United States Patent 11,446,398 (REGULATED BIOCIRCUIT SYSTEMS) - sequence listing, part 78

SEQ ID NO: 180940 - DNA, 3051 bp, Homo sapiens
  Payload ID: 15633
  Gene Symbol: SH2D3C
  Gene Name: SH2 domain containing 3C
  Uniprot ID: Q8N5H7
  ENST ID: ENST00000373276
  CDS Start-End: 245-2623
cgtgtctgggggcgtggtctacaggtcagtctccgcccccggagtccggcactgagctctgcagctcagtggcccgagaaaggcaggagccgctgggtttaggaggtccccgggttgccggcggcgacagcgggggaagcatgactgctgtgggccgaaggtgccccgcgctggggtcccgagggttttgagacttgggtggcagctgtcagggcccagcatcctcagctccgctctgggaagaatggcccctgctctgccttctcctcacaaggctgtcgcccgtcctgagctcctgctggacactgcagcccactcaggaaaactgagggctccagacggtggagagggagcagaatgtgctgggcacaatggtggcccatcttggggagtggggcagggccaaagccaagagccttcccggcagggaatcccacaggccccatggctggtgtcctggcagagacggggctttccacccagctctttttgcccagggcctttaaggactgagaagctcagagcaggcaggtgcccgttgcttctctgcggtggggctgctggagagccagaggctggcagcgactatgtgaagttctccaaggagaagtacatcctggactcatcgccagagaaactccacaaggaattggaggaggagctcaaactcagcagcacggatctccgcagccatgcctggtaccatggccgcatcccccgagaggtctcggagaccttggtacaacgcaacggcgacttcctcatccgggactcactcaccagcctgggcgactatgtgctcacgtgccgctggcgcaaccaggccttgcacttcaagatcaacaaggtggtggtgaaggcaggcgagagctacacacacatccagtacctgtttgagcaggagagctttgaccacgtgcccgccctcgtgcgctatcatgtgggcagccgcaaggctgtgtcagagcagagtggtgccatcatctactgcccggtgaaccgcaccttcccactgcgctacctcgaggccagctatggcctgggacaggggagtagcaagcctgctagccccgtcagcccctcaggccccaagggcagccacatgaagcggcgcagcgtcaccatgaccgatgggctcactgctgacaaggtcacccgcagcgatggctgccccaccagtacgtcgctgccccgccctcgggactccatccgcagctgtgccctcagcatggaccagatcccagacctgcactcacccatgtcgcccatctccgagagccctagctcccctgcctacagcactgtaacccgtgtccatgccgcccctgcagccccttctgccacagcattgcctgcctcccctgtcgcccgccgttccagtgagccccagctgtgtcccggaagtgccccaaagacccatggggagtcagacaagggcccccacaccagcccctcccacacccttggcaaggcctccccgtcaccatcactcagcagctacagtgacccggactctggccactactgccagctccagcctcccgtgcgtggcagccgagagtgggcagcgactgagacctccagccagcaggccaggagctatggggagaggctaaaggaactgtcagaaaatggggcccctgaaggggactggggcaagaccttcacagtccccatcgtggaagtcacttcttccttcaacccggccaccttccagtcactactgatccccagggataaccggccactggaggtgggccttctgcgcaaggtcaaggagctgctggcagaagtggatgcccggacgctggcccggcatgtcaccaaggtggactgcctggttgctaggatactgggcgttaccaaggagatgcagaccctaatgggagtccgctggggcatggaactgctcaccctcccccatggccggcagctacgcctagacctgctggaaaggttccacaccatgtccatcatgctggccgtggacatcctgggctgcaccggctctgcggaggagcgggcagcgctgctgcacaagaccattcagctggcggccgagctgcgggggactatgggcaacatgttcagcttcgcggcggtcatgggtgccctggacatggcccagatttctcggctggagcagacatgggtgaccctgcggcagcgacacacagagggtgccatcctgtacgagaagaagctcaagccttttctcaagagcctcaacgagggcaaagaaggcccgccgctgagcaacaccacgtttcctcatgtgctgcccctcatcaccctgctggagtgtgactcggccccaccagagggccctgagccctggggcagcacggagcacggcgtggaggtggtgctggctcacctggaggccgcccgcacagtggcacaccacggaggcctgtaccacaccaatgctgaagtcaagctgcaggggttccaggcccggccggagctcctggaggtgttcagcacggagttccagatgcgccttctctggggcagtcagggtgccagcagcagccaggcccggcgctatgagaagttcgacaaggtcctcactgccctgtcccacaagctggaacctgctgtccgctccagcgagctgtgaccccagggacatttcccctctgcagctgcggacagcgtcaggggcagaggggcacacaactttccccagagcaccccaaggacactgtgatcaacccgagaatgttctgggttcaactcaagcatctcccttgcacctccagggtcctgcgtggactctgggttccatcccacctgctacatgctcaccaggtctccattgaggaagaacaggaacgccggttcccccaccagcttttgctgctccccttcctgctggggttccctgttttcgagccatgggaggcaggctgctcacgcctcctcactctctgtctgtccctcaccaacaccaaggcctccatctcactgtaaataagtctctgttctgtaaatagatgtacagaagccatgttatttctttcatataataaacttttatgactcttt

SEQ ID NO: 180941 - DNA, 2750 bp, Homo sapiens
  Payload ID: 15633
  Gene Symbol: SH2D3C
  Gene Name: SH2 domain containing 3C
  Uniprot ID: Q8N5H7
  ENST ID: ENST00000373277
  CDS Start-End: 210-2321
gaggcggagagcgtccttccctgccggtggagtaggcggtggagtggggccgggcaaggagcgcaggggcgtgtctgggggcgtggtctacaggtcagtctccgcccccggagtccggcactgagctctgcagctcagtggcccgagaaaggcaggagccgctgggtttaggaggtccccgggttgccggcggcgacagcgggggaagcatgactgctgtgggccgaaggtgccccgcgctggggtcccgaggggctgctggagagccagaggctggcagcgactatgtgaagttctccaaggagaagtacatcctggactcatcgccagagaaactccacaaggaattggaggaggagctcaaactcagcagcacggatctccgcagccatgcctggtaccatggccgcatcccccgagaggtctcggagaccttggtacaacgcaacggcgacttcctcatccgggactcactcaccagcctgggcgactatgtgctcacgtgccgctggcgcaaccaggccttgcacttcaagatcaacaaggtggtggtgaaggcaggcgagagctacacacacatccagtacctgtttgagcaggagagctttgaccacgtgcccgccctcgtgcgctatcatgtgggcagccgcaaggctgtgtcagagcagagtggtgccatcatctactgcccggtgaaccgcaccttcccactgcgctacctcgaggccagctatggcctgggacaggggagtagcaagcctgctagccccgtcagcccctcaggccccaagggcagccacatgaagcggcgcagcgtcaccatgaccgatgggctcactgctgacaaggtcacccgcagcgatggctgccccaccagtacgtcgctgccccgccctcgggactccatccgcagctgtgccctcagcatggaccagatcccagacctgcactcacccatgtcgcccatctccgagagccctagctcccctgcctacagcactgtaacccgtgtccatgccgcccctgcagccccttctgccacagcattgcctgcctcccctgtcgcccgccgttccagtgagccccagctgtgtcccggaagtgccccaaagacccatggggagtcagacaagggcccccacaccagcccctcccacacccttggcaaggcctccccgtcaccatcactcagcagctacagtgacccggactctggccactactgccagctccagcctcccgtgcgtggcagccgagagtgggcagcgactgagacctccagccagcaggccaggagctatggggagaggctaaaggaactgtcagaaaatggggcccctgaaggggactggggcaagaccttcacagtccccatcgtggaagtcacttcttccttcaacccggccaccttccagtcactactgatccccagggataaccggccactggaggtgggccttctgcgcaaggtcaaggagctgctggcagaagtggatgcccggacgctggcccggcatgtcaccaaggtggactgcctggttgctaggatactgggcgttaccaaggagatgcagaccctaatgggagtccgctggggcatggaactgctcaccctcccccatggccggcagctacgcctagacctgctggaaaggttccacaccatgtccatcatgctggccgtggacatcctgggctgcaccggctctgcggaggagcgggcagcgctgctgcacaagaccattcagctggcggccgagctgcgggggactatgggcaacatgttcagcttcgcggcggtcatgggtgccctggacatggcccagatttctcggctggagcagacatgggtgaccctgcggcagcgacacacagagggtgccatcctgtacgagaagaagctcaagccttttctcaagagcctcaacgagggcaaagaaggcccgccgctgagcaacaccacgtttcctcatgtgctgcccctcatcaccctgctggagtgtgactcggccccaccagagggccctgagccctggggcagcacggagcacggcgtggaggtggtgctggctcacctggaggccgcccgcacagtggcacaccacggaggcctgtaccacaccaatgctgaagtcaagctgcaggggttccaggcccggccggagctcctggaggtgttcagcacggagttccagatgcgccttctctggggcagtcagggtgccagcagcagccaggcccggcgctatgagaagttcgacaaggtcctcactgccctgtcccacaagctggaacctgctgtccgctccagcgagctgtgaccccagggacatttcccctctgcagctgcggacagcgtcaggggcagaggggcacacaactttccccagagcaccccaaggacactgtgatcaacccgagaatgttctgggttcaactcaagcatctcccttgcacctccagggtcctgcgtggactctgggttccatcccacctgctacatgctcaccaggtctccattgaggaagaacaggaacgccggttcccccaccagcttttgctgctccccttcctgctggggttccctgttttcgagccatgggaggcaggctgctcacgcctcctcactctctgtctgtccctcaccaacaccaaggcctccatctcactgtaaataagtctctgttctgtaaatagatgtacagaagccatgttatttctttcatataataaacttttatgactcttta

SEQ ID NO: 180942 - DNA, 2682 bp, Homo sapiens
  Payload ID: 15633
  Gene Symbol: SH2D3C
  Gene Name: SH2 domain containing 3C
  Uniprot ID: Q8N5H7
  ENST ID: ENST00000420366
  CDS Start-End: 146-2254
cccgctcctcccccgacaaggcgatgaggtaatcgcgccgctgagaggcacgcgcagccggtgcctagccggttggtccctgcgcccctgccccgccggccaccgcccccccacaccgtcccggccccggcagcctggccccaccatgaccgagcggtgcagcctgtggagtgccctgtcggccgccgcctgctgcttctaccgcggctccttcgtgcaggtgcagttctccaaggagaagtacatcctggactcatcgccagagaaactccacaaggaattggaggaggagctcaaactcagcagcacggatctccgcagccatgcctggtaccatggccgcatcccccgagaggtctcggagaccttggtacaacgcaacggcgacttcctcatccgggactcactcaccagcctgggcgactatgtgctcacgtgccgctggcgcaaccaggccttgcacttcaagatcaacaaggtggtggtgaaggcaggcgagagctacacacacatccagtacctgtttgagcaggagagctttgaccacgtgcccgccctcgtgcgctatcatgtgggcagccgcaaggctgtgtcagagcagagtggtgccatcatctactgcccggtgaaccgcaccttcccactgcgctacctcgaggccagctatggcctgggacaggggagtagcaagcctgctagccccgtcagcccctcaggccccaagggcagccacatgaagcggcgcagcgtcaccatgaccgatgggctcactgctgacaaggtcacccgcagcgatggctgccccaccagtacgtcgctgccccgccctcgggactccatccgcagctgtgccctcagcatggaccagatcccagacctgcactcacccatgtcgcccatctccgagagccctagctcccctgcctacagcactgtaacccgtgtccatgccgcccctgcagccccttctgccacagcattgcctgcctcccctgtcgcccgccgttccagtgagccccagctgtgtcccggaagtgccccaaagacccatggggagtcagacaagggcccccacaccagcccctcccacacccttggcaaggcctccccgtcaccatcactcagcagctacagtgacccggactctggccactactgccagctccagcctcccgtgcgtggcagccgagagtgggcagcgactgagacctccagccagcaggccaggagctatggggagaggctaaaggaactgtcagaaaatggggcccctgaaggggactggggcaagaccttcacagtccccatcgtggaagtcacttcttccttcaacccggccaccttccagtcactactgatccccagggataaccggccactggaggtgggccttctgcgcaaggtcaaggagctgctggcagaagtggatgcccggacgctggcccggcatgtcaccaaggtggactgcctggttgctaggatactgggcgttaccaaggagatgcagaccctaatgggagtccgctggggcatggaactgctcaccctcccccatggccggcagctacgcctagacctgctggaaaggttccacaccatgtccatcatgctggccgtggacatcctgggctgcaccggctctgcggaggagcgggcagcgctgctgcacaagaccattcagctggcggccgagctgcgggggactatgggcaacatgttcagcttcgcggcggtcatgggtgccctggacatggcccagatttctcggctggagcagacatgggtgaccctgcggcagcgacacacagagggtgccatcctgtacgagaagaagctcaagccttttctcaagagcctcaacgagggcaaagaaggcccgccgctgagcaacaccacgtttcctcatgtgctgcccctcatcaccctgctggagtgtgactcggccccaccagagggccctgagccctggggcagcacggagcacggcgtggaggtggtgctggctcacctggaggccgcccgcacagtggcacaccacggaggcctgtaccacaccaatgctgaagtcaagctgcaggggttccaggcccggccggagctcctggaggtgttcagcacggagttccagatgcgccttctctggggcagtcagggtgccagcagcagccaggcccggcgctatgagaagttcgacaaggtcctcactgccctgtcccacaagctggaacctgctgtccgctccagcgagctgtgaccccagggacatttcccctctgcagctgcggacagcgtcaggggcagaggggcacacaactttccccagagcaccccaaggacactgtgatcaacccgagaatgttctgggttcaactcaagcatctcccttgcacctccagggtcctgcgtggactctgggttccatcccacctgctacatgctcaccaggtctccattgaggaagaacaggaacgccggttcccccaccagcttttgctgctccccttcctgctggggttccctgttttcgagccatgggaggcaggctgctcacgcctcctcactctctgtctgtccctcaccaacaccaaggcctccatctcactgtaaataagtctctgttctgtaaatagatgtacagaagccatgttatttctttcatataataaacttttatgactcttt

SEQ ID NO: 180943 - DNA, 2794 bp, Homo sapiens
  Payload ID: 15633
  Gene Symbol: SH2D3C
  Gene Name: SH2 domain containing 3C
  Uniprot ID: Q8N5H7
  ENST ID: ENST00000429553
  CDS Start-End: 846-2366
agatatccaaggggaggcgtccaggaggtagttgggtttccaagtctggggttggaggggcaggtccaggctgcctgagggtaggggtagcatttaaggccatgcggtggggggagtggttcacggtggccctcaggaggaaggaaggaaaaacagccgtctctggcctctggcctctccaggctctccaccctgggggcagaatcaattctgtagccctctagcaccggcagtggctccgcagtcagctgggcagtggccgtgactgggtcactctaccctaggaagtgagtgcaggggctgctggagagccagaggctggcagcgactatgtgaagttctccaaggagaagtacatcctggactcatcgccagagaaactccacaaggaattggaggaggagctcaaactcagcagcacggatctccgcagccatgcctggtaccatggccgcatcccccgagaggtctcggagaccttggtacaacgcaacggcgacttcctcatccgggactcactcaccagcctgggcgactatgtgctcacgtgccgctggcgcaaccaggccttgcacttcaagatcaacaaggtggtggtgaaggcaggcgagagctacacacacatccagtacctgtttgagcaggagagctttgaccacgtgcccgccctcgtgcgctatcatgtgggcagccgcaaggctgtgtcagagcagagtggtgccatcatctactgcccggtgaaccgcaccttcccactgcgctacctcgaggccagctatggcctgggacaggggagtagcaagcctgctagccccgtcagcccctcaggccccaagggcagccacatgaagcggcgcagcgtcaccatgaccgatgggctcactgctgacaaggtcacccgcagcgatggctgccccaccagtacgtcgctgccccgccctcgggactccatccgcagctgtgccctcagcatggaccagatcccagacctgcactcacccatgtcgcccatctccgagagccctagctcccctgcctacagcactgtaacccgtgtccatgccgcccctgcagccccttctgccacagcattgcctgcctcccctgtcgcccgccgttccagtgagccccagctgtgtcccggaagtgccccaaagacccatggggagtcagacaagggcccccacaccagcccctcccacacccttggcaaggcctccccgtcaccatcactcagcagctacagtgacccggactctggccactactgccagctccagcctcccgtgcgtggcagccgagagtgggcagcgactgagacctccagccagcaggccaggagctatggggagaggctaaaggaactgtcagaaaatggggcccctgaaggggactggggcaagaccttcacagtccccatcgtggaagtcacttcttccttcaacccggccaccttccagtcactactgatccccagggataaccggccactggaggtgggccttctgcgcaaggtcaaggagctgctggcagaagtggatgcccggacgctggcccggcatgtcaccaaggtggactgcctggttgctaggatactgggcgttaccaaggagatgcagaccctaatgggagtccgctggggcatggaactgctcaccctcccccatggccggcagctacgcctagacctgctggaaaggttccacaccatgtccatcatgctggccgtggacatcctgggctgcaccggctctgcggaggagcgggcagcgctgctgcacaagaccattcagctggcggccgagctgcgggggactatgggcaacatgttcagcttcgcggcggtcatgggtgccctggacatggcccagatttctcggctggagcagacatgggtgaccctgcggcagcgacacacagagggtgccatcctgtacgagaagaagctcaagccttttctcaagagcctcaacgagggcaaagaaggcccgccgctgagcaacaccacgtttcctcatgtgctgcccctcatcaccctgctggagtgtgactcggccccaccagagggccctgagccctggggcagcacggagcacggcgtggaggtggtgctggctcacctggaggccgcccgcacagtggcacaccacggaggcctgtaccacaccaatgctgaagtcaagctgcaggggttccaggcccggccggagctcctggaggtgttcagcacggagttccagatgcgccttctctggggcagtcagggtgccagcagcagccaggcccggcgctatgagaagttcgacaaggtcctcactgccctgtcccacaagctggaacctgctgtccgctccagcgagctgtgaccccagggacatttcccctctgcagctgcggacagcgtcaggggcagaggggcacacaactttccccagagcaccccaaggacactgtgatcaacccgagaatgttctgggttcaactcaagcatctcccttgcacctccagggtcctgcgtggactctgggttccatcccacctgctacatgctcaccaggtctccattgaggaagaacaggaacgccggttcccccaccagcttttgctgctccccttcctgctggggttccctgttttcgagccatgggaggcaggctgctcacgcctcctcactctctgtctgtccctcaccaacaccaaggcctccatctcactgtaaataagtctctgttctgtaaatagatgtacagaagccatgttatttctttcatataataaacttttatgactcttt

SEQ ID NO: 180944 - DNA, 976 bp, Homo sapiens
  Payload ID: 15633
  Gene Symbol: SH2D3C
  Gene Name: SH2 domain containing 3C
  ENST ID: ENST00000440630
  CDS Start-End: 573-976
atatccaaggggaggcgtccaggagggctgctggagagccagaggctggcagcgactatgtgaagttctccaaggagaagtacatcctggactcatcgccagagaaactccacaaggaattggaggaggagctcaaactcagcagcacggatctccgcagccatgcctggtaccatggccgcatcccccgagaggtctcggagaccttggtacaacgcaacggcgacttcctcatccgggactcactcaccagcctgggcgactatgtgctcacgtgccgctggcgcaaccaggccttgcacttcaagatcaacaaggtggtggtgaaggcaggcgagagctacacacacatccagtacctgtttgagcaggagagctttgaccacgtgcccgccctcgtgcgctatcatgtgggcagccgcaaggctgtgtcagagcagagtggtgccatcatctactgcccggtgaaccgcaccttcccactgcgctacctcgaggccagctatggcctgggacaggggagtagcaagcctgctagccccgtcagcccctcaggccccaagggcagccacatgaagcggcgcagcgtcaccatgaccgatgggctcactgctgacaaggtcacccgcagcgatggctgccccaccagtacgtcgctgccccgccctcgggactccatccgcagctgtgccctcagcatggaccagatcccagacctgcactcacccatgtcgcccatctccgagagccctagctcccctgcctacagcactgtaacccgtgtccatgccgcccctgcagccccttctgccacagcattgcctgcctcccctgtcgcccgccgttccagtgagccccagctgtgtcccggaagtgccccaaagacccatggggagtcagacaagggcccccacaccagcccctcccacacccttggcaaggcctccccgtcaccatcactcagcagctacagtga

SEQ ID NO: 180945 - DNA, 778 bp, Homo sapiens
  Payload ID: 15633
  Gene Symbol: SH2D3C
  Gene Name: SH2 domain containing 3C
  ENST ID: ENST00000414380
  CDS Start-End: 190-778
ggccgctccgcccggggccctagagccagccggggagctgcagctcagcggcgcccggcagggtcgggctgggctgggcccggccgacccggggagggggcggggtcaccccagcctcacctctgggcgcccaggcgctccgcggggtgagggttcggcggccactcctgggactctgggctgcggtagatgccgttctccaaggagaagtacatcctggactcatcgccagagaaactccacaaggaattggaggaggagctcaaactcagcagcacggatctccgcagccatgcctggtaccatggccgcatcccccgagaggtctcggagaccttggtacaacgcaacggcgacttcctcatccgggactcactcaccagcctgggcgactatgtgctcacgtgccgctggcgcaaccaggccttgcacttcaagatcaacaaggtggtggtgaaggcaggcgagagctacacacacatccagtacctgtttgagcaggagagctttgaccacgtgcccgccctcgtgcgctatcatgtgggcagccgcaaggctgtgtcagagcagagtggtgccatcatctactgcccggtgaaccgcaccttcccactgcgctacctcgaggccagctatggcctgggacaggggagtagcaagcctgctagccccgtcagcccctcaggccccaagggcagccacatgaagcggcgcagcgtcaccatgaccgatgggctcactgctgacaaggtcacccgcagcgatggctgccccacca

SEQ ID NO: 180946 - DNA, 2478 bp, Homo sapiens
  Payload ID: 15633
  Gene Symbol: SH2D3C
  Gene Name: SH2 domain containing 3C
  Uniprot ID: Q8N5H7
  ENST ID: ENST00000629203
  CDS Start-End: 116-2218
aatcgcgccgctgagaggcacgcgcagccggtgcctagccggttggtccctgcgcccctgccccgccggccaccgcccccccacaccgtcccggccccggcagcctggccccaccatgaccgagcggtgcagcctgtggagtgccctgtcggccgccgcctgctgcttctaccgcggctccttcgtgcagttctccaaggagaagtacatcctggactcatcgccagagaaactccacaaggaattggaggaggagctcaaactcagcagcacggatctccgcagccatgcctggtaccatggccgcatcccccgagaggtctcggagaccttggtacaacgcaacggcgacttcctcatccgggactcactcaccagcctgggcgactatgtgctcacgtgccgctggcgcaaccaggccttgcacttcaagatcaacaaggtggtggtgaaggcaggcgagagctacacacacatccagtacctgtttgagcaggagagctttgaccacgtgcccgccctcgtgcgctatcatgtgggcagccgcaaggctgtgtcagagcagagtggtgccatcatctactgcccggtgaaccgcaccttcccactgcgctacctcgaggccagctatggcctgggacaggggagtagcaagcctgctagccccgtcagcccctcaggccccaagggcagccacatgaagcggcgcagcgtcaccatgaccgatgggctcactgctgacaaggtcacccgcagcgatggctgccccaccagtacgtcgctgccccgccctcgggactccatccgcagctgtgccctcagcatggaccagatcccagacctgcactcacccatgtcgcccatctccgagagccctagctcccctgcctacagcactgtaacccgtgtccatgccgcccctgcagccccttctgccacagcattgcctgcctcccctgtcgcccgccgttccagtgagccccagctgtgtcccggaagtgccccaaagacccatggggagtcagacaagggcccccacaccagcccctcccacacccttggcaaggcctccccgtcaccatcactcagcagctacagtgacccggactctggccactactgccagctccagcctcccgtgcgtggcagccgagagtgggcagcgactgagacctccagccagcaggccaggagctatggggagaggctaaaggaactgtcagaaaatggggcccctgaaggggactggggcaagaccttcacagtccccatcgtggaagtcacttcttccttcaacccggccaccttccagtcactactgatccccagggataaccggccactggaggtgggccttctgcgcaaggtcaaggagctgctggcagaagtggatgcccggacgctggcccggcatgtcaccaaggtggactgcctggttgctaggatactgggcgttaccaaggagatgcagaccctaatgggagtccgctggggcatggaactgctcaccctcccccatggccggcagctacgcctagacctgctggaaaggttccacaccatgtccatcatgctggccgtggacatcctgggctgcaccggctctgcggaggagcgggcagcgctgctgcacaagaccattcagctggcggccgagctgcgggggactatgggcaacatgttcagcttcgcggcggtcatgggtgccctggacatggcccagatttctcggctggagcagacatgggtgaccctgcggcagcgacacacagagggtgccatcctgtacgagaagaagctcaagccttttctcaagagcctcaacgagggcaaagaaggcccgccgctgagcaacaccacgtttcctcatgtgctgcccctcatcaccctgctggagtgtgactcggccccaccagagggccctgagccctggggcagcacggagcacggcgtggaggtggtgctggctcacctggaggccgcccgcacagtggcacaccacggaggcctgtaccacaccaatgctgaagtcaagctgcaggggttccaggcccggccggagctcctggaggtgttcagcacggagttccagatgcgccttctctggggcagtcagggtgccagcagcagccaggcccggcgctatgagaagttcgacaaggtcctcactgccctgtcccacaagctggaacctgctgtccgctccagcgagctgtgaccccagggacatttcccctctgcagctgcggacagcgtcaggggcagaggggcacacaactttccccagagcaccccaaggacactgtgatcaacccgagaatgttctgggttcaactcaagcatctcccttgcacctccagggtcctgcgtggactctgggttccatcccacctgctacatgctcaccaggtctccattgaggaagaacaggaacgccggttcccccaccagcttttgctgctccccttcctgctgggg

SEQ ID NO: 180947 - DNA, 3352 bp, Homo sapiens
  Payload ID: 15634
  Gene Symbol: SH2D4A
  Gene Name: SH2 domain containing 4A
  Uniprot ID: Q9H788
  ENST ID: ENST00000265807
  CDS Start-End: 412-1776
agtcaccccggcatgtgggcgcggcggggcggcgcgggcgggacggctacaagagctgttttgcgtccgggccggagtatttgctcagcccgcctgcgccgcttgggacgcctctgcctttccctccctcccttccccgacggcttctggcggccaagtggatgtggcgggtgatcgagccaccctgcccaggggcgcccagcactggttcagtgaacagcattttggacaggacatttggtgccaggtctgagtagccagtttgctgaattattgtcccagtcagccaggattgtgagctgtttgggaagtttcgtggaaacgcccaagtgccagcacaggtggagggacacctggaggccagtttcaggaacttttgccacaagtataaaagacttcagaagtgcaaagatgctgaaacagatactgtcggagatgtacatagatcctgatctactggcagagctcagcgaagaacagaaacagatcctgttcttcaagatgagagaggaacagatccgacgatggaaagaaagagaagcagctatggaaagaaaggagtccctgccagtgaaacccagaccaaagaaagagaatggcaaatcggttcattggaaacttggagctgataaggaagtctgggtatgggtgatgggcgaacaccatctagataaaccctatgatgtgctctgtaatgaaattattgctgagagggcccggctgaaagcagaacaggaggcagaagagcccagaaaaactcactctgaagaattcaccaatagcttgaaaacaaaatcacagtaccatgatctgcaggctccggataaccagcagactaaagacatctggaagaaagtggcagaaaaggaggaactggagcaaggatcgaggccagcaccaaccctggaagaagagaaaatccgatcactctccagttcttcaagaaatattcaacaaatgttggcagattcaatcaatcgtatgaaggcatatgcatttcaccagaagaaagaatctatgaagaaaaaacaagatgaagaaataaatcaaatagaagaagagagaacgaagcagatttgtaagagctggaaagaagactcggaatggcaggcatctctgcgaaaatccaaagcagctgatgagaagagacgctccttggctaaacaagcacgagaagactacaagaggttatccctcggggcccagaaaggaagaggcggtgagaggctgcaaagccccttgcgtgttccgcagaaaccagaaagacctccccttccacccaagcctcagttcctaaactcaggggcatatcctcaaaaacctcttagaaatcagggagtggtgaggacactgtccagctctgcccaagaggacatcatccggtggtttaaagaggagcagctaccacttcgagcgggctaccagaaaacctcagacaccatagccccctggttccatggaattctcacactcaagaaagcaaatgaacttcttctgagcacaggcatgcccggcagttttctcatccgagtcagtgaaaggatcaaaggctatgccctgtcctatctgtcggaggacggctgtaaacatttcctcatcgatgcctctgcagacgcctacagcttcctgggcgtggaccagctacagcatgccaccttggcggatttggtggaatatcacaaggaggaacccatcacttccctggggaaggagctccttctctatccctgtggtcagcaggaccagctgcctgactacctggagctgtttgagtgacagcctccatcagggtcatcctacagcctccaagcgggctttcccctggacaaatgccactgcaacatttatgtgtgaagccaaaatcaccctgcagcagagccaatactgatcaactgaaagtaaagtatccatggagtcctcattgacacctcttttctgcacaaatactggaattcaatgtcaagagaaaatgacctctgctcaaaagggagaagagtctcaatttcagcaagtacctgtcatgaagggtatgaccttaatgatgtacataaaataaaacaaatgaagaaatggaaaacttttagaaattaaggtgtacttgaaaacgaatatctatcatatgacccctgcactccctctgtatcatctcaggaggtttcaggggcctgttgacatgaagtttcgaagtttcatgttggctttggaatggtagcaaaagcctttcctggctgagatgatgcttaaaacacacctcacttattgtacatgttggaaccaggacatgagagacatagaaaaacagaagtcatgaatgtaaattgaatgagaggcttaacatgcatgaaaatacagatggacctgcaggaaagtgagcaaacatcgctgagtttgttttcttgttcgggagaatggggccggggctggcctggcctcccctggatatactctatagtgcaccaaaaggataaagcatctgtacatgtatttttttattttttatcagaagtgcttagacaagaacagaataagcaggctgtttggatgctacttgtggttgaattgtgttcccccaaaatatatggtgaagtcttaacccccatccccgtgaatgggaccttgtttggaaatagggtctttgcagatatagtcaagatgaggtcacattggattagggtgggccccaaatccaatgactggcatccttaggagaagagagagttttggtaatagacacaaatgcagtgggaagaagaccaggggacaagaggcaagttggagtgatgcagccggaagggaagggacaccaaggatctccggccaccagcagaagccagcagagaggcatgggacaggttccccacaagccttagaaggaagcatggccctgacttcagaattccagactccagaactggaagaataaatgtctgttgttttaagctgcttagttcatgctgagttcatgctgacttgttactatagccccagaaagctaatacagtcgtttatgtaattacataacctgacacacaagatcgacccattcactgctgcccagtccaccattttcataatgaagtagaaatgggaggtaagaaaaacattccagccagttctgtttagccctggcacacatatttgtcccgtcaggaatcttatgccctcctggaacccccgcccacctcagtccagtcccagtcaggcgaacggcctctggacagggactgaggtggctctgagccactggagatcatttttcttggaggatggagattggctagtacctctggcctaactgtgtaggtcaatactcttttacattgccttctaataaaagcagaatgatacagca

SEQ ID NO: 180948 - DNA, 567 bp, Homo sapiens
  Payload ID: 15634
  Gene Symbol: SH2D4A
  Gene Name: SH2 domain containing 4A
  ENST ID: ENST00000523736
  CDS Start-End: 1-567
ctactggcagagctcagcgaagaacagaaacagatcctgttcttcaagatgagagaggaacagatccgacgatggaaagaaagagaagcagctatggaaagaaaggagtccctgccagtgaaacccagaccaaagaaagagaatggcaaatcggttcattggaaacttggagctgataaggaagtctgggtatgggtgatgggcgaacaccatctagataaaccctatgatgtgctctgtaatgaaattattgctgagagggcccggctgaaagcagaacaggaggcagaagagcccagaaaaactcactctgaagaattcaccaatagcttgaaaacaaaatcacagtaccatgatctgcaggctccggataaccagcagactaaagacatctggaagaaagtggcagaaaaggaggaactggagcaaggatcgaggccagcaccaaccctggaagaagagaaaatccgaaagaaagaatctatgaagaaaaaacaagatgaagaaataaatcaaatagaagaagagagaacgaagcagatttgtaagagctggaaagaagactcg

SEQ ID NO: 180949 - DNA, 1984 bp, Homo sapiens
  Payload ID: 15634
  Gene Symbol: SH2D4A
  Gene Name: SH2 domain containing 4A
  Uniprot ID: Q9H788
  ENST ID: ENST00000519207
  CDS Start-End: 309-1673
cggcgcccggggcgggctcaggtgcggggttgggcggcgagagcggccgcggcgggtgtccggtgtccggtgtccggtgtccggtgtctggagccgctggctaggttcagtgaacagcattttggacaggacatttggtgccaggtctgagtagccagtttgctgaattattgtcccagtcagccaggattgtgagctgtttgggaagtttcgtggaaacgcccaagtgccagcacaggtggagggacacctggaggccagtttcaggaacttttgccacaagtataaaagacttcagaagtgcaaagatgctgaaacagatactgtcggagatgtacatagatcctgatctactggcagagctcagcgaagaacagaaacagatcctgttcttcaagatgagagaggaacagatccgacgatggaaagaaagagaagcagctatggaaagaaaggagtccctgccagtgaaacccagaccaaagaaagagaatggcaaatcggttcattggaaacttggagctgataaggaagtctgggtatgggtgatgggcgaacaccatctagataaaccctatgatgtgctctgtaatgaaattattgctgagagggcccggctgaaagcagaacaggaggcagaagagcccagaaaaactcactctgaagaattcaccaatagcttgaaaacaaaatcacagtaccatgatctgcaggctccggataaccagcagactaaagacatctggaagaaagtggcagaaaaggaggaactggagcaaggatcgaggccagcaccaaccctggaagaagagaaaatccgatcactctccagttcttcaagaaatattcaacaaatgttggcagattcaatcaatcgtatgaaggcatatgcatttcaccagaagaaagaatctatgaagaaaaaacaagatgaagaaataaatcaaatagaagaagagagaacgaagcagatttgtaagagctggaaagaagactcggaatggcaggcatctctgcgaaaatccaaagcagctgatgagaagagacgctccttggctaaacaagcacgagaagactacaagaggttatccctcggggcccagaaaggaagaggcggtgagaggctgcaaagccccttgcgtgttccgcagaaaccagaaagacctccccttccacccaagcctcagttcctaaactcaggggcatatcctcaaaaacctcttagaaatcagggagtggtgaggacactgtccagctctgcccaagaggacatcatccggtggtttaaagaggagcagctaccacttcgagcgggctaccagaaaacctcagacaccatagccccctggttccatggaattctcacactcaagaaagcaaatgaacttcttctgagcacaggcatgcccggcagttttctcatccgagtcagtgaaaggatcaaaggctatgccctgtcctatctgtcggaggacggctgtaaacatttcctcatcgatgcctctgcagacgcctacagcttcctgggcgtggaccagctacagcatgccaccttggcggatttggtggaatatcacaaggaggaacccatcacttccctggggaaggagctccttctctatccctgtggtcagcaggaccagctgcctgactacctggagctgtttgagtgacagcctccatcagggtcatcctacagcctccaagcgggctttcccctggacaaatgccactgcaacatttatgtgtgaagccaaaatcaccctgcagcagagccaatactgatcaactgaaagtaaagtatccatggagtcctcattgacacctcttttctgcacaaatactggaattcaatgtcaagagaaaatgacctctgctcaaaagggagaagagtctcaatttcagcaagtacctgtcatgaagggtatgaccttaatgatgtacataaaataaaacaaatgaagaaatggaaaacttttagaaa

SEQ ID NO: 180950 - DNA, 1697 bp, Homo sapiens
  Payload ID: 15634
  Gene Symbol: SH2D4A
  Gene Name: SH2 domain containing 4A
  Uniprot ID: Q9H788
  ENST ID: ENST00000518040
  CDS Start-End: 83-1312
tttgctcagcccgcctgcgccgcttgggacgcctctgcctttccctccctcccttccccgacggcttctggcggccaagtggatgtggcgggtgatcgagccaccctgcccaggggcgcccagcactgagaatggcaaatcggttcattggaaacttggagctgataaggaagtctgggtatgggtgatgggcgaacaccatctagataaaccctatgatgtgctctgtaatgaaattattgctgagagggcccggctgaaagcagaacaggaggcagaagagcccagaaaaactcactctgaagaattcaccaatagcttgaaaacaaaatcacagtaccatgatctgcaggctccggataaccagcagactaaagacatctggaagaaagtggcagaaaaggaggaactggagcaaggatcgaggccagcaccaaccctggaagaagagaaaatccgatcactctccagttcttcaagaaatattcaacaaatgttggcagattcaatcaatcgtatgaaggcatatgcatttcaccagaagaaagaatctatgaagaaaaaacaagatgaagaaataaatcaaatagaagaagagagaacgaagcagatttgtaagagctggaaagaagactcggaatggcaggcatctctgcgaaaatccaaagcagctgatgagaagagacgctccttggctaaacaagcacgagaagactacaagaggttatccctcggggcccagaaaggaagaggcggtgagaggctgcaaagccccttgcgtgttccgcagaaaccagaaagacctccccttccacccaagcctcagttcctaaactcaggggcatatcctcaaaaacctcttagaaatcagggagtggtgaggacactgtccagctctgcccaagaggacatcatccggtggtttaaagaggagcagctaccacttcgagcgggctaccagaaaacctcagacaccatagccccctggttccatggaattctcacactcaagaaagcaaatgaacttcttctgagcacaggcatgcccggcagttttctcatccgagtcagtgaaaggatcaaaggctatgccctgtcctatctgtcggaggacggctgtaaacatttcctcatcgatgcctctgcagacgcctacagcttcctgggcgtggaccagctacagcatgccaccttggcggatttggtggaatatcacaaggaggaacccatcacttccctggggaaggagctccttctctatccctgtggtcagcaggaccagctgcctgactacctggagctgtttgagtgacagcctccatcagggtcatcctacagcctccaagcgggctttcccctggacaaatgccactgcaacatttatgtgtgaagccaaaatcaccctgcagcagagccaatactgatcaactgaaagtaaagtatccatggagtcctcattgacacctcttttctgcacaaatactggaattcaatgtcaagagaaaatgacctctgctcaaaagggagaagagtctcaatttcagcaagtacctgtcatgaagggtatgaccttaatgatgtacataaaataaaacaaatgaagaaatggaaaacttttagaaattaaggtgtacttgaaaacgaatatctatcatatgacccctgcactccctctgtatcatctcaggaggtttcag

SEQ ID NO: 180951 - DNA, 2889 bp, Homo sapiens
  Payload ID: 15635
  Gene Symbol: SH2D4B
  Gene Name: SH2 domain containing 4B
  Uniprot ID: Q5SQS7
  ENST ID: ENST00000313455
  CDS Start-End: 79-1008
aaagcagccgtgccgtgtcccagggcgggaattgtgcggggacgggctccacggaggaatcttctcttccttcccttgatgttgccagaggactcaggaggctctccagatgctgcagcgagtgacaagcacatccaatggctcctaggggcagatggcgaggtctgggtctggatcatgggagaaggccctggtgacaagccctacgaagagatctctgaggagctgattgcagagagggcgcggctgcaggcacagagggaagctgaggagctctggagacagaaggaggcagagatcaccaagaagttccgggatgctctggccaatgagaaagcccggatcttggcggagaagtggaaagtggagatggaagaccgcaaggctgccaaagtcctggaggaacgcatccacgaggaattcaagaggaaagaggaagaggagaggaagcgaggagaagagcagattcgcctccaggaagagcagagggcgaaggagctctactggaccctgaagcaggctcagctgcattgccaagccagtgagaaagaggagcgagagtgggaagaacagttgcgccggtccaaggcggctgatgaggagaggagccgccgagcccagcgcgcccgggacgagtaccgacaccactcgctccgtgctatccagaagggcacggtcgctggcctcagctccatgttccgggagcttggccagagccatgagcaggaggcaagactctaccaccacctccccgacccgggtctgccgcagccccttgccctgccggtcagcaggacctgggagcgcccgctgcgcccagtctccagagatgtcatcgtccgctggtttaaggaggagcagctgcctcgccgagctggcttcgagaggaacaccaagttcatcgccccctggttccatggaggaaattatcactgtttcaggaggagagttacttcaggaaccctgcggacagagggacagcccaccagactaccatctgttgtttgaataatttttttccttatcaattggattcattttggtatcctgtttttgaactcagcttaagaacttctcatctcaaatcctatggccttctggaagatccaccactatccaaaggaaaaagtagattaatatgcctcaagggatatgacatctatggcatagggctactggtctcatcccagcgatcgggacagaaattgctaatagctcatgcaactctttcatgaagagcttagctatgaccttagaagacaaagcctgtttgtcatggctgccgtaaaccgagctcttacagtgcgtggaccatgttttaataatccaaaataattccagtgccgaaccctgaatttaacatatggtagacattcagtaaatgtttgttgaatgaatgcatgtcttctaaaagttttccaacacaaattagcagtggtttcttgtaaattatttcctactcgccactctataaaatcatggcaataatagaagattatgaaggatttctatggaggacataaatgctgcatctttcataatctccattatcaccctcattgatattatcattggaattatctaaggtgagccccagtttccagggcagctgattgacaccgtcctgccttccttatttaacctcttcttttgccactcgcctctatctttgaatcatattttggccttggttttgcaatggttttatgtcatcctacagatgtcttcaagacctggggtgagttatcaatgcaagaatggttcttagaaatctgatgaggcctctgctctctgggatgtggccctctctatgcaggttactccaatgattagctctgtcctcattgtccttttaattcccttgtcaacttaatctcagtatgttgcttatattaacaagaagactcacgcaataactcctcgataactctcagtgatggtatctgttggtgcatacttgtgttccacagttatggccatatacacagaggtagtatatgatgaagagaagattacagtctttacagtcaagaagacttgggttcatatcctaaccctggaacttactagcattataatgcttgcagcattgtgtttggtgagaggaaaagaatgaatggattctaggaatgttagggaacgatttactttacccgatggctgtatcaaacatctatgccccacttcttctcttgcctcacctattccttagattcttggtcacttctctaccacaagccaccagcactataaccagttttgcgtgggttctgctcttcctccctatgttgatcagtgtcatgtgagcataagccaatggtagcttgccacatgccccatctcccattgctgcagaggcataagacagaagagatgggaagtgaatgcccgatgtggtgaatctgggatgaatgggagtcataggctggtagatcgctttttcctccttcttcctcctggaggaactattctgagagtcatctgtttgtatggtcttgtagaagacagtcctgtaagatcgagcaaccagtcatgatgaaaccaagtggtggccggatcagtatgacaccctgctgcccccgtttttaattcttctctgccttgccctgctctctcctgttgctctgggattgcacttctgaatgaagtagcagctcataagcttttgccacaggctctgtcttttggggaatccaggataagaacccattatacagaagtgttcaataatatcaattttgcaactcactcagctccatggcttcccccggtctacctgtctcactacatgcataaagtgaaatgatggaaggaatctgctttctgaactctaatgtgccttcattgattatcattaaaattatcattaaaattgccttatttctatgg

SEQ ID NO: 180952 - DNA, 3983 bp, Homo sapiens
  Payload ID: 15635
  Gene Symbol: SH2D4B
  Gene Name: SH2 domain containing 4B
  Uniprot ID: Q5SQS7
  ENST ID: ENST00000339284
  CDS Start-End: 431-1504
actaacagatcactcgacacctaccagcccaggcagggctgggactgggcatttcctggctgagctggaggcttgggcccttcccattgtctcagaaccccaggtgatgccaagacatgggctctcctgggatgccgtgcttggtgacccaggagaaggactagattgctcctggtggttgctcccccttgcagagtcccacctgcccctttgggtcctgttgcctggcctcttttgctgtcctgggtagaggagatgagttcgtcgctggctgcaagctgaggccaactgacaatgctgcacagagaaggggcaccgagagtggccccggattgagcagtccgtagtgcagagcagcccctcgggcgttctgcctggccctgcttcccctgctggctgcccttctggtgcgtgcatcccaggtggcatcatgctgcagcagatcctgcacgacatgtacatcgaccccgagctccttgccgagctcagcgatgtgcagaagcacatcctcttctacaaaatgcgggaggagcagctgaggcgctggaaggagcgggagacttgggaggccctggcccaggacgagggtctcaggcctccaaagaccaagcgagcagcgagtgacaagcacatccaatggctcctaggggcagatggcgaggtctgggtctggatcatgggagaaggccctggtgacaagccctacgaagagatctctgaggagctgattgcagagagggcgcggctgcaggcacagagggaagctgaggagctctggagacagaaggaggcagagatcaccaagaagttccgggatgctctggccaatgagaaagcccggatcttggcggagaagtggaaagtggagatggaagaccgcaaggctgccaaagtcctggaggaacgcatccacgaggaattcaagaggaaagaggaagaggagaggaagcgaggagaagagcagattcgcctccaggaagagcagagggcgaaggagctctactggaccctgaagcaggctcagctgcattgccaagccagtgagaaagaggagcgagagtgggaagaacagttgcgccggtccaaggcggctgatgaggagaggagccgccgagcccagcgcgcccgggacgagtaccgacaccactcgctccgtgctatccagaagggcacggtcgctggcctcagctccatgttccgggagcttggccagagccatgagcaggaggcaagactctaccaccacctccccgacccgggtctgccgcagccccttgccctgccggtcaggacctgggagcgcccgctgcgcccagtctccagagatgtcatcgtccgctggtttaaggaggagcagctgcctcgccgagctggcttcgagaggaacaccaagttcatcgccccctggttccatggaggaaattatcactgtttcaggaggagagttacttcaggaaccctgcggacagagggacagcccaccagactaccatctgttgtttgaataatttttttccttatcaattggattcattttggtatcctgtttttgaactcagcttaagaacttctcatctcaaatcctatggccttctggaagatccaccactatccaaaggaaaaagtagattaatatgcctcaagggatatgacatctatggcatagggctactggtctcatcccagcgatcgggacagaaattgctaatagctcatgcaactctttcatgaagagcttagctatgaccttagaagacaaagcctgtttgtcatggctgccgtaaaccgagctcttacagtgcgtggaccatgttttaataatccaaaataattccagtgccgaaccctgaatttaacatatggtagacattcagtaaatgtttgttgaatgaatgcatgtcttctaaaagttttccaacacaaattagcagtggtttcttgtaaattatttcctactcgccactctataaaatcatggcaataatagaagattatgaaggatttctatggaggacataaatgctgcatctttcataatctccattatcaccctcattgatattatcattggaattatctaaggtgagccccagtttccagggcagctgattgacaccgtcctgccttccttatttaacctcttcttttgccactcgcctctatctttgaatcatattttggccttggttttgcaatggttttatgtcatcctacagatgtcttcaagacctggggtgagttatcaatgcaagaatggttcttagaaatctgatgaggcctctgctctctgggatgtggccctctctatgcaggttactccaatgattagctctgtcctcattgtccttttaattcccttgtcaacttaatctcagtatgttgcttatattaacaagaagactcacgcaataactcctcgataactctcagtgatggtatctgttggtgcatacttgtgttccacagttatggccatatacacagaggtagtatatgatgaagagaagattacagtctttacagtcaagaagacttgggttcatatcctaaccctggaacttactagcattataatgcttgcagcattgtgtttggtgagaggaaaagaatgaatggattctaggaatgttagggaacgatttactttacccgatggctgtatcaaacatctatgccccacttcttctcttgcctcacctattccttagattcttggtcacttctctaccacaagccaccagcactataaccagttttgcgtgggttctgctcttcctccctatgttgatcagtgtcatgtgagcataagccaatggtagcttgccacatgccccatctcccattgctgcagaggcataagacagaagagatgggaagtgaatgcccgatgtggtgaatctgggatgaatgggagtcataggctggtagatcgctttttcctccttcttcctcctggaggaactattctgagagtcatctgtttgtatggtcttgtagaagacagtcctgtaagatcgagcaaccagtcatgatgaaaccaagtggtggccggatcagtatgacaccctgctgcccccgtttttaattcttctctgccttgccctgctctctcctgttgctctgggattgcacttctgaatgaagtagcagctcataagcttttgccacaggctctgtcttttggggaatccaggataagaacccattatacagaagtgttcaataatatcaattttgcaactcactcagctccatggcttcccccggtctacctgtctcactacatgcataaagtgaaatgatggaaggaatctgctttctgaactctaatgtgccttcattgattatcattaaaattatcattaaaattgccttatttctatggactcagaggaatgatgttttagttttggctctctgatttaccaactatgtgactttgtccaagtcatttaacttcagtaaacctcggtatgactgaaaagggagttttctgtatggccgtcactaggtttttttgtgggttagttaaatgataaacatgaaagctctgtccaaatgaaaaaggtatttctaacaacaaccacaataacaataacaacttagtgcttagcccatgatgtatcaggggatatgatgtgatgattttcaaggtgttggaggcaacttctgttccaagaactcccagcagctttgaaagcagactgagatgagttgagaccctgaatccctgggctgttgttcctgtcacccctaattaatatgtgagagacaacagctgggttttccatccctaacacatttatttcattttatttggggcctgcaatttctgcatgtctcatatattttaggttttacctttttacctggctttaaaataaatcccttgtaagttgtcctgcaaatgaaattactgtctggaaaactgcaatttcatcttgagagttttattatgctaataaatgtcaggattctcatat

SEQ ID NO: 180953 - DNA, 3705 bp, Homo sapiens
  Payload ID: 15636
  Gene Symbol: SH2D5
  Gene Name: SH2 domain containing 5
  Uniprot ID: Q6ZV89
  ENST ID: ENST00000375031
  CDS Start-End: 626-1645
actcacaagggccgggcccgaaccaccctgagcgcctcctccgagccaggctcgatccttcacactgggaacggagacactccggtccagtgtcacttgtcctcgagtaagaggagagggatgacaggcgagcaacggagtcacaagggctctgcagagaatgaagcgtgagtggtggtcgtggaaggcttcccggaggaggcggtgcggtagccgcggctcggatgacgcggaggagccagccagagaggggaggggcagaggccctccaggaggagggacccgtgagtgaggcgcgggggattcagcgcccccagcccgggaggaggtgccttctgagctccgggcgagcccctcccgcccttccaggcggagcgccgggcgtgggcagtgccagggcccctcgcggccgctgattgggtggtgcggccgagcggagcggctccgcgggcgccgattgtacgtgggctccttccctgtggatgacctggacacccaggagagcgtgtggctggtgcagcagcagctgtgggcgctgaaggactgtccccgacgccgggccgtcatcctgaaattcagccttcagggtctcaagatctacagcggggagggtgaggtgctgctgatggctcatgccctgaggcgcatactctactccacctggtgccctgccgactgccagtttgccttcatggctcgaaacccacggagcccagccagcaagctcttctgccacctctttgtgggcagccagccaggagaggtccagatcctgcacctgctgctgtgccgctctttccagctggcttacctcttgcagcaccctgaggagcgggcacagccagagccctgcccagggcccacaggggaggtgcccctgaagccactgtccagctctgggggcctggtgcgggagcccttcggccgtgatcagctctctcagaacgtccatgccctggtctcctttcggcggctgccagcagaggggctggtgggcagtgggaaggagctgccagagtcggaaggccgtgcccgccatgcccgcctggggaatccctactgctcgcccacgctggtgcgcaagaaggccattcgcagcaaggtgatccgctcgggggcctaccgcggctgcacctatgagacccagctgcagctgtcggctcgggaggcctttcctgccgcatgggaggcatggccccggggtcctggtggccactcgtgcctggtggagagcgagggcagcctgacggagaacatctgggccttcgctggcatctccaggccctgtgccctggccctgttgcggagagacgtgctgggggccttcctgctgtggcctgagctgggtgctagcggccagtggtgtctgtccgtgcgcacgcagtgcggcgtggtgccccaccaggtcttccggaaccacctgggccgctactgcttggagcacctgccggcagagttccccagcctggaggctctggtggagaaccacgcggttactgaacgtagcctcttctgtcccctcgacatgggccgcctgaaccccacctacgaggagcaggactgtgggcccccaggcaggccgccccggactctccggcccctcagccatgccaagtccgaggcagagctgcagggcctgggctaagaggtagggccccggtcccacaggccccgcctcaccccggctcctgggccccagcagcatctctgcccgtcctgcacccctctggttgccagttccatccagtcaccctgcccttggagcagtcttccatcgcgtcactgtccgtgggaggggagccctgagggtgggtatcgccaatggcttcttggagaacatgtggcctgctgagattccaggagggcaggtggagttgcaggcttcggataaccctttgggtggcttcggatgacctgctgtgtggcttcggatgctttgggacttctgggcttctgctttactcctggggcaggagcttgttcacggcaaagctgcagccctctcctaaggaggctaggccttggggcgctgactgggagtctccagaaagagggttttggggaggcaggagtgagcttttactctgggcaaagacctggagtgagccaccctgtctatgagagcagagatgactccatggagcttgtgggcaggaggctggggatgagccccatctaggctgacagagcagggctgtttctcatatgtatctgagagtgaaggaggggtgggaaggtgcagagagggcaggagggacagagggctgtacctaacgctcacgcacggtggactcctgtgtgcagaaagggatgcgcaccagcagacagggccaagaatctccatgctgtctccactcaaaacctcagggctgtgactcccgctttctcagaagggatgcgcaggctcaccccttccccctaggaatcaccagggcacccccacccccagctcatctcctttagccatttgacagggaggggccagcagtgagctgcaggcttagaggggtgaccagggcccttcctaactcgaccgcatgtggtttggtggctgccttgggagggaggctgtccgatgctgacattccccttagcatggccctgaccgtggctgtcaggggccaccttgcctcaccaggccagccccactgggaatggggtcagtcacagcagaaccgtcgaaaggtggacctgatgtgggccctgccgggggcgcttggcctcagcgggccatgggagacccagggaaacgactctagtgtgaggcagtggtcctgccagtgactgacaaaccctctttgtaagcaaacttgacaaataatgaatctactgaactctgttatagaacaagttcattttgcatgaacttctcttattgaagcagaagccacgtcatgagcctgggggctgccctctccccgtctgggagtgggacagaactgttcagtgccttgaaagtcacagatttctgactcctggaaggaactgggcagtcccaccagagcagaaagaaaggaggcaaacttggggagtgagaagccagcctcccagaggcccaggcctcgtgttccccacctccaaccctcccgtgaggagaggggcttggcctgggaccttgtaacttccttgcaagttaagtgagctatcctgtcacaaaagatagaaggaactgccctttgggacttcttttcactggaaacccagcactggttttatgttgagtgagtgggaagctgggactctgttttacagccatctgtactggagcctggacaaaccactggtctctatgggaggccccagcctcacatttccctggcaaggagagagaggtttagccatgtcctgggtctaggattacagcccagagatgggcacttaagaagacctggtcattggtccagacttgggccaaggctctcctctgtgagggatgggttttactggtgaattacctgtgtggagaagctatcagggccatgtttagcacactgaagggaccagtctccaccaagcactttaacatccctccagccagcatagattgatctcgtgttacagagagggcaaggtttttggcccctgtttgcagactccatgtcttaatcagagaccacagttttctctttgttccaatctgcgccacctcggtagccccactttccttgctgtgtggacttgaaacaaaataaaatgtgttgcttc

SEQ ID NO: 180954 - DNA, 1934 bp, Homo sapiens
  Payload ID: 15636
  Gene Symbol: SH2D5
  Gene Name: SH2 domain containing 5
  Uniprot ID: Q6ZV89
  ENST ID: ENST00000444387
  CDS Start-End: 399-1670
gagtaagaggagagggatgacaggcgagcaacggagtcacaagggctctgcagagaatgaagcgtgagtggtggtcgtggaaggcttcccggaggaggcggtgcggtagccgcggctcggatgacgcggaggagccagccagagaggggaggggcagaggccctccaggaggagggacccgtgagtgaggcgcgggggattcagcgcccccagcccgggaggaggtgccttctgagctccgggcgagcccctcccgcccttccaggcggagcgccgggcgtgggcagtgccagggcccctcgcggccgctgattgggtggtgcggccgagcggagcggctccgcgggcgccgattgcctcccctcccgtggagctggaagccaggcaccctgggggccatgcagaaggcgggggctgggggccgcagggcctctgactgcgggctggcccctcaccggcccaggtgcatcaccaagtttgcccagtacgtgggctccttccctgtggatgacctggacacccaggagagcgtgtggctggtgcagcagcagctgtgggcgctgaaggactgtccccgacgccgggccgtcatcctgaaattcagccttcagggtctcaagatctacagcggggagggtgaggtgctgctgatggctcatgccctgaggcgcatactctactccacctggtgccctgccgactgccagtttgccttcatggctcgaaacccacggagcccagccagcaagctcttctgccacctctttgtgggcagccagccaggagaggtccagatcctgcacctgctgctgtgccgctctttccagctggcttacctcttgcagcaccctgaggagcgggcacagccagagccctgcccagggcccacaggggaggtgcccctgaagccactgtccagctctgggggcctggtgcgggagcccttcggccgtgatcagctctctcagaacgtccatgccctggtctcctttcggcggctgccagcagaggggctggtgggcagtgggaaggagctgccagagtcggaaggccgtgcccgccatgcccgcctggggaatccctactgctcgcccacgctggtgcgcaagaaggccattcgcagcaaggtgatccgctcgggggcctaccgcggctgcacctatgagacccagctgcagctgtcggctcgggaggcctttcctgccgcatgggaggcatggccccggggtcctggtggccactcgtgcctggtggagagcgagggcagcctgacggagaacatctgggccttcgctggcatctccaggccctgtgccctggccctgttgcggagagacgtgctgggggccttcctgctgtggcctgagctgggtgctagcggccagtggtgtctgtccgtgcgcacgcagtgcggcgtggtgccccaccaggtcttccggaaccacctgggccgctactgcttggagcacctgccggcagagttccccagcctggaggctctggtggagaaccacgcggttactgaacgtagcctcttctgtcccctcgacatgggccgcctgaaccccacctacgaggagcaggactgtgggcccccaggcaggccgccccggactctccggcccctcagccatgccaagtccgaggcagagctgcagggcctgggctaagaggtagggccccggtcccacaggccccgcctcaccccggctcctgggccccagcagcatctctgcccgtcctgcacccctctggttgccagttccatccagtcaccctgcccttggagcagtcttccatcgcgtcactgtccgtgggaggggagccctgagggtgggtatcgccaatggcttcttggagaacatgtggcctgctgagattccaggagggcaggtggagttgcaggcttcggataaccctttgggtggcttcgg

SEQ ID NO: 180955 - DNA, 544 bp, Homo sapiens
  Payload ID: 15636
  Gene Symbol: SH2D5
  Gene Name: SH2 domain containing 5
  ENST ID: ENST00000447746
  CDS Start-End: 141-544
cttccaggcggagcgccgggcgtgggcagtgccagggcccctcgcggccgctgattgggtggtgcggccgagcggagcggctccgcgggcgccgattgcctcccctcccgtggagctggaagccaggcaccctgggggccatgcagaaggcgggggctgggggccgcagggcctctgactgcgggctggcccctcaccggcccaggtgcatcaccaagtttgcccagtacgtgggctccttccctgtggatgacctggacacccaggagagcgtgtggctggtgcagcagcagctgtgggcgctgaaggtgggtggcctgggagggcacttccctagtggaagtcacagccttgaagaccaggtgctgctgatggctcatgccctgaggcgcatactctactccacctggtgccctgccgactgccagtttgccttcatggctcgaaacccacggagcccagccagcaagctcttctgccacctctttgtgggcagccagccaggagaggtccagatcctgcacctgctgctgtgccgctcttt

SEQ ID NO: 180956 - DNA, 511 bp, Homo sapiens
  Payload ID: 15636
  Gene Symbol: SH2D5
  Gene Name: SH2 domain containing 5
  ENST ID: ENST00000518294
  CDS Start-End: 117-511
agtgccgtggctggagctgctagcccgattccccacctaaagggcccgaaggatggggccacggcccatgtgcgcctcccctcccgtggagctggaagccaggcaccctgggggccatgcagaaggcgggggctgggggccgcagggcctctgactgcgggctggcccctcaccggcccaggtgcatcaccaagtttgcccagtacgtgggctccttccctgtggatgacctggacacccaggagagcgtgtggctggtgcagcagcagctgtgggcgctgaaggactgtccccgacgccgggccgtcatcctgaaattcagccttcagggtctcaagatctacagcggggagggtgaggtgctgctgatggctcatgccctgaggcgcatactctactccacctggtgccctgccgactgccagtttgccttcatggctcgaaacccacggagcccagccagcaagctcttctgccacctctttgtgggcagccagccaggagaggtcca

SEQ ID NO: 180957 - DNA, 564 bp, Homo sapiens
  Payload ID: 15636
  Gene Symbol: SH2D5
  Gene Name: SH2 domain containing 5
  ENST ID: ENST00000517430
  CDS Start-End: 187-564
tcactttaccccccatgccgcctccaccaccccagctgggtgcccccagagggcgggcaccttcgtccaccggcggcggggcctgacacacagtcagcctcggaaacattccaagaaggaccagagctacgagcaccccaggagcctcccctcccgtggagctggaagccaggcaccctgggggccatgcagaaggcgggggctgggggccgcagggcctctgactgcgggctggcccctcaccggcccaggtgcatcaccaagtttgcccagtacgtgggctccttccctgtggatgacctggacacccaggagagcgtgtggctggtgcagcagcagctgtgggcgctgaaggactgtccccgacgccgggccgtcatcctgaaattcagccttcagggtctcaagatctacagcggggagggtgaggtgctgctgatggctcatgccctgaggcgcatactctactccacctggtgccctgccgactgccagtttgccttcatggctcgaaacccacggagcccagccagcaagctcttctgccacctctttgtgggcagc

SEQ ID NO: 180958 - DNA, 524 bp, Homo sapiens
  Payload ID: 15636
  Gene Symbol: SH2D5
  Gene Name: SH2 domain containing 5
  ENST ID: ENST00000519434
  CDS Start-End: 313-524
ctcctcgtggactggcagggacccccaccaaactccaagagtggacaccctacttatctgtgggaggggagtccgagcagaaaggcaccgccatggcctgaggaaacagctccagagacatggatttgcttccctgctctcccactgaagctgtgtgactatggggccacctggaaaacctcagaggacagctccagcctcattccaagtgtgtccccttcggaaggtgctggcccagccagactccagtgtaaagcctcagaaaagcagcctcccctcccgtggagctggaagccaggcaccctgggggccatgcagaaggcgggggctgggggccgcagggcctctgactgcgggctggcccctcaccggcccaggtgcatcaccaagtttgcccagtacgtgggctccttccctgtggatgacctggacacccaggagagcgtgtggctggtgcagcagcagctgtgggcgctgaaggactgtccccgacgccgggccgtcatcctgaaattcagccttca

SEQ ID NO: 180959 - DNA, 894 bp, Homo sapiens
  Payload ID: 15637
  Gene Symbol: SH2D6
  Gene Name: SH2 domain containing 6
  Uniprot ID: Q7Z4S9
  ENST ID: ENST00000340326
  CDS Start-End: 162-689
ggcattttccggtgcctgcaccaaatcaggaagctcctagtctgtgccccaagatcacgcctcatttggaggtcacacgaggcctggctggtgggtcctgccagggcactggatctggagagtggaggaagcactgggtgccggggtttgggctcggggccatgtacgcctcctcctaccccccacccccgcagctgtcccctagaagccacctttgcccacccccaccccaccccaccccaccccagctcaataatctgcttcttctagaaggaaggaaatcgtctcttccctctgtagcccccactgggagtgcctcagctgctgaggacagtgatctgctgactcagccttggtactcggggaactgtgaccgctatgctgttgagagtgccctgctccacttacaaaaggatggggcctataccgtgcgccccagctcagggcctcatggctcccagcccttcaccctggcagtgcttctccgaggccgggtcttcaacattcccatccggcggctggatggcggacgccactatgccctgggccgggagggcaggaaccgtgaggagctcttctcctccgtggcggccatggtccagcacttcatgtggcaccctctgccccttgtggacagacacagcggcagccgggaactcacctgcctgctcttccccaccaagccttgaggccacagcgaagaatgcaggtgtctgcccagttcactaggtcctggatgaaggaaccgtggtggcctagaccagtcaggggacagcacaggcactgctggaacagcaaaggatcctctcacatctacttgtgggcctagggcaccctgagagggactggcctaccttgcacaagttcacattcaataaacatttgttgaatgaa

SEQ ID NO: 180960 - DNA, 1975 bp, Homo sapiens
  Payload ID: 15637
  Gene Symbol: SH2D6
  Gene Name: SH2 domain containing 6
  Uniprot ID: Q7Z4S9
  ENST ID: ENST00000389938
  CDS Start-End: 1315-1746
gttggggccgtgggagatgaagatggtgggtggggggttgggcccacagcctgctaagcaggcagagtggcctcctgaacccttcctccatcgcctagagcaaactcccattcctggaaggaggagcagcccagaccctgagactggactaggtctgttagggtccctgtgtggccggcaggactcgtggtgaagcccggggaaggcctgggtcctccaggtcagggatgtaggtcccagggtgtgcaggccgcggtatctgaccatcgtcggcgccctgcgcccaggcatcaattttacatggcagagtcaagaatgccctcttggtcgagtgcagtggctcacacctgtgatcccaacactttgggaggctgaggcaggaggattgcttgagcccagaagttcaagaccagcctggacaacatagacacagaatggtctgcctgggcctcagtcacattggaggagcagagagagaaggagccatgaggagtcactcaagggttttaggcagagccgtgacacaaccagagatactacgagcaaaggttccggaacagggcagggcaggacaggtttgagagcaatggcgcgatttcggctcacagcaacctccgcctcctgggttcaagctattctcctgcctcaacaacctcctgagggctgggattacagacaagaggccatgtgaggacacagagaaagcagccgtttacaagccaagaagagaggccgcatcacaaaccaacctttatggcaccttgatcttagacttctagctccagaacagagatgcaaatgatgggaacaatggagcccttgtccccaggccatttgtggcagatcctgggctccagggaggcaaagctcctctgcctctgccatggacaagctcagtgggagcaggccccggctggggccaccgctcccaccccccagatgtgtggactccccaggttggagagaagatgctcccagcccttccttcctgcctgccccagggacttggagacacaaggcccaggaggaggacgaggaggaaaataagtatgagctgcccccctgtgaggctctgcccctcagtctagcccctgcccaccttcctggcactgaggaggactccttgtacctggatcactctggccccctgggtccatcaaagccatcgccacccctgcctcagcccaccatgagcagggtgcatcgtccagagtggtgccaggccctccaaagaaacctgatgaggacctctacttggaatgtgagccggatccagtcctggctttgactcagactctcagcttccaagtcctgatgccctcaggccctctgcccaggacatcagtggtgcccaggcctaccacagccccccaggaaactcggaatggaacagcagatgctgcctctaaagaaggaaggaaatcgtctcttccctctgtagcccccactgggagtgcctcagctgctgaggatggggcctataccgtgcgccccagctcagggcctcatggctcccagcccttcaccctggcagtgcttctccgaggccgggtcttcaacattcccatccggcggctggatggcggacgccactatgccctgggccgggagggcaggaaccgtgaggagctcttctcctccgtggcggccatggtccagcacttcatgtggcaccctctgccccttgtggacagacacagcggcagccgggaactcacctgcctgctcttccccaccaagccttgaggccacagcgaagctgacaccctcttcctggcctccaggaatgcaggtgtctgcccagttcactaggtcctggatgaaggaaccgtggtggcctagaccagtcaggggacagcacaggcactgctggaacagcaaaggatcctctcacatctacttgtgggcctagggcaccctgagagggactggcctaccttgcacaagttcacattcaataaacatttgttgaatg

SEQ ID NO: 180961 - DNA, 2750 bp, Homo sapiens
  Payload ID: 15638
  Gene Symbol: SH2D7
  Gene Name: SH2 domain containing 7
  Uniprot ID: A6NKC9
  ENST ID: ENST00000328828
  CDS Start-End: 1-1356
atggaggacagcctaaagcagctcagcctggggagagatcctgagggggcaggggacagccaggccctggctgagctccaggagcttgccctgaagtggttcatggagacacaggcccccttcattctgcagaacggtgccctgcctccctggtttcatggattcatcacccgcaagcagacggagcagctactcagggacaaagctcttggttccttccttatccgcctcagtgaccgagccactggctacatcttgtcctacaggggcagtgatcgctgccgacattttgtcatcaaccagcttcgaaaccggcgttacatcatctcaggagacacccagagccacagcaccctggctgagcttgtgcaccattaccaggaggcacagctcgagcccttcaaagagatgctgactgctgcctgcccccggccagaggacaatgatctgtatgatgccatcacccggggcctccaccagaccatcgtggacccagaaaacccacctgccacggcattcctcacagtggtccccgacaaggccgccagcccccgctcttctccaaagccccaggtctccttcctccatgcacagaaaagcctggatgtgagtccccggaacctctcccaggaggaaagcatggaggctcccatcagagtgtctccactccctgagaagagttcctccctcctggaagagtcttttggaggccccagtgacatcatctatgcagacctgaggaggatgaaccaggcacggctaggcttgggcacagaggggtccggcaggcatgggccagttccagctggcagccaggcctactccccaggcagggaggcccaaaggagactctcagatggagaacagaacaggcctgatggcctggggcctgtcctttctggggtgagcccagaccagggtcccacagagtctcccacttcctggggatgttctgatgccatgggatccctgggggctacctggaggcaggagtttccaaagctgagccaagaggctcagccctgctcccagggcagctctgcagatatctatgagttcatcgggacagaaggcctcctgcaagaggccagggacacaccagaccaagaaggcagcacctatgagcagatcccagcttgctggggtggcccagccagggccccacatcctggggccagtcccacatatagcccatgggtccatggctacaagaggatctcagggaccccagagctctcagagcctgggaacacctatgaacagatcccagcaaccaagagcaaggagactggacggacacacaagcctgacaagcttcggaggctcttcttcacgtacaggaagcacaaattctgagggcctggcatccggcagcccaccagtgggtttcctggtacccaggccatgccaggggttatcgcaaaggcctcagctcacttgaaggcaccctttggatcttgagactcatccagcctgctacagaactaggctccgagacagccgaggtgcctgcctgagagcaggtggaagaggaccttgcaggtgcctgcagctcctggctatgtcctgctttccttgtgcctcccatccatgcacaggagggactggagaggaatgagattggccaaaggcaggggtcaccacccccatttcccagataagcatgctgaggcccaggcagactgactgaacctgcctcccactactgagcacttaccgaatgtgtggcaggctgtgtgctagcacagacacctttctaactggccaagtgacatcatgcaattgctaccgagaacaaaaccagttcccctccttgcggccccatcagcgaaaaggaggggagggccagaagccacatcctctgcttcaggcctcttcgctccagctgtaccctcaggtcaggctggctcttcctggaactctgtccctcaggaaacttcctgttttgtgtgtcacttcccttcctatccacatgtccccttctctataagggtggacagctggcttgctaccccactcccaacaacccccaggcctgggatgcagaaaacaggactgatcatctccagagagaacaccatacgtgcccctcctccctgccctgaccctgggcagagcgggctcaggttgcatttgtgggaaatctactcttagtgaccacttggctatgcagcttttcctgaaatataggcctgtaagagtccctccctccttgggggtttaaggattgagactgaagcaactgtccctgtgcctgagtggttagcactcccaaatgttaaccagagatactgtcagggaattcacggaaggttcggggcatgaatgtgttttcctcccgatggcacacgcactgaaatcaaagttagtgcctaaagcaggaggcactgcctaatgccgagaggtgagacaccaatggtgggatttcaaggatcagaagcaaaggtaccctcaaacatttcctaacattagcatacatggagagcaaagggatgcaaaagtgttttactaccaggagttcacaaatctgtggacagcacaccagtgaggattccacggtgttggggaggcaggcagggtggtactcatgacccagaggcagagacaggagcaagagcccttgggcccactgcacccacagcttcacattgtgaaggaggccgggagaaggggaacaggcaggggtgggaagcagcccaaccttgggttttggaaaaagattgcatagctcgttaaaaccctgacctctt

SEQ ID NO: 180962 - DNA, 2162 bp, Homo sapiens
  Payload ID: 15638
  Gene Symbol: SH2D7
  Gene Name: SH2 domain containing 7
  ENST ID: ENST00000409568
  CDS Start-End: 360-1307
gccgttgccccctcagcccccggaggcagggtcctgcgaccagcaccccgcgggtcagttgccttcgtgccacctgggctccaagtcctcgccctgccggatgaagcaatggtctatttctttatggcagtacggagcagctactcagggacaaagctcttggttccttccttatccgcctcagtgaccgagccactggctacatcttgtcctacaggggcagtgatcgctgccgacattttgtcatcaaccagcttcgaaaccggcgttacatcatctcaggagacacccagagccacagcaccctggctgagcttgtgcaccattaccaggaggcacagctcgagcccttcaaagagatgctgactgctgcctgcccccggccagaggacaatgatctgtatgatgccatcacccggggcctccaccagaccatcgtggacccagaaaacccacctgccacggcattcctcacagtggtccccgacaaggccgccagcccccgctcttctccaaagccccaggtctccttcctccatgcacagaaaagcctggatgtgagtccccggaacctctcccaggaggaaagcatggaggctcccatcagagtgtctccactccctgagaagagttcctccctcctggaagagtcttttggaggccccagtgacatcatctatgcagacctgaggaggatgaaccaggcacggctaggcttgggcacagaggggtccggcaggcatgggccagttccagctggcagccaggcctactccccaggcagggaggcccaaaggagactctcagatggagaacagaacaggcctgatggcctggggcctgtcctttctggggtgagcccagaccagggtcccacagagtctcccacttcctggggatgttctgatgccatgggatccctgggggctacctggaggcaggagtttccaaagctgagccaagaggctcagccctgctcccagggcagctctgcagatatctatgagttcatcgggacagaaggcctcctgcaagaggccagggacacaccagaccaagaaggcagcacctatgagcagatcccagcttgctggggtggcccagccagggccccacatcctggggccagtcccacatatagcccatgggtccatggctacaagaggatctcagggaccccagagctctcagagcctgggaacacctatgaacagatcccagcaaccaagagcaaggagactggacggacacacaagcctgacaagcttcggaggctcttcttcacgtacaggaagcacaaattctgagggcctggcatccggcagcccaccagtgggtttcctggtacccaggccatgccaggggttatcgcaaaggcctcagctcacttgaaggcaccctttggatcttgagactcatccagcctgctacagaactaggctccgagacagccgaggtgcctgcctgagagcaggtggaagaggaccttgcaggtgcctgcagctcctggctatgtcctgctttccttgtgcctcccatccatgcacaggagggactggagaggaatgagattggccaaaggcaggggtcaccacccccatttcccagataagcatgctgaggcccaggcagactgactgaacctgcctcccactactgagcacttaccgaatgtgtggcaggctgtgtgctagcacagacacctttctaactggccaagtgacatcatgcaattgctaccgagaacaaaaccagttcccctccttgcggccccatcagcgaaaaggaggggagggccagaagccacatcctctgcttcaggcctcttcgctccagctgtaccctcaggtcaggctggctcttcctggaactctgtccctcaggaaacttcctgttttgtgtgtcacttcccttcctatccacatgtccccttctctataagggtggacagctggcttgctaccccactcccaacaacccccaggcctgggatgcagaaaacaggactgatcatctccagagagaacaccatacgtgcccctcctccctgccctgaccctgggcagagcgggctcaggttgcatttgtgggaaatctactcttagtgaccacttggctatgcagcttttcctgaaatataggcctgtaagagtccctccctc

SEQ ID NO: 180963 - DNA, 3095 bp, Homo sapiens
  Payload ID: 15639
  Gene Symbol: SH2B1
  Gene Name: SH2B adaptor protein 1
  Uniprot ID: Q9NRF2
  ENST ID: ENST00000322610
  CDS Start-End: 440-2710
gggctccgggaggcagctgcggctccgactgctcaggaacctcctcctgggcccggcagagagagaccccgagtcccccggagtccgactcgctacgcgggtcttgcgagatatctggccgcctctgccgcagctggagcagagatggggtttcaccgtgttagccaggatggtcttgatctcctgacctcatgatccgcctgtctcggcctcccaaagtgctgggattacaggcgtgagccactgtgcccggccttgaacattcttaggtgcaactggagaaggcactgaagccctacgagattcacaccgtcttcggtctcctggggtcggcgccgagtgggaggatggcggaactgctgccgcccacccctcgtcttctggctgcctccctctttgtgccccacaggctccccctctccacctcctggggcccatcatgaatggtgccccttccccagaggacggggcctccccctcgtctcccccgctgcccccacccccgccccctagttggcgggagttctgtgagtcccacgcccgggctgcggctctggactttgcccgccgttttcgcctctacctggcctcccacccccaatatgcggggcccggggccgaggctgccttctcccgccgttttgctgagctcttcctgcagcactttgaagccgaggtggcccgggcctctggctccctgtcgccacccatcctggctcccctgagccctggtgcggagatttcgccacatgacctgtcccttgagagctgcagggtgggtgggcccctggctgtgctgggcccttctcgatcatctgaggacctggccggccccctcccttcctcagtctcttcctcctctacaacctcctccaagccgaagctcaagaagcgcttttccctgcgttcagtgggtcgctctgtccgaggctcagtccgtggcatcctgcagtggcgggggaccgttgaccctccctcctccgctgggcccctggagacctcgtcaggccccccagtcttaggtggaaacagcaactccaactcctctggcggggctgggaccgttggtaggggactggtcagtgatggaacgtcccctggggaaagatggactcaccgttttgagaggctgagactcagtcggggagggggcgccttgaaggatggagcagggatggtgcagagggaagagctgctgagtttcatgggggctgaggaggcagcccctgacccagccggagtgggccggggaggaggggtggctgggcctccttcagggggaggagggcagcctcagtggcagaagtgtcgcctgctgcttcgaagtgaaggagaaggaggaggaggaagtcgcctggagttctttgtaccacccaaggcctctcggccccgactcagcatcccctgctcttctatcacagacgtccggacaaccacagccctggagatgcctgaccgggagaacacgtttgtggttaaggtggaaggtccatccgagtatatcatggagacagtggatgcccagcatgtgaaggcctgggtgtctgacatccaagaatgcctgagcccaggaccctgccctgctaccagtccccgccccatgaccctccctctggcccctgggacctcattccttacaagggagaacacagacagcctggagctgtcctgcctgaatcactcggagagtctacccagccaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggacccccaacagggacagttcatcccctctcagccccctaccctcccttggacactccggaaacagccacagggtccttcctgttccagggggagccagagggcggtgagggggaccagcccctctcagggtatccttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcaggaaccgaccacctcccatgacccaccccagccccctgaacccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggtccccgtggttgagctggtccccgtggttgaattggaagaggccatagccccaggctcagaggcccagggcgctgggtctggtggggacgcgggggtgcccccaatggtgcagctgcagcagtcaccactagggggtgatggagaggaagggggccaccccagggccattaacaaccagtactccttcgtgtgagccaaccccacccgctccaccctttttaaaccccccagccctgctcgtgagattgggctgggtagggacagaggaggccgaaatccctcccccatgcttcctgacccttgttggccaagggcatctttgatggtacaagcagaggctcgggagaggctcccgtcacacactacaggtcccctccccagggcaggggatttgggctccatgagctccttgaggggctcttctggtcagccccaccctgggggccatttccccattaactacccccagcccgaggcagggtgagggggaagggctgtcagttacattaaggtggttgttgttgttgttttaaacaaaatggagaagcataaataaataaaaaggtttatctcggttc

SEQ ID NO: 180964 - DNA, 6043 bp, Homo sapiens
  Payload ID: 15639
  Gene Symbol: SH2B1
  Gene Name: SH2B adaptor protein 1
  Uniprot ID: Q9NRF2
  ENST ID: ENST00000337120
  CDS Start-End: 3292-5307
gacggggtttcaccatgttggtcaggctggtctcaaactcctgacctcaagccatccgcccgcctcggcctcccaaagggctgggattacaggcgtgagccagcgctcccggccctgacctcattttttttttttctatttttaaaatagggattctagttctgttgcctgggctggagtgccgtggcgccatctcggctcaccgcaatctctgccttccggattcaagctattctcttgcctctgcctccggagggactgggactacaggcgcgcgccaccatgcccggctaatttttgtatttttagtagagacggggtttcaccatgttggccaggctggtctcgaactcctgacctcaggtgatccacctgcctcggccttccgaagtgctgggattacaggcatgagccactgcgcccggccctgacctcattatttctacccaccccctcccccaccactaccaccatcttcatctccagcctcagagatgcaaactcctggaccgcctgcccctttcctcagataaaccaaggtcgtaagttcaggctccgcctccccgcagggcctccccaaggtcacccgcttctttcctcgctcagctccttggtggcgttgtccgcgtgcccctccacagcggggccggcgctctaggctgcagcgggccgttcacacagcctcatcatctcgctggtttccggtgctcggcggctactctagccctcagccgggccctgggactctatcccctaaggccggttctctatggtcgacatcgcccctttgtcccgaatttcctccgggaggacgctctggtgggatccaagcacttcccccgctgcgtctgtggtcgcttttaggtgcaactggagaaggcactgaagccctacgagattcacaccgtcttcggtctcctggggtcggcgccgagtgggaggatggcggaagtaagtatgaaggtgcccttccctcccgccgctgttctctatggtctcttccttcagcgacgggaaagggggtcctgacgcctgcgcggaaccgggctgggcgctcgtcgcgtagtgggtgggggcgcagggagcgggagccgccgccgccgccgccgccgccggagctaacctcggggaccgagatgcaggtgggaccggaaccggaacccccctcttcaagtaccttttccctctccgcgacccggccctggcgcccgagaggattcctgggtgggggtgggcgtggagggccgggggctggagaggcactcggccccggagagtgcagcagacagggctggtcccgaggtggatgcggccccggaaaatgggcggctggggggtgtccagggagtagggtcggatcggagtatatggaccaccgggcccggagggtccgagccgagagcggagcctgcaccctccacctcccgcccttcgggaaatatcagaactgagccaggaggcaggtgcaccgggaaaatgtgtctgagtcctgcttggcagaagagaaactgagtcaccagcttaggagtcgcagggtcagcgggcctgaagggggctgggtctgtctgcggtgcggaggattgggtgggcctgtgtgagccgaggtggccgctggctggagattggtttgcacttcttggctgggttcccccgtgctccatgactcctgcatctcctgattgtttctcgttggtttggagttgtccctgcggttggagccatctgagcttgtagggtcgaggcccaggaggaaggggagggttcaccgacttacagcctggctgtaggtttgaacaggagtctgaggtcgctgagggtttggggaggctttcctgagctgctctggccccagtcctggggctgtcaccttccagtattgcgtggcgggaggagcgctaacaagagccaagggttgtaaattccacacccagctctgccactttctagttgtaagaccttgagagggctcctcctttctctaatttctattttagaaaattggaacaataatattcttctcccacatgaagatagtaacaatggcagtcgttcagcggatgcttactttgcgttcagcgctgacataccccattccatgtaattctctcaacatttcgaggggagggatcattagctttgtttaacagatagaaaaacggaggctcagagaggacgtggaatttgttcaagataacatcgctcataaggtggctggactgggtgctcataaggtggtttgagccctggtctgactcaagtccatggccttaaccagaaggctaacctgcctttagggcatactccccagtgggagaagaggaaggtgaaaaatcctagggccccagctctccctgtgatgttttgtttacgtgaggccagcaaagacttgacctgagccaacccagtttctcctctggggcccctgcggcctctggccccagactgaagggataccaaagaagtgggctgtagctatttcacatctccttcacgcagtgcgtgggtgctggactctggggtcagctttcaagacaattactgttttggtccatcatgcatccatcctcattaatgaatcggccccctccaaagagttggaccctaagatgcgtgaggcaggctctctaaggtctagaatcccagctcctctctagccccctgcgagctggggcggtgaggtgctatggctgaggctggcccagccgggccctggggacagggactatgaagtggggaaaacagtagacttggagttctgaaacttttctgagcttcggtttcctcatctgttcgagaggtctttgaaacctctcagggaaaggtaagataaccaagtgggagcctctagaatggctcatgggaagtgtgacatgaatattggaggatccgatgtagagggggggtgatctggaaaagttcccttttttagggggaaggtgctccaaagccctctactgctggatccaaagctaaggaaagtgggggcaaatgtggcaggctcggggcaggttagacgctggggagccagttggctggggcctgcagggtgccaggatctgggagagggaagggaggtgttgggctcccttccccattgctctctgcggagtctgaagtagggtcggacgtctctggctgggggtgggatgcagcctccggtgcgccctcagcagtgaccctcgtgtgtgcctctctcttcctttcgcagctgctgccgcccacccctcgtcttctggctgcctccctctttgtgccccacaggctccccctctccacctcctggggcccatcatgaatggtgccccttccccagaggacggggcctccccctcgtctcccccgctgcccccacccccgccccctagttggcgggagttctgtgagtcccacgcccgggctgcggctctggactttgcccgccgttttcgcctctacctggcctcccacccccaatatgcggggcccggggccgaggctgccttctcccgccgttttgctgagctcttcctgcagcactttgaagccgaggtggcccgggcctctggctccctgtcgccacccatcctggctcccctgagccctggtgcggagatttcgccacatgacctgtcccttgagagctgcagggtgggtgggcccctggctgtgctgggcccttctcgatcatctgaggacctggccggccccctcccttcctcagtctcttcctcctctacaacctcctccaagccgaagctcaagaagcgcttttccctgcgttcagtgggtcgctctgtccgaggctcagtccgtggcatcctgcagtggcgggggaccgttgaccctccctcctccgctgggcccctggagacctcgtcaggccccccagtcttaggtggaaacagcaactccaactcctctggcggggctgggaccgttggtaggggactggtcagtgatggaacgtcccctggggaaagatggactcaccgttttgagaggctgagactcagtcggggagggggcgccttgaaggatggagcagggatggtgcagagggaagagctgctgagtttcatgggggctgaggaggcagcccctgacccagccggagtgggccggggaggaggggtggctgggcctccttcagggggaggagggcagcctcagtggcagaagtgtcgcctgctgcttcgaagtgaaggagaaggaggaggaggaagtcgcctggagttctttgtaccacccaaggcctctcggccccgactcagcatcccctgctcttctatcacagacgtccggacaaccacagccctggagatgcctgaccgggagaacacgtttgtggttaaggtggaaggtccatccgagtatatcatggagacagtggatgcccagcatgtgaaggcctgggtgtctgacatccaagaatgcctgagcccaggaccctgccctgctaccagtccccgccccatgaccctccctctggcccctgggacctcattccttacaagggagaacacagacagcctggagctgtcctgcctgaatcactcggagagtctacccagccaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggacccccaacagggacagttcatcccctctcagccccctaccctcccttggacactccggaaacagccacagggtccttcctgttccagggggagccagagggcggtgagggggaccagcccctctcagggtatccttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagggccgggagcaggctgggagccatgcgggggtgtgcgagggagatggatgccaccccgatgcctcctgcaccctcatgcccttcggagcgagtgactgtgtaaccgaccacctcccatgacccaccccagccccctgaacccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggtccccgtggttgagctggtccccgtggttgaattggaagaggccatagccccaggctcagaggcccagggcgctgggtctggtggggacgcgggggtgcccccaatggtgcagctgcagcagtcaccactagggggtgatggagaggaagggggccaccccagggccattaacaaccagtactccttcgtgtgagccaaccccacccgctccaccctttttaaaccccccagccctgctcgtgagattgggctgggtagggacagaggaggccgaaatccctcccccatgcttcctgacccttgttggccaagggcatctttgatggtacaagcagaggctcgggagaggctcccgtcacacactacaggtcccctccccagggcaggggatttgggctccatgagctccttgaggggctcttctggtcagccccaccctgggggccatttccccattaactacccccagcccgaggcagggtgagggggaagggctgtcagttacattaaggtggttgttgttgttgttttaaacaaaatggagaagcataaataaataaaaaggtttatctcg

SEQ ID NO: 180965 - DNA, 3033 bp, Homo sapiens
  Payload ID: 15639
  Gene Symbol: SH2B1
  Gene Name: SH2B adaptor protein 1
  Uniprot ID: Q9NRF2
  ENST ID: ENST00000359285
  CDS Start-End: 225-2276
ccttcagcgacgggaaagggggtcctgacgcctgcgcggaaccgggctgggcgctcgtcgcgtagtgggtgggggcgcagggagcgggagccgccgccgccgccgccgccgccggagctaacctcggggaccgagatgcagctgctgccgcccacccctcgtcttctggctgcctccctctttgtgccccacaggctccccctctccacctcctggggcccatcatgaatggtgccccttccccagaggacggggcctccccctcgtctcccccgctgcccccacccccgccccctagttggcgggagttctgtgagtcccacgcccgggctgcggctctggactttgcccgccgttttcgcctctacctggcctcccacccccaatatgcggggcccggggccgaggctgccttctcccgccgttttgctgagctcttcctgcagcactttgaagccgaggtggcccgggcctctggctccctgtcgccacccatcctggctcccctgagccctggtgcggagatttcgccacatgacctgtcccttgagagctgcagggtgggtgggcccctggctgtgctgggcccttctcgatcatctgaggacctggccggccccctcccttcctcagtctcttcctcctctacaacctcctccaagccgaagctcaagaagcgcttttccctgcgttcagtgggtcgctctgtccgaggctcagtccgtggcatcctgcagtggcgggggaccgttgaccctccctcctccgctgggcccctggagacctcgtcaggccccccagtcttaggtggaaacagcaactccaactcctctggcggggctgggaccgttggtaggggactggtcagtgatggaacgtcccctggggaaagatggactcaccgttttgagaggctgagactcagtcggggagggggcgccttgaaggatggagcagggatggtgcagagggaagagctgctgagtttcatgggggctgaggaggcagcccctgacccagccggagtgggccggggaggaggggtggctgggcctccttcagggggaggagggcagcctcagtggcagaagtgtcgcctgctgcttcgaagtgaaggagaaggaggaggaggaagtcgcctggagttctttgtaccacccaaggcctctcggccccgactcagcatcccctgctcttctatcacagacgtccggacaaccacagccctggagatgcctgaccgggagaacacgtttgtggttaaggtggaaggtccatccgagtatatcatggagacagtggatgcccagcatgtgaaggcctgggtgtctgacatccaagaatgcctgagcccaggaccctgccctgctaccagtccccgccccatgaccctccctctggcccctgggacctcattccttacaagggagaacacagacagcctggagctgtcctgcctgaatcactcggagagtctacccagccaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggacccccaacagggacagttcatcccctctcagccccctaccctcccttggacactccggaaacagccacagggtccttcctgttccagggggagccagagggcggtgagggggaccagcccctctcagggtatccttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagggtgagcagagcaggtctgcaggggaggaggtgcccgtgcacccaagaagtgaggccgggagcaggctgggagccatgcgggggtgtgcgagggagatggatgccaccccgatgcctcctgcaccctcatgcccttcggagcgagtgactgtgtaaccgaccacctcccatgacccaccccagccccctgaacccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggtccccgtggttgagctggtccccgtggttgaattggaagaggccatagccccaggctcagaggcccagggcgctgggtctggtggggacgcgggggtgcccccaatggtgcagctgcagcagtcaccactagggggtgatggagaggaagggggccaccccagggccattaacaaccagtactccttcgtgtgagccaaccccacccgctccaccctttttaaaccccccagccctgctcgtgagattgggctgggtagggacagaggaggccgaaatccctcccccatgcttcctgacccttgttggccaagggcatctttgatggtacaagcagaggctcgggagaggctcccgtcacacactacaggtcccctccccagggcaggggatttgggctccatgagctccttgaggggctcttctggtcagccccaccctgggggccatttccccattaactacccccagcccgaggcagggtgagggggaagggctgtcagttacattaaggtggttgttgttgttgttttaaacaaaatggagaagcataaataaataaaaaggtttatctcggttc

SEQ ID NO: 180966 - DNA, 2529 bp, Homo sapiens
  Payload ID: 15639
  Gene Symbol: SH2B1
  Gene Name: SH2B adaptor protein 1
  Uniprot ID: Q9NRF2
  ENST ID: ENST00000395532
  CDS Start-End: 372-2387
aagtaccttttccctctccgcgacccggccctggcgcccgagaggattcctgggtgggggtgggcgtggagggccgggggctggagaggcactcggccccggagagtgcagcagacagggctggtcccgaggtggatgcggccccggaaaatgggcggctggggggtgtccagggagtagggtcggatcggagtatatggaccaccgggcccggagggtccgagccgagagcggagcctgcaccctccacctcccgcccttcgggaaatatcagaactgagccaggagctgctgccgcccacccctcgtcttctggctgcctccctctttgtgccccacaggctccccctctccacctcctggggcccatcatgaatggtgccccttccccagaggacggggcctccccctcgtctcccccgctgcccccacccccgccccctagttggcgggagttctgtgagtcccacgcccgggctgcggctctggactttgcccgccgttttcgcctctacctggcctcccacccccaatatgcggggcccggggccgaggctgccttctcccgccgttttgctgagctcttcctgcagcactttgaagccgaggtggcccgggcctctggctccctgtcgccacccatcctggctcccctgagccctggtgcggagatttcgccacatgacctgtcccttgagagctgcagggtgggtgggcccctggctgtgctgggcccttctcgatcatctgaggacctggccggccccctcccttcctcagtctcttcctcctctacaacctcctccaagccgaagctcaagaagcgcttttccctgcgttcagtgggtcgctctgtccgaggctcagtccgtggcatcctgcagtggcgggggaccgttgaccctccctcctccgctgggcccctggagacctcgtcaggccccccagtcttaggtggaaacagcaactccaactcctctggcggggctgggaccgttggtaggggactggtcagtgatggaacgtcccctggggaaagatggactcaccgttttgagaggctgagactcagtcggggagggggcgccttgaaggatggagcagggatggtgcagagggaagagctgctgagtttcatgggggctgaggaggcagcccctgacccagccggagtgggccggggaggaggggtggctgggcctccttcagggggaggagggcagcctcagtggcagaagtgtcgcctgctgcttcgaagtgaaggagaaggaggaggaggaagtcgcctggagttctttgtaccacccaaggcctctcggccccgactcagcatcccctgctcttctatcacagacgtccggacaaccacagccctggagatgcctgaccgggagaacacgtttgtggttaaggtggaaggtccatccgagtatatcatggagacagtggatgcccagcatgtgaaggcctgggtgtctgacatccaagaatgcctgagcccaggaccctgccctgctaccagtccccgccccatgaccctccctctggcccctgggacctcattccttacaagggagaacacagacagcctggagctgtcctgcctgaatcactcggagagtctacccagccaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggacccccaacagggacagttcatcccctctcagccccctaccctcccttggacactccggaaacagccacagggtccttcctgttccagggggagccagagggcggtgagggggaccagcccctctcagggtatccttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagggccgggagcaggctgggagccatgcgggggtgtgcgagggagatggatgccaccccgatgcctcctgcaccctcatgcccttcggagcgagtgactgtgtaaccgaccacctcccatgacccaccccagccccctgaacccccttcatggacagatcccccacagcctggggcagaagaggcgtcgagggcgccagaagtggcggcagcagcagccgcagcagccaaagagaggcaagagaaagagaaagcgggcggtgga

SEQ ID NO: 180967 - DNA, 1532 bp, Homo sapiens
  Payload ID: 15639
  Gene Symbol: SH2B1
  Gene Name: SH2B adaptor protein 1
  ENST ID: ENST00000538342
  CDS Start-End: 167-1174
cttcagcgacgggaaagggggtcctgacgcctgcgcggaaccgggctgggcgctcgtcgcgtagtgggtgggggcgcagggagcgggagccgccgccgccgccgccgccgccggagctaacctcggggaccgagatgcagacgtccggacaaccacagccctggagatgcctgaccgggagaacacgtttgtggttaaggtggaaggtccatccgagtatatcatggagacagtggatgcccagcatgtgaaggcctgggtgtctgacatccaagaatgcctgagcccaggaccctgccctgctaccagtccccgccccatgaccctccctctggcccctgggacctcattccttacaagggagaacacagacagcctggagctgtcctgcctgaatcactcggagagtctacccagccaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggacccccaacagggacagttcatcccctctcagccccctaccctcccttggacactccggaaacagccacagggtccttcctgttccagggggagccagagggcggtgagggggaccagcccctctcagggtatccttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagggccgggagcaggctgggagccatgcgggggtgtgcgagggagatggatgccaccccgatgcctcctgcaccctcatgcccttcggagcgagtgactgtgtaaccgaccacctcccatgacccaccccagccccctgaacccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggtccccgtggttgagctggtccccgtggttgaattggaagaggccatagccccaggctcagaggcccagggcgctgggtctggtggggacgcgggggtgcccccaatggtgcagctgcagcagtcaccactagggggtgatggagaggaagggggccaccccagggccattaacaaccagtactccttcgtgtgagcc

SEQ ID NO: 180968 - DNA, 1488 bp, Homo sapiens
  Payload ID: 15639
  Gene Symbol: SH2B1
  Gene Name: SH2B adaptor protein 1
  ENST ID: ENST00000545570
  CDS Start-End: 188-1309
aaggccggttctctatggtcgacatcgcccctttgtcccgaatttcctccgggaggacgctctggtgggatccaagcacttcccccgctgcgtctgtggtcgcttttaggtgcaactggagaaggcactgaagccctacgagattcacaccgtcttcggtctcctggggtcggcgccgagtgggaggatggcggaagcctctcggccccgactcagcatcccctgctcttctatcacagacgtccggacaaccacagccctggagatgcctgaccgggagaacacgtttgtggttaaggtggaaggtccatccgagtatatcatggagacagtggatgcccagcatgtgaaggcctgggtgtctgacatccaagaatgcctgagcccaggaccctgccctgctaccagtccccgccccatgaccctccctctggcccctgggacctcattccttacaagggagaacacagacagcctggagctgtcctgcctgaatcactcggagagtctacccagccaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggacccccaacagggacagttcatcccctctcagccccctaccctcccttggacactccggaaacagccacagggtccttcctgttccagggggagccagagggcggtgagggggaccagcccctctcagggtatccttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagggtgagcagagcaggtctgcaggggaggaggtgcccgtgcacccaagaagtgaggccgggagcaggctgggagccatgcgggggtgtgcgagggagatggatgccaccccgatgcctcctgcaccctcatgcccttcggagcgagtgactgtgtaaccgaccacctcccatgacccaccccagccccctgaacccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggt

SEQ ID NO: 180969 - DNA, 613 bp, Homo sapiens
  Payload ID: 15639
  Gene Symbol: SH2B1
  Gene Name: SH2B adaptor protein 1
  ENST ID: ENST00000561629
  CDS Start-End: 247-613
ttggtaaagctggctcttggctctgtgttagcagctgcgggcaggactgagaaagcagtgtgactgccttttgtctaacttcccgaggatgtagaaggaaagatgaatgtctggagggaggggaagagtggtctttggaaaccaaacacccagatctgtttctttctcctgacttaggcctctcggccccgactcagcatcccctgctcttctatcacagacgtccggacaaccacagccctggagatgcctgaccgggagaacacgtttgtggttaaggtggaaggtccatccgagtatatcatggagacagtggatgcccagcatgtgaaggcctgggtgtctgacatccaagaatgcctgagcccaggggagaacacagacagcctggagctgtcctgcctgaatcactcggagagtctacccagccaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggac

SEQ ID NO: 180970 - DNA, 484 bp, Homo sapiens
  Payload ID: 15639
  Gene Symbol: SH2B1
  Gene Name: SH2B adaptor protein 1
  ENST ID: ENST00000567536
  CDS Start-End: 431-484
agagtgggagtcaggcgggctaggccggacccggagggaggggctcgggctccgggaggcagctgcggctccgactgctcaggaacctcctcctgggcccggcagagagagaccccgagtcccccggagtccgactcgctacgcgggtcttgcgagatatctggccgcctctgccgcagctggagcagagatggggtttcaccgtgttagccaggatggtcttgatctcctgacctcatgatccgcctgtctcggcctcccaaagtgctgggattacaggcgtgagccactgtgcccggccttgaacattcttaggtgcaactggagaaggcactgaagccctacgagattcacaccgtcttcggtctcctggggtcggcgccgagtgggaggatggcggaaaccctgccctgctaccagtccccgccccatgaccctccctctggcccctgggacctcattccttacaagggagaacacagac

SEQ ID NO: 180971 - DNA, 546 bp, Homo sapiens
  Payload ID: 15639
  Gene Symbol: SH2B1
  Gene Name: SH2B adaptor protein 1
  ENST ID: ENST00000566176
  CDS Start-End: 1-546
tccgctgggcccctggagacctcgtcaggccccccagtcttagacgtccggacaaccacagccctggagatgcctgaccgggagaacacgtttgtggttaaggtggaaggtccatccgagtatatcatggagacagtggatgcccagcatgtgaaggcctgggtgtctgacatccaagaatgcctgagcccaggaccctgccctgctaccagtccccgccccatgaccctccctctggcccctgggacctcattccttacaagggagaacacagacagcctggagctgtcctgcctgaatcactcggagagtctacccagccaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggacccccaacagggacagttcatcccctctcagccccctaccct

SEQ ID NO: 180972 - DNA, 533 bp, Homo sapiens
  Payload ID: 15639
  Gene Symbol: SH2B1
  Gene Name: SH2B adaptor protein 1
  ENST ID: ENST00000566209
  CDS Start-End: 364-533
aagctattctcttgcctctgcctccggagggactgggactacaggcgcgcgccaccatgcccggctaatttttgtatttttagtagagacggggtttcaccatgttggccaggctggtctcgaactcctgacctcagcctcagagatgcaaactcctggaccgcctgcccctttcctcagataaaccaaggtcgtgcaactggagaaggcactgaagccctacgagattcacaccgtcttcggtctcctggggtcggcgccgagtgggaggatggcggaactgctgccgcccacccctcgtcttctggctgcctccctctttgtgccccacaggctccccctctccacctcctggggcccatcatgaatggtgccccttccccagaggacggggcctccccctcgtctcccccgctgcccccacccccgccccctagttggcgggagttctgtgagtcccacgcccgggctgcggctctggactttgcccgccgttttcgcctctacctggcctcccacccccaatatgcggg

SEQ ID NO: 180973 - DNA, 342 bp, Homo sapiens
  Payload ID: 15639
  Gene Symbol: SH2B1
  Gene Name: SH2B adaptor protein 1
  ENST ID: ENST00000568868
  CDS Start-End: 1-342
gccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagggtgagcagagcaggtctgcaggggaggaggtgcccgtgcacccaagaagtgaggtgtgtgtgccagaaagatggggcggggaggggggactatcacaaggagaagctt

SEQ ID NO: 180974 - DNA, 821 bp, Homo sapiens
  Payload ID: 15639
  Gene Symbol: SH2B1
  Gene Name: SH2B adaptor protein 1
  ENST ID: ENST00000569651
  CDS Start-End: 1-602
cttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagggtgagcagagcaggtctgcaggggaggaggtgcccgtgcacccaagaagtgagaaccgaccacctcccatgacccaccccagccccctgaacccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggtccccgtggttgagctggtccccgtggttgaattggaagaggccatagccccaggctcagaggcccagggcgctgggtctggtggggacgcgggggtgcccccaatggtgcagctgcagcagtcaccactagggggtgatggagaggaagggggccaccccagggccattaacaaccagtactccttcgtgtgagccaaccccacccgctccaccctttttaaaccccccagccctgctcgtgagattgggctgggtagggacagag

SEQ ID NO: 180975 - DNA, 588 bp, Homo sapiens
  Payload ID: 15639
  Gene Symbol: SH2B1
  Gene Name: SH2B adaptor protein 1
  ENST ID: ENST00000563591
  CDS Start-End: 399-588
atgggcgtagtagttctcaggtcggcgggctgtggaggtgatcagagtgggagtcaggcgggctaggccggacccggagggaggggctcgggctccgggaggcagctgcggctccgactgctcaggaacctcctcctgggcccggcagagagagaccccgagtcccccggagtccgactcgctacgcgggtcttgcgagatatctggccgcctctgccgcagctggaggtgcaactggagaaggcactgaagccctacgagattcacaccgtcttcggtctcctggggtcggcgccgagtgggaggatggcggaactgctgccgcccacccctcgtcttctggctgcctccctctttgtgccccacaggctccccctctccacctcctggggcccatcatgaatggtgccccttccccagaggacggggcctccccctcgtctcccccgctgcccccacccccgccccctagttggcgggagttctgtgagtcccacgcccgggctgcggctctggactttgcccgccgttttcgcctctacctggcctcccacccccaatatgcggggcccggggccgaggctgcct

SEQ ID NO: 180976 - DNA, 2935 bp, Homo sapiens
  Payload ID: 15639
  Gene Symbol: SH2B1
  Gene Name: SH2B adaptor protein 1
  Uniprot ID: Q9NRF2
  ENST ID: ENST00000618521
  CDS Start-End: 273-2543
aagtatgaaggtgcccttccctcccgccgctgttctctatggtctcttccttcagcgacgggaaagggggtcctgacgcctgcgcggaaccgggctgggcgctcgtcgcgtagtgggtgggggcgcagggagcgggagccgccgccgccgccgccgccgccggagctaacctcggggaccgagatgcagctgctgccgcccacccctcgtcttctggctgcctccctctttgtgccccacaggctccccctctccacctcctggggcccatcatgaatggtgccccttccccagaggacggggcctccccctcgtctcccccgctgcccccacccccgccccctagttggcgggagttctgtgagtcccacgcccgggctgcggctctggactttgcccgccgttttcgcctctacctggcctcccacccccaatatgcggggcccggggccgaggctgccttctcccgccgttttgctgagctcttcctgcagcactttgaagccgaggtggcccgggcctctggctccctgtcgccacccatcctggctcccctgagccctggtgcggagatttcgccacatgacctgtcccttgagagctgcagggtgggtgggcccctggctgtgctgggcccttctcgatcatctgaggacctggccggccccctcccttcctcagtctcttcctcctctacaacctcctccaagccgaagctcaagaagcgcttttccctgcgttcagtgggtcgctctgtccgaggctcagtccgtggcatcctgcagtggcgggggaccgttgaccctccctcctccgctgggcccctggagacctcgtcaggccccccagtcttaggtggaaacagcaactccaactcctctggcggggctgggaccgttggtaggggactggtcagtgatggaacgtcccctggggaaagatggactcaccgttttgagaggctgagactcagtcggggagggggcgccttgaaggatggagcagggatggtgcagagggaagagctgctgagtttcatgggggctgaggaggcagcccctgacccagccggagtgggccggggaggaggggtggctgggcctccttcagggggaggagggcagcctcagtggcagaagtgtcgcctgctgcttcgaagtgaaggagaaggaggaggaggaagtcgcctggagttctttgtaccacccaaggcctctcggccccgactcagcatcccctgctcttctatcacagacgtccggacaaccacagccctggagatgcctgaccgggagaacacgtttgtggttaaggtggaaggtccatccgagtatatcatggagacagtggatgcccagcatgtgaaggcctgggtgtctgacatccaagaatgcctgagcccaggaccctgccctgctaccagtccccgccccatgaccctccctctggcccctgggacctcattccttacaagggagaacacagacagcctggagctgtcctgcctgaatcactcggagagtctacccagccaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggacccccaacagggacagttcatcccctctcagccccctaccctcccttggacactccggaaacagccacagggtccttcctgttccagggggagccagagggcggtgagggggaccagcccctctcagggtatccttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcaggaaccgaccacctcccatgacccaccccagccccctgaacccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggtccccgtggttgagctggtccccgtggttgaattggaagaggccatagccccaggctcagaggcccagggcgctgggtctggtggggacgcgggggtgcccccaatggtgcagctgcagcagtcaccactagggggtgatggagaggaagggggccaccccagggccattaacaaccagtactccttcgtgtgagccaaccccacccgctccaccctttttaaaccccccagccctgctcgtgagattgggctgggtagggacagaggaggccgaaatccctcccccatgcttcctgacccttgttggccaagggcatctttgatggtacaagcagaggctcgggagaggctcccgtcacacactacaggtcccctccccagggcaggggatttgggctccatgagctccttgaggggctcttctggtcagccccaccctgggggccatttccccattaactacccccagcccgaggcagggtgagggggaagggctgtcagttacattaaggtggttgttgttgttgttttaaacaaaatggagaagcataaataaataaaaaggtttatctcggttctatcgtg

SEQ ID NO: 180977 - DNA, 965 bp, Homo sapiens
  Payload ID: 15640
  Gene Symbol: SH2B2
  Gene Name: SH2B adaptor protein 2
  ENST ID: ENST00000444095
  CDS Start-End: 237-965
ttggagcgcgcggagctcggctgccagagagccgcgcgggggacgcgccgggaccgcgaggagcgcaggagccttcgaggcggtgaacgagggagggagcccagtccgccgcgggccatgagccaccgggcccggggagcccggccgcggtccgggcagcgctcagccggcgccccagcccgctcggccgcagctgcgcgcctgtagccgcaggtggctgcgatgggacggaagccatgaatggtgccggccctggccccgccgcagccgccccggtcccagtcccggtcccggtcccggactggcggcagttctgcgagctgcatgcgcaggcggccgccgtggactttgcgcacaagttctgccgtttcctgcgggacaacccagcttacgacacgcccgacgccggcgcctccttctcccgccacttcgccgccaacttcctggacgtcttcggcgaggaggtgcgccgcgtgctggtggctgggccgacgactcggggcgcggccgtgagcgcagaggccatggagccggagctcgcggacacctctgcactcaaggcggcgccctacggccactcgcggagctcggaggacgtgtccacgcacgcggccaccaaggcccgcgttcgcaagggcttctcgctgcgcaacatgagcctgtgcgtggtggacggcgtgcgcgacatgtggcaccggcgcgcctcgcccgagcccgacgcggcagctgccccgcgcaccgccgagccccgcgacaagtggacgcggcgcctgaggctgtcgcggacgctggctgccaaggtggagctggtggacattcaacgcgagggggcgctgcgcttcatggtggccgacgacgcggccgcgggctccgggggctcggctcagtggcagaagtgccgcctgctcctgcgcagggctgtggccgaggaacgcttccgcctggagttcttcgtgccgcccaaa

SEQ ID NO: 180978 - DNA, 2113 bp, Homo sapiens
  Payload ID: 15640
  Gene Symbol: SH2B2
  Gene Name: SH2B adaptor protein 2
  ENST ID: ENST00000536178
  CDS Start-End: 5-2032
ggggatggatccaagctattgtcctgcccatggcttcccatctcaggaccctctctggccgctatcatcccagcagtggagttcagcccactactctgaaccagccgcaggtggctgcgatgggacggaagccatgaatggtgccggccctggccccgccgcagccgccccggtcccagtcccggtcccggtcccggactggcggcagttctgcgagctgcatgcgcaggcggccgccgtggactttgcgcacaagttctgccgtttcctgcgggacaacccagcttacgacacgcccgacgccggcgcctccttctcccgccacttcgccgccaacttcctggacgtcttcggcgaggaggtgcgccgcgtgctggtggctgggccgacgactcggggcgcggccgtgagcgcagaggccatggagccggagctcgcggacacctctgcactcaaggcggcgccctacggccactcgcggagctcggaggacgtgtccacgcacgcggccaccaaggcccgcgttcgcaagggcttctcgctgcgcaacatgagcctgtgcgtggtggacggcgtgcgcgacatgtggcaccggcgcgcctcgcccgagcccgacgcggcagctgccccgcgcaccgccgagccccgcgacaagtggacgcggcgcctgaggctgtcgcggacgctggctgccaaggtggagctggtggacattcaacgcgagggggcgctgcgcttcatggtggccgacgacgcggccgcgggctccgggggctcggctcagtggcagaagtgccgcctgctcctgcgcagggctgtggccgaggaacgcttccgcctggagttcttcgtgccgcccaaagcctccaggcccaaggtcagcatcccactgtcagccatcattgaggtccgcaccaccatgcccctggaaatgccagagaaggataacacattcgtcctcaaggtagagaatggagccgaatacatcttggagaccatcgactctctgcagaagcactcgtgggtagctgacatccagggctgcgtggaccccggtgacagtgaggaagacaccgagctctcctgtacccgaggaggctgtctggccagccgcgtggcctcctgcagctgtgagctcctgactgatgcagtcgacctgccccgccccccagagacgacagccgtgggtgcagtggtgacagccccccacagccgaggtcgagatgccgtcagagaatccctgatccacgtcccgctagagacctttctgcagaccctggaatccccgggcggcagcggcagtgacagcaataacacaggggaacagggtgcagagacggatcccgaggctgaacccgagctggagctatccgactacccatggttccacgggacactgtcccgggtcaaggctgctcaactggttctggcaggggggccccggaaccacggcctcttcgtgatccgccaaagtgagactcggcctggggagtacgtgctgaccttcaacttccagggcaaggccaagcacctgcgcctgtccctgaacggccacggccagtgtcacgtacagcatctgtggttccagtctgtgcttgacatgctccgccacttccacacacaccccatcccactggagtcagggggctcggccgacatcacccttcgcagctatgtgcgggcccaggaccccccaccagagccgggccccacgccccctgccgcgcccgcgtccccggcctgctggagcgactcgcccggccagcactacttctccagcctcgccgcggccgcctgcccgcctgcctcgccctccgacgccgccggcgcctcctcgtcttccgcctcgtcgtcctctgccgcgtcggggcccgcccccccgcgccccgtcgagggccagctcagcgcgcggagccgcagcaacagcgccgagcgcctgctggaggccgtggccgccaccgccgccgaggagcccccggaggccgcgcccggccgcgcgcgcgccgtggagaaccagtactccttctactagcccgcggcgccgcccgggtgggacacgccaagctcttcagtgaagacacgatgttattaaaagcctgttttagggactgca

SEQ ID NO: 180979 - DNA, 490 bp, Homo sapiens
  Payload ID: 15640
  Gene Symbol: SH2B2
  Gene Name: SH2B adaptor protein 2
  ENST ID: ENST00000617975
  CDS Start-End: 69-212
catcagttcctccttgtgggtccgaggcgctctgccgccggcccctcctcacttcttcctccctggggatggatccaagctattgtcctgcccatggcttcccatctcaggaccctctctggccgctatcatcccagcagtggagttcagcccactactctgaaccaggcctccaggcccaaggtcagcatcccactgtcagccatcattgaggtccgcaccaccatgcccctggaaatgccagagaaggataacacattcgtcctcaaggtagagaatggagccgaatacatcttggagaccatcgactctctgcagaagcactcgtgggtagctgacatccagggctgcgtggaccccggtgacagtgaggaagacaccgagctctcctgtacccgaggaggctgtctggccagccgcgtggcctcctgcagctgtgagctcctgactgatgcagtcgacctgccccgccccccagagacgacagccg

SEQ ID NO: 180980 - DNA, 5406 bp, Homo sapiens
  Payload ID: 15641
  Gene Symbol: SH2B3
  Gene Name: SH2B adaptor protein 3
  Uniprot ID: Q9UQQ2
  ENST ID: ENST00000341259
  CDS Start-End: 358-2085
cccgggccaccgcctccgcccggctgcccgcccggactgtcgcggcccgcggtggcgacggcggccgctgcaaagtttccccggcggcggcggcccgggggcgcatcctcccgcaactgtcaagcgctggcggcggaaatgatgaggcgctggccattttccgagcccgggtttcctgcctgagccccgctcgagcgagccgcgagcgaggagccggcgggcgggagaggacgcgcccagggcgggggcccgcccgccccctcgggatttcgagggcccgggggcgcgcgacgccatgggccggccgggcccagagctcctgtctctcagcccggccgcaccacctgggtctccgccatgaacgggcctgccctgcagccctcctcgccctcttccgcgccctcagcctccccggcggcggccccgcggggctggagcgagttctgtgagttgcacgccgtagcggcggcccgggagctggcccgccagtactggctgttcgcccgggagcatccgcagcacgcgccgctgcgcgccgagctggtgtcgctgcagttcaccgacctcttccagcgctacttctgccgcgaggtgcgcgacggacgggcgccgggccgcgactaccgggacacaggccgtgggcccccagccaaggccgaggcgtccccggagccaggccccggccccgccgcccctggcctgcccaaggcccgcagctctgaggagctggccccgccgcggccgcccgggccctgctccttccagcactttcgccgcagcctccgccacatcttccgccgccgctcggccggggagctgccagcggcccacaccgctgccgcccccgggacccccggagaggctgctgagacccccgcccggcctggcctggccaagaagttcctgccctggagcctggcccgggagccgccacccgaggcgctgaaggaggcggtgctgcgctacagcctggccgacgaggcctccatggacagcggggcacgctggcagcgcgggaggctggcgctgcgccgggccccgggccccgatggccccgaccgcgtgctggagctcttcgacccacccaagagttcaaggcccaagctacaagcagcttgctccagcatccaggaggtccggtggtgcacacggcttgagatgcctgacaacctttacacctttgtgctgaaggtgaaggaccggacagacatcatctttgaggtgggagacgagcagcagctgaattcatggatggctgagctctcggagtgcacaggccgagggctggagagcacagaagcagagatgcatattccctcagccctagagcctagcacgtccagctccccaaggggcagcacagattcccttaaccaaggtgcttctcctggggggctgctggacccggcctgccagaagacggaccatttcctgtcctgctacccctggttccacggccccatctccagagtgaaagcagctcagctggttcagctgcagggccctgatgctcatggagtgttcctggtgcggcagagcgagacgcggcgtggggaatacgtgctcactttcaactttcaggggatagccaagcacctgcgcctgtcgctgacagagcggggccagtgccgtgtgcagcacctccactttccctcggtcgtggacatgctccaccacttccagcgctcgcccatcccactcgagtgcggcgccgcctgtgatgtccggctctccagctacgtggtagtcgtctcccaaccaccaggttcctgcaacacggtcctcttccctttctcccttcctcactgggattcagagtcccttcctcactggggttcagagttgggccttccccaccttagttcttctggctgtccccgggggctcagcccagagggtctcccagggcgatcctcaccccccgagcagatcttccacctggtgccttcgcccgaagaactggccaacagcctgcagcacctggagcatgagcctgtgaatcgagcccgggactcggactacgaaatggactcatcctcccggagccacctgcgggccatagacaatcagtacacacctctctgaccagtgaggaattccaggcctcaacagctgcccttgaggagcacaggcagaagtgtgaacttgtgaatgtaattgatctttccttccttccagagaaagatttaagggacactgttaactgctcgtgccagtttggaagtgacccttctattaggcctgttgaagggccctcctgtaggtttcatctatccacctggctttctccttattgtttacagatgtagttcttgttagaggatgccgctagctcctgcccggggtccctatgcccagtccccgttactcttagagaaaggagttggggtgagggccagagctggcagtggaaacttgttctctttttcactgacactgtcacagcggatgacagactttctacggggaggagggggggatcatcaggaagcccagaacactaacaagcggttctcccatctaccgtcagtccacatggcaggtctgctgtgtccacaccacagatgaccacatctaatcctgcttctactctcagctttaggacaaaagctctgtcagaggcacaagctgaaggtcaaaaatgatttaaaacattttacctcagactaatttctttaaaggattcaggttcaaaacttaaccactgcttatttcagtgcactgtttcaactaacacccatgctatttttgtagtcagaaacagctatgcaaaccctacctaatttacagtctgagccagcatgctggcttgtctactgcatcctcgggacagtcacctgccactgagtggccactgtccttcctaaatgtcaagaagtgaagtatgtcaccctttcagggaaattcaggcaattactgaaataggagggtggcaagaacagttctatcctggtgccttacgaataaaaaactggattctggtttacagcagctttacagtgatagttaaattaactggggctaggggaagagcaagcaaaaagggaagaaggactcctaggccctttctagtaaatccttcagcaacaaggctggcttggtgccctccaagcatctaatggcttattaaattatcccacaagtgggttttaggctccttttttgagccaaaatggaagctgggaatctggtgccataactaatgagaaactcctttaatagcccacaatcagtgttctgttctagctggctactgcttcactggattgagaatctatctatctccttgcacacatgggcacacacaatctccaccatccagggaggtcctgaagtcaaatctctatctatacaagtgatacaattcatagggggctggctcctcccagaacctgtctggaggctcagaaacgggggcagtgacagtggagtcagctgctcttgggtgccagcagagccattcagtacaacccccaggctcacagcagtggcttctaggaaactgggagtttagatcagctttacagatacatcgatcagaggctaaaatgaaacctcagcctaaaactcataggactgactgcctgggaggagggttaggtctgcttcttccacttatacttagtctctgtgctccaagaggtcaaatttttgcttctagaatttccttggggtctttcagagggtgggggaacaaacccctatgcacttttcttttttttttttttgagatggagtttctcttgtcaaccgggctggagtgcagtggtgcaatcttggctcactgcaacctccaccttcctggttcaagcgattctgcctcgacctctcaagtagctgggattacaagcaccagccaccatgcctggctaattttgtatttttagtagagacagggtttcaccatgttggccaggctggtctcgaatgtctgacctcaggtgatccacccgccttggcctcccaaagtgctgggattacaggcgcgagccaccgcgcccagcctacaccacttttagtaccaacactcttgggtgatttcatggaccctaaagcagacctgacactgatccagatttgcagtccatttttaaggacacctgtctttatttcctcaaagtcaagcagctttctctggaaaatgaatgctaattagtgtgaaccaaaagagtaagtaagagtctgaagtttttttaaaggagaaagcttattatggaaagtcactggtcctcccctccgcacaggaaaggtacccagtagataatgaaccaaattaagttccctccctccagccagaagttaaacatctgggatatgacgtcttcatgccaggggcactcatttcttagcagcctctctacatacatctctcaggtggtgccaagaggcacaccaggtagagcaaacttagcagctctgactaacaggctgcaaagtgcaagttcagattctgtggcagagatttggaaggcacccacctccagactgcttcccgtccaagttaccaggacagctcaaaaacatgctgacagaaaactcccatggctctaggaagaagtgacactaagccaacacctttctttatgtgggagcagaatcagctgatgaaggggtgggcagcagtgtggggcaggcaccccactggctgcagctagcccaccataggcacagcacatcccaccactctccttccagtcctgaccaggccccagccggcaacttctaccgagagccatggctcaacaccaaactggacagtagacatcatgatccctccagttagctctaattacagaccccaccagtacagcttgacagctcccggcaccatcccttccttcatctgacttattgaacttttacaaactaacagtcaccagcaccaaagaattaagtcaactaacctgccttgaattttagaccagcaatccatatggctttatctggtataaatcttctgcctttgatcatttctggaccgtaggaaaaaggaatagcaatcattaaaatcttgggccagagaacactatttttacataacagtttcttaacctaaagtcaaggccttggactcttccctgagggttgcctgagattccttcatgctttctattcaggactaagtcccttactgcaaatgtgttagctctaacatctcccacaagctagaggaacttgcgagtatattaacaaggacacatctgacatcctgtgtttggttagaatatacagcacattgtgataacataaagtggattcatcttgtatcattataggcagaaggtatttggcaaatttttatgtattgttttatgtactgtacaagtaacttattcttgaataatgcaaattttgctataatgtacaaattgctatatgtgaattaaaaagttttcagaatcttga

SEQ ID NO: 180981 - DNA, 2062 bp, Homo sapiens
  Payload ID: 15641
  Gene Symbol: SH2B3
  Gene Name: SH2B adaptor protein 3
  ENST ID: ENST00000538307
  CDS Start-End: 41-1162
atagtaatgagagtccgtgccgggtggagctcagaaggacatgggattcccggtgctgtgccgtggctggaggaggacctggcctggctgtgccagttggctgggagcccctccaccccagaagcccttgctctcacctcttcttctgaatcatcgttcttcgaagagttcaaggcccaagctacaagcagcttgctccagcatccaggaggtccggtggtgcacacggcttgagatgcctgacaacctttacacctttgtgctgaaggtgaaggaccggacagacatcatctttgaggtgggagacgagcagcagctgaattcatggatggctgagctctcggagtgcacaggccgagggctggagagcacagaagcagagatgcatattccctcagccctagagcctagcacgtccagctccccaaggggcagcacagattcccttaaccaaggtgcttctcctggggggctgctggacccggcctgccagaagacggaccatttcctgtcctgctacccctggttccacggccccatctccagagtgaaagcagctcagctggttcagctgcagggccctgatgctcatggagtgttcctggtgcggcagagcgagacgcggcgtggggaatacgtgctcactttcaactttcaggggatagccaagcacctgcgcctgtcgctgacagagcggggccagtgccgtgtgcagcacctccactttccctcggtcgtggacatgctccaccacttccagcgctcgcccatcccactcgagtgcggcgccgcctgtgatgtccggctctccagctacgtggtagtcgtctcccaaccaccaggttcctgcaacacggtcctcttccctttctcccttcctcactgggattcagagtcccttcctcactggggttcagagttgggccttccccaccttagttcttctggctgtccccgggggctcagcccagagggtctcccagggcgatcctcaccccccgagcagatcttccacctggtgccttcgcccgaagaactggccaacagcctgcagcacctggagcatgagcctgtgaatcgagcccgggactcggactacgaaatggactcatcctcccggagccacctgcgggccatagacaatcagtacacacctctctgaccagtgaggaattccaggcctcaacagctgcccttgaggagcacaggcagaagtgtgaacttgtgaatgtaattgatctttccttccttccagagaaagatttaagggacactgttaactgctcgtgccagtttggaagtgacccttctattaggcctgttgaagggccctcctgtaggtttcatctatccacctggctttctccttattgtttacagatgtagttcttgttagaggatgccgctagctcctgcccggggtccctatgcccagtccccgttactcttagagaaaggagttggggtgagggccagagctggcagtggaaacttgttctctttttcactgacactgtcacagcggatgacagactttctacggggaggagggggggatcatcaggaagcccagaacactaacaagcggttctcccatctaccgtcagtccacatggcaggtctgctgtgtccacaccacagatgaccacatctaatcctgcttctactctcagctttaggacaaaagctctgtcagaggcacaagctgaaggtcaaaaatgatttaaaacattttacctcagactaatttctttaaaggattcaggttcaaaacttaaccactgcttatttcagtgcactgtttcaactaacacccatgctatttttgtagtcagaaacagctatgcaaaccctacctaatttacagtctgagccagcatgctggcttgtctactgcatcctcgggacagtcacctgccactgagtggccactgtccttcctaaatgtcaagaagtgaagtatgtcaccctttcagggaaattcaggcaattactgaaataggagggtggcaagaacagttctatcctggtgccttacgaataaaaaactggattctggttt

SEQ ID NO: 180982 - DNA, 648 bp, Homo sapiens
  Payload ID: 15641
  Gene Symbol: SH2B3
  Gene Name: SH2B adaptor protein 3
  ENST ID: ENST00000550925
  CDS Start-End: 1-648
gcagttcaccgacctcttccagcgctacttctgccgcgaggtgcgcgacggacgggcgccgggccgcgactaccgggacacaggccgtgggcccccagccaaggccgaggcgtccccggagccaggccccggccccgccgcccctggcctgcccaaggcccgcagctctgaggagctggccccgccgcggccgcccgggccctgctccttccagcactttcgccgcagcctccgccacatcttccgccgccgctcggccggggagctgccagcggcccacaccgctgccgcccccgggacccccggagaggctgctgagacccccgcccggcctggcctggccaagaagttcctgccctggagcctggcccgggagccgccacccgaggcgctgaaggaggcggtgctgcgctacagcctggccgacgaggcctccatggacagcggggcacgctggcagcgcgggaggctggcgctgcgccgggccccgggccccgatggccccgaccgcgtgctggagctcttcgacccacccaagtggccagagcctgagctgtccaggctgaggtttcgactgaagcaggggttgtcctgcgcccatgtgcccacacgctgcaacctggctggagcctctggcataggacaccc

SEQ ID NO: 180983 - DNA, 3227 bp, Homo sapiens
  Payload ID: 15642
  Gene Symbol: STAC
  Gene Name: SH3 and cysteine rich domain
  Uniprot ID: Q99469
  ENST ID: ENST00000273183
  CDS Start-End: 301-1509
agaagcccgctcgcccgctgccgagtggcagtcacgactgtgaggtcgccggcgaggtggccgcgggcgcggcggggcggggcagggcgcactctcctccacgcccgcggaagtgccggggaggtgggcagggcggggagggagagggagcgaggctggaggagggcacgtcggcgcctcggcgaggatgggagtccccaggacccggagctgagcagcctggcgcgcggcgggcagggcgcgcaggacagaagcctcgctgttcctccgggagcccaacaccgttcccgcgcggccacgatgatccctccgagcagcccccgcgaggacggcgtggacgggctgcccaaggaggcggtgggcgccgagcaaccgccctctcctgcatccaccagcagccaggaatccaagctccagaaactaaaacgatcactttctttcaagaccaagagtttacggagcaaaagtgctgacaacttcttccagcgaaccaacagcgaagacatgaaactgcaagcacacatggtggctgagatcagccccagctccagcccactccctgctccaggaagcctgacgtccacacccgccagggctggtctgcatccaggtggcaaggctcatgcctttcaggaatacatcttcaagaagcccactttctgtgatgtctgcaaccacatgatagtgggaacaaatgctaagcatggactgcgctgcaaagcctgtaagatgagcatccaccacaagtgcacagatggcctggcaccccagcggtgcatgggcaagctgccaaaggggtttcggcgttactacagctcccccttgctcattcatgaacagtttggctgcattaaagaagttatgcccattgcctgtggcaataaggtggaccctgtctacgagaccctccgcttcggcacctccctggcccagaggacaaagaagggcagctccggcagtggctctgactcacctcacagaacctctacttcagatcttgtggaggttcctgaggaagccaatgggccaggaggcgggtatgacctaaggaaacgcagcaacagcgtgtttacatatccagaaaatggcactgatgatttcagagatccagcgaagaacataaaccaccagggatctctttccaaagacccattacagatgaacacctatgttgccttgtacaaatttgtaccacaggagaatgaagatttggaaatgaggccaggagacataattactcttttagaggattccaatgaagactggtggaaagggaaaattcaagacagaattggcttctttccagccaactttgttcagagactacaacaaaatgagaagatttttagatgtgttagaaccttcattgggtgtaaggaacaggggcagataacactgaaagagaatcagatctgcgtgagttctgaagaagaacaagatggttttatcagagtcctcagtggaaaaaagaaaggcctcatcccccttgatgtactagaaaacatctgattgctggctcctcctccgtttgcagtaggcaagctctgctgcgatgcctctgcctcatctcacactgcgtcaacccaaaggagctgccgcactgacccagccccccaggaaacagtgagacaagaatcaagtatctgagactgtggagtaatagccacaaaacagagggcccactgcacagcatatccaggctgccacaggtggggacgaggctgagagagtcagcaggcagagccagatgccatgcttggcagcagcagtaggactataaaccacagctgtcccccaggatcccactcctttcctgtctgtgtggtgtaagttaacacactggagtgtgctccagtttgcagggtagcccagtgcaaggttcagatccatgtagctaagtattatcctgcttccagacctatgtcaccagtaccaatcagtcagtgtcatcacatttcaggccccaagcaatctctgtgcaaagcatcagaaagacctgcttcccagcccccagcattccagtgctctccaggcttcctctctttgtgattgtgctgtccagagtgtccagcttgttctttctttctcttcagtcctctgagtacatctggtggtgtgcattagatgtgagggctatgttgacatggcatcacctccaaagacctgacctgcctaaagactgatgacaggccatccttcctgctgttctaggtactggcctgggtgacagagcaggacatgagacatagatacagtggggaggagaagtggggaaaggtggagcagagagttcttacttattgaagattatacagccctttcggttatgaagtccctgcttgaaggcaatggacctggggaagagactatcacaaaaagtctccattttcattttacatcctctctattggaggcagcacttttccctcatgctgtcctataggactccactttgaaggttgtgcctacgttgcagggaactaggaacatggaggggaaccaacaacagcatcttagaagaaatgtagccaaattggagtccattcttctttagggcagtatatgaaatcctagcagatgtaaaatggaaaagaatcctaatgcttcttccttcagaaagtagaggaactaggggcccaattagcatcatctaggggaatctctattactctgtacttatactaatgtttacaagaatgcaatatactgtgatgccttcctactcaagcctcctagcattcaaacttccatcctattagtcattaacatggttaaacttcaattcacaatcaccttggaatcaatgtcagtttgatttattttgttacagagcaataaaatcattagaacaatggtttttaaaagacttaagtggatgcatcctatgcatgtaagcattatttcccaaaccaaagcatcattcatctccatttatttcttttgttcccgctcagtgtgaagttgggaactgagaggggatggctgctggtttcacagaagtttggatgccttactcttatcttaaagccagcatccagaatttcctccctctctgatgccacatgcaaaaccaggtgtacgatgtcaagatggattctttgagagccagggtagatcatatgactgcctttctgtaaaattggatgcctagtacaaatgctctttgcctctaattcagtattccatttaataaaaacaatacagtggctggaaaggagcatcagaaa

SEQ ID NO: 180984 - DNA, 1366 bp, Homo sapiens
  Payload ID: 15642
  Gene Symbol: STAC
  Gene Name: SH3 and cysteine rich domain
  ENST ID: ENST00000457375
  CDS Start-End: 142-1167
aggagggcacgtcggcgcctcggcgaggatgggagtccccaggacccggagctgagcagcctggcgcgcggcgggcagggcgcgcaggacagaagcctcgctgttcctccgggagcccaacaccgttcccgcgcggccacgatgatccctccgagcagcccccgcgaggacggcgtggacgggctgcccaaggaggcggtgggcgccgagcaaccgccctctcctgcatccaccagcagccaggaatccaagctccagaaactaaaacgatcactttctttcaagaccaagagtttacggagcaaaagtgctgacaacttcttccagcgaaccaacagcgaagacatgaaactgcaagcacacatggtggctgagatcagccccagctccagcccactccctgctccaggaagcctgacgtccacacccgccagggctggtctgcatccaggtggcaaggctcatgcctttcaggaatacatcttcaagaagcccactttctgtgatgtctgcaaccacatgatagtggcctgtggcaataaggtggaccctgtctacgagaccctccgcttcggcacctccctggcccagaggacaaagaagggcagctccggcagtggctctgactcacctcacagaacctctacttcagatcttgtggaggttcctgaggaagccaatgggccaggaggcgggtatgacctaaggaaacgcagcaacagcgtgtttacatatccagaaaatggcactgatgatttcagagatccagcgaagaacataaaccaccagggatctctttccaaagacccattacagatgaacacctatgttgccttgtacaaatttgtaccacaggagaatgaagatttggaaatgaggccaggagacataattactcttttagaggattccaatgaagactggtggaaagggaaaattcaagacagaattggcttctttccagccaactttgttcagagactacaacaaaatgagaagatttttagatgtgttagaaccttcattgggtgtaaggaacaggggcagataacactgaaagagaatcagatctgcgtgagttctgaagaagaacaagatggttttatcagagtcctcagtggaaaaaagaaaggcctcatcccccttgatgtactagaaaacatctgattgctggctcctcctccgtttgcagtaggcaagctctgctgcgatgcctctgcctcatctcacactgcgtcaacccaaaggagctgccgcactgacccagccccccaggaaacagtgagacaagaatcaagtatctgagactgtggagtaatagccacaaaacagagggcccactgcacagcatatccaggctgccaca

SEQ ID NO: 180985 - DNA, 605 bp, Homo sapiens
  Payload ID: 15642
  Gene Symbol: STAC
  Gene Name: SH3 and cysteine rich domain
  ENST ID: ENST00000427486
  CDS Start-End: 117-272
aggatgggagtccccaggacccggagctgagcagcctggcgcgcggcgggcagggcgcgcaggacagaagcctcgctgttcctccgggagcccaacaccgttcccgcgcggccacgatgatccctccgagcagcccccgcgaggacggcgtggacgggctgcccaaggaggcggtgggcgccgagcaaccgccctctcctgcatccaccagcagccaggaatccaaggaacaaatgctaagcatggactgcgctgcaaagcctgtaagatgagcatccaccacaagtgcacagatggcctggcaccccagcggtgcatgggcaagctgccaaaggggtttcggcgttactacagctcccccttgctcattcatgaacagtttggctgcattaaagaagttatgcccattgcctgtggcaataaggtggaccctgtctacgagaccctccgcttcggcacctccctggcccagaggacaaagaagggcagctccggcagtggctctgactcacctcacagaacctctacttcagatcttgtggaggttcctgaggaagccaatgggccaggaggcgggtatgacctaaggaaacgcagcaacagcg

SEQ ID NO: 180986 - DNA, 827 bp, Homo sapiens
  Payload ID: 15642
  Gene Symbol: STAC
  Gene Name: SH3 and cysteine rich domain
  ENST ID: ENST00000434649
  CDS Start-End: 72-827
gcgggcagggcgcgcaggacagaagcctcgctgttcctccgggagcccaacaccgttcccgcgcggccacgatgatccctccgagcagcccccgcgaggacggcgtggacgggctgcccaaggaggcggtgggcgccgagcaaccgccctctcctgcatccaccagcagccaggaatccaagaccaagagtttacggagcaaaagtgctgacaacttcttccagcgaaccaacagcgaagacatgaaactgcaagcacacatggtggctgagatcagccccagctccagcccactccctgctccaggaagcctgacgtccacacccgccagggctggtctgcatccaggtggcaaggctcatgcctttcaggaatacatcttcaagaagcccactttctgtgatgtctgcaaccacatgatagtggcctgtggcaataaggtggaccctgtctacgagaccctccgcttcggcacctccctggcccagaggacaaagaagggcagctccggcagtggctctgactcacctcacagaacctctacttcagatcttgtggaggttcctgaggaagccaatgggccaggaggcgggtatgacctaaggaaacgcagcaacagcgtgtttacatatccagaaaatggcactgatgatttcagagatccagcgaagaacataaaccaccagggatctctttccaaagacccattacagatgaacacctatgttgccttgtacaaatttgtaccacaggagaatgaagatttggaaatgaggccaggagacataattactcttttagaggattccaatgaagactggtggaaa

SEQ ID NO: 180987 - DNA, 3362 bp, Homo sapiens
  Payload ID: 15643
  Gene Symbol: STAC2
  Gene Name: SH3 and cysteine rich domain 2
  Uniprot ID: Q6ZMT1
  ENST ID: ENST00000333461
  CDS Start-End: 371-1606
atggggggcgggcgcagcggacggcggagccggctggacacggacagctccttggctccctccctcggctcatccccgcggccccacttccctcctccccgcgctgcgagcagcatcctctgcagaccctcggtcctcgcgcccggggtcgtcccgctcctgcggctcagcgtggtggcctcccctcgcccgccaccccggcaactttctctgcccgctcccgcgggttgggggctgccgtgccgggggctaactgggggcagcctctggagaacggcttcagagtcccggagacgcccgccacccgcagcctgcccgcggtgggcctgccgtcggatctcggcaccctctcctcccctctccccgaaccatgaccgagatgagcgagaaggagaacgaaccggatgacgcggccacccacagccccccagggaccgtctccgccctccaggaaaccaagctccagcgattcaagcgctccctctccctcaagaccatcctccgaagtaagagcttggagaacttcttccttcgctcgggctctgagctcaagtgccccaccgaggtgctgctgacgcccccaaccccactgccccctccctccccaccacccacagcctcggacaggggcctggctaccccatccccctccccatgcccagtcccacgccccctggcagcgctcaaaccagtgaggctgcacagcttccaggaacatgtcttcaagcgagctagcccttgtgagctgtgccaccagctcatcgtaggaaactccaaacagggcttgcgatgtaagatgtgcaaagtcagcgtccacctctggtgctctgaggagatctcccaccagcaatgcccaggcaagacgtccacctccttccgccgcaacttcagttcccctctcctggtgcatgagccgccaccagtctgtgccacaagcaaagagtccccacccactggggacagtgggaaggtggaccctgtctacgagaccctgcgctatggcacctccctggcactgatgaaccgctccagtttcagcagcacctctgagtccccgacaaggagcctgagtgagcgggatgagctgaccgaggatggggaaggcagcatccgcagctctgaggaggggcctggtgacagtgcatctccagtattcacagccccagcagagagtgaagggccaggaccagaggagaagagtcctggacagcagctccccaaagccaccctgcggaaggatgtggggcccatgtactcctacgttgcactctacaagtttctgccccaggagaacaatgatctggctctgcagcctggagatcggatcatgctggtggatgactctaacgaggactggtggaagggcaagatcggcgaccgggttggcttcttcccagctaattttgtgcaacgggtgaggccaggcgagaatgtttggcgctgctgccaacccttctccgggaacaaggaacagggttacatgagcctcaaggagaaccagatctgcgtgggcgtgggcagaagcaaggatgctgacggcttcatccgcgtcagcagtggcaagaagcggggcctggtgccagtcgacgccctgactgagatctgagaggagccaagggaacccagatgacacccttgcccatgcctggaccttgcttctggccagggaggggatcaggcccccttgtccactccatacccttcctccctctgtccctctcctaggtgccacttaccgtggcttaggagccttttgtactggggaagattttatttcttgggtggggtgccctgagtgggttgatcctctgggacttggcggggatggggtggggtgggagggaatgaggaagctacaggtaggtccacccaacgcccaggcaccccagtctacttgctgggctgagtccagccctggggaagattcctggggaatttatttgctgcttctcccagccttcccctgcccacaccacctgcgcatgcctggcacacccctctccccacagagcctctgcttgggtctatgtgtgtgtgaccgtgcatctgctcctttgcaagtggggtcttgggagcaggcctttttgtgtcctcggccctccacccttggtggggaggggacccaggaccataggaaggtcctgagtccacctcctggtctccacctctgtcattccgtcaattctcaggaaagttttgcaggaatctctcccgttacttgaaacctgggcggacagatgaggggaaggctgaggtccctggaaggtgtaacaaatcagagactatctgttcaagtagaaaacccaagagctggccaggtgtggtggctcatgcctgtaatcccagcactttgggaggctgaggtgggcagatcacctgaggtcaggagttcaagaccagcctggccaacatggtgaaaccccgtctctactaaaagtacgaaacttagccaggcatgatgggggtctgcctgtaatgccagctactccagaggctgaggcaagagaatcacttgaacccgggaggcggaggtttcagtgagccgagattgcaccattgcaccccagcctgggcaacagagcgagactccgtctcaaaaaaaaaaaaagaaagaaagaaaaggaaacccaagagctgcctggacacacggaaacccaactgagaacaaaatcctggcccgtgcttggtcaaagcaaacccatttcactgtcaggacccccggtcacacaggaaccacccgccaggggagcctgtgactgtcagttcctgtcccaggctttgcccggccgccccaggaacccaaccctctgggctgacctttctcctgcttctctccaggctctgcaggggacagggcaggtgctgcaggagcccctttgctggctttatctgctcccttgttctggacacagagccctgggaaaaagagggggtggaagacagacaaggaaggtggaatgttctgttttggccaccaggaaatggggtggggtgggcatacacagagaggacccctctcttaatacagctgcttttctcggtgccaacctccctcccccaagctcagatcctcctcttatgcccttgattgtgccagcccatgccacccccatcctgggcacagttacaccctcccatgcagtgggagaaacacagaccctcgtacccaaaggcccctgccccacttctcccccacaaagcggggtctcaagccacactgccctgtttgctgccatgaggcccccccccccagcaatatcccaggggcgggcccaatgcccactgtacatgaggctgcatgatgggtctggggccttgctgattccccagacccctaattaaatgtttcttgtcccagccca

SEQ ID NO: 180988 - DNA, 2251 bp, Homo sapiens
  Payload ID: 15643
  Gene Symbol: STAC2
  Gene Name: SH3 and cysteine rich domain 2
  ENST ID: ENST00000584501
  CDS Start-End: 167-613
ctttctctgcccgctcccgcgggttgggggctgccgtgccgggggctaactgggggcagcctctggagaacggcttcagagtcccggagacgcccgccacccgcagcctgcccgcggtgggcctgccgtcggatctcggcaccctctcctcccctctccccgaaccatgaccgagatgagcgagaaggagaacgaaccggatgacgcggccacccacagccccccagggaccgtctccgccctccaggaaaccaagctccagcgattcaagcgctccctctccctcaagaccatcctccgaagtaagagcttggagaacttcttccttcgctcgggctctgagctcaagtgccccaccgaggaaactccaaacagggcttgcgatgtaagatgtgcaaagtcagcgtccacctctggtgctctgaggagatctcccaccagcaatgcccaggcaagacgtccacctccttccgccgcaacttcagttcccctctcctggtgcatgagccgccaccagtctgtgccacaagcaaagagtccccacccactggggacagtgggaaggtggaccctgtctacgagaccctgcgctatggcacctccctggcactgatgaaccgctccagtttcagcagcacctctgagtccccgacaaggagcctgagtgagcgggatgagctgaccgaggatggggaaggcagcatccgcagctctgaggaggggcctggtgacagtgcatctccagtattcacagccccagcagagagtgaagggccaggaccagaggagaagagtcctggacagcagctccccaaagccaccctgcggaaggatgtggggcccatgtactcctacgttgcactctacaagtttctgccccaggagaacaatgatctggctctgcagcctggagatcggatcatgctggtggatgactctaacgaggactggtggaagggcaagatcggcgaccgggttggcttcttcccagctaattttgtgcaacgggtgaggccaggcgagaatgtttggcgctgctgccaacccttctccgggaacaaggaacagggttacatgagcctcaaggagaaccagatctgcgtgggcgtgggcagaagcaaggatgctgacggcttcatccgcgtcagcagtggcaagaagcggggcctggtgccagtcgacgccctgactgagatctgagaggagccaagggaacccagatgacacccttgcccatgcctggaccttgcttctggccagggaggggatcaggcccccttgtccactccatacccttcctccctctgtccctctcctaggtgccacttaccgtggcttaggagccttttgtactggggaagattttatttcttgggtggggtgccctgagtgggttgatcctctgggacttggcggggatggggtggggtgggagggaatgaggaagctacaggtaggtccacccaacgcccaggcaccccagtctacttgctgggctgagtccagccctggggaagattcctggggaatttatttgctgcttctcccagccttcccctgcccacaccacctgcgcatgcctggcacacccctctccccacagagcctctgcttgggtctatgtgtgtgtgaccgtgcatctgctcctttgcaagtggggtcttgggagcaggcctttttgtgtcctcggccctccacccttggtggggaggggacccaggaccataggaaggtcctgagtccacctcctggtctccacctctgtcattccgtcaattctcaggaaagttttgcaggaatctctcccgttacttgaaacctgggcggacagatgaggggaaggctgaggtccctggaaggtgtaacaaatcagagactatctgttcaagtagaaaacccaagagctggccaggtgtggtggctcatgcctgtaatcccagcactttgggaggctgaggtgggcagatcacctgaggtcaggagttcaagaccagcctggccaacatggtgaaaccccgtctctactaaaagtacgaaacttagccaggcatgatgggggtctgcctgtaatgccagctactccagaggctgaggcaagagaatcacttgaacccgggaggcggaggtttcagtgagccgagattgcaccattgcaccccagcctgggcaacagagcgagactccgtctcaaaaaaaaaaaaagaaagaaagaaaaggaaacccaagagctgcctggacacacggaaaccca

SEQ ID NO: 180989 - DNA, 1656 bp, Homo sapiens
  Payload ID: 15644
  Gene Symbol: STAC3
  Gene Name: SH3 and cysteine rich domain 3
  Uniprot ID: Q96MF2
  ENST ID: ENST00000332782
  CDS Start-End: 203-1297
ccctgtcatttcagccctgacaccaaggcaggaggctaggaggtctacaaatagcgactgggtagctggtgtgaacacagggggtactgggggggcttagcccccaaggaagaggaccagtttttccccagcaccaccatcaaggcctcgaggctcccagctccctctacagcctgtggactgacttagggaatcccgaacgatgacagaaaaggaggtgctggagtcccctaagccctccttcccagcagagactcggcaaagtgggctacagcggctaaagcagttactcaggaagggttctacagggacaaaggagatggaacttcccccagagccccaggccaatggggaggcagtgggagctgggggtgggcccatctactacatctatgaggaagaggaagaggaagaagaggaggaggaggagccacccccagaacctcctaagctggtcaacgataagccccacaaattcaaagatcacttcttcaagaagccaaagttctgtgatgtctgtgcccggatgattgttctcaacaacaagtttgggcttcgctgtaagaactgcaaaaccaacatccatgaacactgtcagtcctatgtggaaatgcagagatgcttcggcaagatcccacctggtttccatcgggcctatagttccccactctacagcaaccagcagtacgcttgtgtcaaagatctctctgctgccaatcgcaatgatcctgtgtttgaaaccctgcgcactggggtgatcatggcaaacaaggaacggaagaagggacaggcagataagaaaaatcctgtagcagccatgatggaggaggagccagagtcggccagaccagaggaaggcaaaccccaggatggaaaccctgaaggggataagaaggctgagaagaagacacctgatgacaagcacaagcagcctggcttccagcagtctcattactttgtggctctctatcggttcaaagccctggagaaggacgatctggatttcccgccaggagagaagatcacagtcattgatgactccaatgaagaatggtggcgggggaaaatcggggagaaggtcggatttttccctccaaacttcatcattcgggtccgggctggagaacgtgtgcaccgcgtgacgagatccttcgtggggaaccgcgagatagggcagatcactctcaagaaggaccagatcgtggtgcagaaaggagacgaagcgggcggctacgtcaaggtctacaccggccgcaaggtggggctgtttcccaccgactttctagaggaaatttaggcgtgcgggcgcctgcaagcgggagacacccacaccccattctgggcgggcccagtggagtttggggaggggggcgaaagcaacgggactgctgggagaggaggggtaggaaggcccgcctgagcgcgacggggcttccgggaagggactggttctcgcccccttccccagcctggggcctcggatacctgctgcccagagcagcccggacccgaaacctttcaggccccgcttgcaagagctggaaaaaaacgcgtatctactaggaggagccagggactggggcggggggcgggggcgagggagggcgaactgtcgaatgttgcgaatttattaaacttttgacaaaacttagaaaa

SEQ ID NO: 180990 - DNA, 1014 bp, Homo sapiens
  Payload ID: 15644
  Gene Symbol: STAC3
  Gene Name: SH3 and cysteine rich domain 3
  Uniprot ID: Q96MF2
  ENST ID: ENST00000546246
  CDS Start-End: 320-856
tttcagccctgacaccaaggcaggaggctaggaggtctacaaatagcgactgggtagctggtgtgaacacagggggtactgggggggcttagcccccaaggaagaggaccagtttttccccagcaccaccatcaaggcctcgaggctcccagctccctctacagcctgtggactgacttagggaatcccgaacccacctggtttccatcgggcctatagttccccactctacagcaaccagcagtacgcttgtgtcaaagatctctctgctgccaatcgcaatgatcctgtgtttgaaaccctgcgcactggggtgatcatggcaaacaaggaacggaagaagggacaggcagataagaaaaatcctgtagcagccatgatggaggaggagccagagtcggccagaccagaggaaggcaaaccccaggatggaaaccctgaaggggataagaaggctgagaagaagacacctgatgacaagcacaagcagcctggcttccagcagtctcattactttgtggctctctatcggttcaaagccctggagaaggacgatctggatttcccgccaggagagaagatcacagtcattgatgactccaatgaagaatggtggcgggggaaaatcggggagaaggtcggatttttccctccaaacttcatcattcgggtccgggctggagaacgtgtgcaccgcgtgacgagatccttcgtggggaaccgcgagatagggcagatcactctcaagaaggaccagatcgtggtgcagaaaggagacgaagcgggcggctacgtcaaggtctacaccggccgcaaggtggggctgtttcccaccgactttctagaggaaatttaggcgtgcgggcgcctgcaagcgggagacacccacaccccattctgggcgggcccagtggagtttggggaggggggcgaaagcaacgggactgctgggagaggaggggtaggaaggcccgcctgagcgcgacggggcttccgggaagggactggttctcg

SEQ ID NO: 180991 - DNA, 1143 bp, Homo sapiens
  Payload ID: 15644
  Gene Symbol: STAC3
  Gene Name: SH3 and cysteine rich domain 3
  ENST ID: ENST00000557176
  CDS Start-End: 321-635
atttcagccctgacaccaaggcaggaggctaggaggtctacaaatagcgactgggtagctggtgtgaacacagggggtactgggggggcttagcccccaaggaagaggaccagtttttccccagcaccaccatcaaggcctcgaggctcccagctccctctacagcctgtggactgacttagggaatcccgaacccacctggtttccatcgggcctatagttccccactctacagcaaccagcagtacgcttgtgtcaaagatctctctgctgccaatcgcaatgatcctgtgtttgaaaccctgcgcactggggtgatcatggcaaacaaggaacggaagaagggacaggcagataagaaaaatgaaaccctgaaggggataagaaggctgagaagaagacacctgatgacaagcacaagcagcctggcttccagcagtctcattactttgtggctctctatcggttcaaagccctggagaaggacgatctggatttcccgccaggagagaagatcacagtcattgatgactccaatgaagaatggtggcgggggaaaatcggggagaaggtcggatttttccctccaaacttcatcattcgggtccgggctggagaacgtgtgcaccgcgtgacgagatccttcgtggggaaccgcgagatagggcagatcactctcaagaaggaccagatcgtggtgcagaaaggagacgaagcgggcggctacgtcaaggtctacaccggccgcaaggtggggctgtttcccaccgactttctagaggaaatttaggcgtgcgggcgcctgcaagcgggagacacccacaccccattctgggcgggcccagtggagtttggggaggggggcgaaagcaacgggactgctgggagaggaggggtaggaaggcccgcctgagcgcgacggggcttccgggaagggactggttctcgcccccttccccagcctggggcctcggatacctgctgcccagagcagcccggacccgaaacctttcaggccccgcttgcaagagctggaaaaaaacgcgtatctactaggaggagccagggactggggcggggggcgggggcgagggagggcgaactgtcgaatgttgcgaatttattaaacttttgacaaaactt

SEQ ID NO: 180992 - DNA, 1580 bp, Homo sapiens
  Payload ID: 15644
  Gene Symbol: STAC3
  Gene Name: SH3 and cysteine rich domain 3
  Uniprot ID: Q96MF2
  ENST ID: ENST00000554578
  CDS Start-End: 244-1221
ttcagccctgacaccaaggcaggaggctaggaggtctacaaatagcgactgggtagctggtgtgaacacagggggtactgggggggcttagcccccaaggaagaggaccagtttttccccagcaccaccatcaaggcctcgaggctcccagctccctctacagcctgtggactgacttagggaatcccgaacctacagcggctaaagcagttactcaggaagggttctacagggacaaaggagatggaacttcccccagagccccaggccaatggggaggcagtgggagctgggggtgggcccatctactacatctatgaggaagaggaagaggaagaagaggaggaggaggagccacccccagaacctcctaagctggtcaacgataagccccacaaattcaaagatcacttcttcaagaagccaaagttctgtgatgtctgtgcccggatgattgttctcaacaacaagtttgggcttcgctgtaagaactgcaaaaccaacatccatgaacactgtcagtcctatgtggaaatgcagagatgcttcggcaagatcccacctggtttccatcgggcctatagttccccactctacagcaaccagcagtacgcttgtgtcaaagatctctctgctgccaatcgcaatgatcctgtgtttgaaaccctgcgcactggggtgatcatggcaaacaaggaacggaagaagggacaggcagataagaaaaatcctgtagcagccatgatggaggaggagccagagtcggccagaccagaggaaggcaaaccccaggatggaaaccctgaaggggataagaaggctgagaagaagacacctgatgacaagcacaagcagcctggcttccagcagtctcattactttgtggctctctatcggttcaaagccctggagaaggacgatctggatttcccgccaggagagaagatcacagtcattgatgactccaatgaagaatggtggcgggggaaaatcggggagaaggtcggatttttccctccaaacttcatcattcgggtccgggctggagaacgtgtgcaccgcgtgacgagatccttcgtggggaaccgcgagatagggcagatcactctcaagaaggaccagatcgtggtgcagaaaggagacgaagcgggcggctacgtcaaggtctacaccggccgcaaggtggggctgtttcccaccgactttctagaggaaatttaggcgtgcgggcgcctgcaagcgggagacacccacaccccattctgggcgggcccagtggagtttggggaggggggcgaaagcaacgggactgctgggagaggaggggtaggaaggcccgcctgagcgcgacggggcttccgggaagggactggttctcgcccccttccccagcctggggcctcggatacctgctgcccagagcagcccggacccgaaacctttcaggccccgcttgcaagagctggaaaaaaacgcgtatctactaggaggagccagggactggggcggggggcgggggcgagggagggcgaactgtcgaatgttgcgaatttattaaacttttgacaaaacttagaaaa

SEQ ID NO: 180993 - DNA, 795 bp, Homo sapiens
  Payload ID: 15644
  Gene Symbol: STAC3
  Gene Name: SH3 and cysteine rich domain 3
  ENST ID: ENST00000553489
  CDS Start-End: 291-795
tcatttcagccctgacaccaaggcaggaggctaggaggtctacaaatagcgactgggtagctggtgtgaacacagggggtactgggggggcttagcccccaaggaagaggaccagtttttccccagcaccaccatcaaggcctcgaggctcccagctccctctacagcctgtggactgacttagggaatcccgaaccctcccctttgaggaccaccctactgcaagggacagaaagggagagaagaatgaaagggattagatttcatagtggggtccaacctcttgcaggatgacagaaaaggaggtgctggagtcccctaagccctccttcccagcagagactcggcaaagtgggctacagcggctaaagcagttactcaggaagggttctacagggacaaaggagatggaacttcccccagagccccaggccaatggggaggcagtgggagctgggggtgggcccatctactacatctatgaggaagaggaagaggaagaagaggaggaggaggagccacccccagaacctcctaagctggtcaacgataagccccacaaattcaaagatcacttcttcaagaagccaaagttctgtgatgtctgtgcccggatgattgttctcaacaacaagtttgggcttcgctgtaagaactgcaaaaccaacatccatgaacactgtcagtcctatgtggaaatgcagagatgcttcggcaagatcccacctggtttccatcgggcctatagttccccactctacagcaaccagcagtacgcttgtgtcaaagatctct

SEQ ID NO: 180994 - DNA, 6643 bp, Homo sapiens
  Payload ID: 15645
  Gene Symbol: SHANK1
  Gene Name: SH3 and multiple ankyrin repeat domains 1
  Uniprot ID: Q9Y566
  ENST ID: ENST00000293441
  CDS Start-End: 20-6505
gtcgccccgtggccccacaatgacccacagccccgcgacaagcgaggacgaggaacgccacagtgccagcgagtgtcccgaggggggctcagagtccgacagctccccagacgggccaggtcgaggcccccgggggacccggggccagggcagtggggcacctggtagcctggcctctgttagaggcctccagggccgctcaatgtccgtcccagacgacgcccacttcagcatgatggtcttcaggattggcatcccggacctgcaccagacaaaatgccttcgcttcaaccccgatgccaccatctggacggccaagcagcaggtgctctgtgccctgagcgagagcctgcaggatgtgctcaactatggcctgttccaaccggccacctccggccgcgatgccaacttcctggaggaggagaggctgctgcgggagtacccccagtcctttgagaagggggtcccctacctggagttccgatacaagacccgagtttacaaacagaccaacctggatgagaagcagctggccaagttgcacacgaagacggggttgaagaagttcctggagtatgtgcagctcgggacatctgacaaggtggcgcggctgctggacaaggggctggaccccaattaccatgactcggattcgggagagacccccttgacactggcggcccagaccgaaggctctgtagaggtgattcgaaccctgtgcctgggcggggcccacattgacttccgggcccgggatggcatgaccgcactgcataaggccgcatgcgcccgacactgcctggcactcacggcgctcctggaccttgggggttcccccaactacaaggaccgtcgggggctgacccctctgttccacacggccatggtgggtggtgacccccgatgctgcgagctgctcctgttcaacagggcccagctgggcatagctgatgagaacggctggcaggaaatccaccaggcctgccagcggggtcactctcagcacctggagcatctgcttttctacggggctgagcctggagcccagaacgcctcggggaacacggctctgcacatctgcgccctctacaacaaggagacctgtgccaggatcctcctgtatcgaggtgccgacaaggatgtgaagaacaacaacggacagacccccttccaggtggcagtgattgctgggaattttgagctgggggagctgatccgaaaccaccgagaacaggatgtggtgcccttccaggagtcccccaagtacgcggcccggcgacgggggcccccaggcacagggctgacggtgcccccggcgctgctgcgggccaacagtgacaccagcatggcgctgcccgactggatggtgttctccgccccgggggccgcgtcctctggggcccctggccctacctcagggtcccagggccagtcgcagccctcggcccccaccaccaagctcagcagcgggaccctccgaagtgccagcagcccccggggtgccagggcccgctctccatcccgagggaggcaccctgaggacgccaagaggcagccccgaggccggcccagctccagcgggacaccccgggaagggccagccgggggcacggggggctcagggggccccgggggctccctgggcagccgcgggaggcggaggaagctctactcagcggtacccggacgctccttcatggctgtgaagtcctaccaggcccaagccgagggggagatctccctgagcaagggcgagaagatcaaagtacttagcatcggggaaggaggcttctgggaaggccaggtcaaaggtcgtgttggctggttcccctctgactgcctggaagaagtggcgaatcgctctcaggagagcaagcaagaaagccgcagtgacaaggcaaagagactcttccggcattataccgtgggctcctacgacagctttgatgccccaagcttaatggatgggattggcccagggagcgattacatcattaaggagaagacagtcttgctgcagaagaaggacagtgaggggtttgggttcgtgctccggggggccaaggcgcagacccccatcgaggagttcacccccaccccggccttcccggcgctgcagtacctggagtcggtggacgagggtggcgtggcatggcgagctggactgcgaatgggagacttcctcatcgaggtgaacgggcagaatgtggtgaaggtcggccaccgacaggtggtgaacatgatccgccaagggggcaacacgctgatggtgaaggtggtgatggtcaccaggcacccggacatggatgaggcagtgcacaagaaagcaccccagcaggccaagcggctgccgcccccaaccatctccctgcgttccaaatctatgacctcagagctggaggagatggagtacgagcagcagccggcgccggtgcccagcatggagaaaaagcggaccgtgtatcagatggctctcaacaaactggacgaaatcctggccgcagctcaacagaccatcagtgcaagcgaaagccctggtcccggtggcctcgcgtccctgggcaaacaccgacccaaaggtttctttgccactgagtcgagcttcgatccccaccaccgtgcccagccaagttacgagcgtccttctttcctgcctccaggacctgggttgatgctccggcaaaaatctatcggtgcggcagaagatgacagaccttacctagcacccccagccatgaaattcagccgcagcctgtctgtgcctggttcggaggacattcccccgccacccaccacgtccccaccggagcctccctacagcacacctccagtcccctcctcctcagggcgcctcaccccctcccctcggggagggcccttcaaccctggctctggtggccccctccccgcctcctcccctgcatcctttgacgggccctcccctcccgacactcgcgtggggagccgcgagaagagcctgtaccacagtgggcccctgcccccggcccaccaccacccgccccaccaccaccaccaccacgccccgccccctcagccccaccaccaccacgcccacccccctcatcctcccgagatggagacaggcggctctcccgacgaccctccaccccgcctggctctggggccccagcccagcctgcgaggctggaggggcggcgggcccagcccgaccccgggggccccgtccccatcgcaccacggcagcgcgggcgggggcggcggctcctcccagggcccggctctacgctatttccagctgcccccgcgggcggccagcgcagccatgtacgtgcccgcccgctcgggccgcggccgcaagggcccgctggtcaagcagaccaaggtggaaggcgagccccagaagggcggcggcctcccgcccgcgccgtcgcccacgtccccggcctccccgcagccgccgcccgccgtggccgcgccctcggagaagaactccatccccatccccaccatcatcatcaaggccccgtccaccagtagcagcggccgcagcagccagggcagcagcaccgaggcggagccccccacccagccggagcccacgggaggcggcggcggcggcggctcctcgcccagccccgccccggccatgtcacccgtgcccccgtccccctcgcccgtgcccacccccgcctcgcccagcggcccggccacgctggacttcacgagccagttcggggccgccctggtgggggcggcccggagggaggggggctggcagaatgaggcgcgccggcgctccacgctgttcctgtccaccgacgcgggggacgaggacggcggggacggcgggctgggcacaggggcggccccgggcccgcggctgcgccactccaaatccatcgacgagggcatgttctccgccgagccctacctccgactggagtctgcgggcagcggcgcgggctacggcggctacggggccggtagccgagcctacgggggtggcgggggcagcagcgccttcaccagcttcctgcccccgcgacccctggtgcacccgctgaccggcaaggccctggatcccgcctccccgctggggctggccctggccgcccgcgagcgagcgctgaaggagtcctcggagggcggcggggccccccagccgcctcccaggcccccatcgccccgctacgaggccccgccgcccaccccgcaccaccactcgccccacgcccaccacgagccagtgctgcgtctctggggggcctccccgccggaccctgcgcgccgggagctggggtacagggccgggctgggcagccaggagaagtcccttcccgccagcccgcccgccgcccggcgttccctgctacaccgcctgccgcccaccgctcccggggtggggcccctcctgctgcagctggggacggagcccccggccccgcaccccggagtaagcaagccctggaggtccgcagcccccgaagaacccgagcggctgccgctgcacgtgcggttccttgaaaactgccagccccgggcccctgtgacgagcggaaggggtcccccctcggaggacgggccgggggtcccgccgcccagcccacgccggtccgtgcccccctccccgacctccccgagggccagcgaagagaacgggctgcccctgctggtcctgccgcctcccgccccctcggtggatgtggaagatggcgaattccttttcgtggaaccgctgcctccgcctctggaattctccaacagcttcgaaaagccagagtcgcccctcacgcctgggcctccccacccgctgcccgacacacctgcccctgccaccccgttaccccctgtgccacccccggctgtggccgcagcccctcccaccctggactccaccgcatccagcctgacatcctatgacagcgaggtggccaccctgacccagggggcctccgccgctcctggggacccccatccaccaggcccgcctgccccagcagcaccggctcccgctgccccacagcctggcccggaccctccgcctggcacggattctggcatcgaggaggtggacagtcggagcagcagtgaccacccactggagaccatcagcagcgcctccacgctgagcagcctatctgccgaaggtggtggcagcgcagggggtgggggcggggctggggccggtgtggccagtgggccggagcttctggacacctatgtggcctacctggacggccaggcctttgggggcagcagtactcccggcccgccataccctcctcagctcatgactccctctaagctccggggccgggcgctaggagccagcggaggcctgcggcctggccccagcgggggactccgagaccctgttacccccaccagccccaccgtctcggtgacaggggctggaaccgatgggctgctggccctgcgtgcttgttcaggaccccccacggcaggcgtggcggggggtccggtggctgtagagccagaagtcccaccggtgcccttgccgacggcctcctctctgccccggaagctgctgccctgggaggagggcccgggcccaccgccaccacctctgcccgggcccttggcccagcctcaggcctcagccttggccacagtaaaagccagcatcatcagtgaactcagctccaagcttcagcagtttgggggctcctcggcagctggcggcgctctgccctgggcccgaggaggcagtgggggaggcggagacagccaccacgggggagccagctatgtccccgagaggacctcctccctgcagcggcagagactctccgacgactcccagtcctcactcctctccaagcctgtcagcagcctgtttcagaactggcccaaaccacctctgccgccactccccaccggaacaggggtctcccctacagccgctgcggccccaggggccacctcaccctcagcctcctcctcctccacgtccacccgccacctccagggcgtggagttcgagatgcggccccctctgctccgccgggcccccagcccctcgctgctgcccgcctcggagcacaaggtcagccctgcgcccaggccctcgtccctgcccatcctgccttccggacccctctacccaggcctctttgacatccgtggctccccaactggaggggcaggaggctcggctgaccccttcgccccagtctttgtgccgccacacccggggatatccggggggctcgggggagccttgtcaggggcctcgcgctccctctcaccgacccgcctgctctcgctgcccccggacaagccgtttggcgctaaacctctggggttctggaccaagttcgacgtggctgattggctggagtggctgggtttggcggagcaccgagcccagttcctggaccacgagatcgatggctcccacctgcccgccttgaccaaggaggactacgtcgatctaggtgtgaccagggtgggccaccgcatgaacatcgaccgggctctcaaattcttcctggagaggtgatggctggcctggacggaccagccccgtccacagaactcttgagcctgctggcctcttgacctctgacccctgactgtcattctctccccgggccagggactctgttcaaactgcgccctgccctcatctcccaaggcc

SEQ ID NO: 180995 - DNA, 6459 bp, Homo sapiens
  Payload ID: 15645
  Gene Symbol: SHANK1
  Gene Name: SH3 and multiple ankyrin repeat domains 1
  Uniprot ID: Q9Y566
  ENST ID: ENST00000359082
  CDS Start-End: 1-6459
atgacccacagccccgcgacaagcgaggacgaggaacgccacagtgccagcgagtgtcccgaggggggctcagagtccgacagctccccagacgggccaggtcgaggcccccgggggacccggggccagggcagtggggcacctggtagcctggcctctgttagaggcctccagggccgctcaatgtccgtcccagacgacgcccacttcagcatgatggtcttcaggattggcatcccggacctgcaccagacaaaatgccttcgcttcaaccccgatgccaccatctggacggccaagcagcaggtgctctgtgccctgagcgagagcctgcaggatgtgctcaactatggcctgttccaaccggccacctccggccgcgatgccaacttcctggaggaggagaggctgctgcgggagtacccccagtcctttgagaagggggtcccctacctggagttccgatacaagacccgagtttacaaacagaccaacctggatgagaagcagctggccaagttgcacacgaagacggggttgaagaagttcctggagtatgtgcagctcgggacatctgacaaggtggcgcggctgctggacaaggggctggaccccaattaccatgactcggattcgggagagacccccttgacactggcggcccagaccgaaggctctgtagaggtgattcgaaccctgtgcctgggcggggcccacattgacttccgggcccgggatggcatgaccgcactgcataaggccgcatgcgcccgacactgcctggcactcacggcgctcctggaccttgggggttcccccaactacaaggaccgtcgggggctgacccctctgttccacacggccatggtgggtggtgacccccgatgctgcgagctgctcctgttcaacagggcccagctgggcatagctgatgagaacggctggcaggaaatccaccaggcctgccagcggggtcactctcagcacctggagcatctgcttttctacggggctgagcctggagcccagaacgcctcggggaacacggctctgcacatctgcgccctctacaacaaggagacctgtgccaggatcctcctgtatcgaggtgccgacaaggatgtgaagaacaacaacggacagacccccttccaggtggcagtgattgctgggaattttgagctgggggagctgatccgaaaccaccgagaacaggatgtggtgcccttccaggagtcccccaagtacgcggcccggcgacgggggcccccaggcacagggctgacggtgcccccggcgctgctgcgggccaacagtgacaccagcatggcgctgcccgactggatggtgttctccgccccgggggccgcgtcctctggggcccctggccctacctcagggtcccagggccagtcgcagccctcggcccccaccaccaagctcagcagcgggaccctccgaagtgccagcagcccccggggtgccagggcccgctctccatcccgagggaggcaccctgaggacgccaagaggcagccccgaggccggcccagctccagcgggacaccccgggaagggccagccgggggcacggggggctcagggggccccgggggctccctgggcagccgcgggaggcggaggaagctctactcagcggtacccggacgctccttcatggctgtgaagtcctaccaggcccaagccgagggggagatctccctgagcaagggcgagaagatcaaagtacttagcatcggggaaggaggcttctgggaaggccaggtcaaaggtcgtgttggctggttcccctctgactgcctggaagaagtggcgaatcgctctcaggagagcaagcaagaaagccgcagtgacaaggcaaagagactcttccggcattataccgtgggctcctacgacagctttgatgccccaagcgattacatcattaaggagaagacagtcttgctgcagaagaaggacagtgaggggtttgggttcgtgctccggggggccaaggcgcagacccccatcgaggagttcacccccaccccggccttcccggcgctgcagtacctggagtcggtggacgagggtggcgtggcatggcgagctggactgcgaatgggagacttcctcatcgaggtgaacgggcagaatgtggtgaaggtcggccaccgacaggtggtgaacatgatccgccaagggggcaacacgctgatggtgaaggtggtgatggtcaccaggcacccggacatggatgaggcagtgcacaagaaagcaccccagcaggccaagcggctgccgcccccaaccatctccctgcgttccaaatctatgacctcagagctggaggagatggagtacgagcagcagccggcgccggtgcccagcatggagaaaaagcggaccgtgtatcagatggctctcaacaaactggacgaaatcctggccgcagctcaacagaccatcagtgcaagcgaaagccctggtcccggtggcctcgcgtccctgggcaaacaccgacccaaaggtttctttgccactgagtcgagcttcgatccccaccaccgtgcccagccaagttacgagcgtccttctttcctgcctccaggacctgggttgatgctccggcaaaaatctatcggtgcggcagaagatgacagaccttacctagcacccccagccatgaaattcagccgcagcctgtctgtgcctggttcggaggacattcccccgccacccaccacgtccccaccggagcctccctacagcacacctccagtcccctcctcctcagggcgcctcaccccctcccctcggggagggcccttcaaccctggctctggtggccccctccccgcctcctcccctgcatcctttgacgggccctcccctcccgacactcgcgtggggagccgcgagaagagcctgtaccacagtgggcccctgcccccggcccaccaccacccgccccaccaccaccaccaccacgccccgccccctcagccccaccaccaccacgcccacccccctcatcctcccgagatggagacaggcggctctcccgacgaccctccaccccgcctggctctggggccccagcccagcctgcgaggctggaggggcggcgggcccagcccgaccccgggggccccgtccccatcgcaccacggcagcgcgggcgggggcggcggctcctcccagggcccggctctacgctatttccagctgcccccgcgggcggccagcgcagccatgtacgtgcccgcccgctcgggccgcggccgcaagggcccgctggtcaagcagaccaaggtggaaggcgagccccagaagggcggcggcctcccgcccgcgccgtcgcccacgtccccggcctccccgcagccgccgcccgccgtggccgcgccctcggagaagaactccatccccatccccaccatcatcatcaaggccccgtccaccagtagcagcggccgcagcagccagggcagcagcaccgaggcggagccccccacccagccggagcccacgggaggcggcggcggcggcggctcctcgcccagccccgccccggccatgtcacccgtgcccccgtccccctcgcccgtgcccacccccgcctcgcccagcggcccggccacgctggacttcacgagccagttcggggccgccctggtgggggcggcccggagggaggggggctggcagaatgaggcgcgccggcgctccacgctgttcctgtccaccgacgcgggggacgaggacggcggggacggcgggctgggcacaggggcggccccgggcccgcggctgcgccactccaaatccatcgacgagggcatgttctccgccgagccctacctccgactggagtctgcgggcagcggcgcgggctacggcggctacggggccggtagccgagcctacgggggtggcgggggcagcagcgccttcaccagcttcctgcccccgcgacccctggtgcacccgctgaccggcaaggccctggatcccgcctccccgctggggctggccctggccgcccgcgagcgagcgctgaaggagtcctcggagggcggcggggccccccagccgcctcccaggcccccatcgccccgctacgaggccccgccgcccaccccgcaccaccactcgccccacgcccaccacgagccagtgctgcgtctctggggggcctccccgccggaccctgcgcgccgggagctggggtacagggccgggctgggcagccaggagaagtcccttcccgccagcccgcccgccgcccggcgttccctgctacaccgcctgccgcccaccgctcccggggtggggcccctcctgctgcagctggggacggagcccccggccccgcaccccggagtaagcaagccctggaggtccgcagcccccgaagaacccgagcggctgccgctgcacgtgcggttccttgaaaactgccagccccgggcccctgtgacgagcggaaggggtcccccctcggaggacgggccgggggtcccgccgcccagcccacgccggtccgtgcccccctccccgacctccccgagggccagcgaagagaacgggctgcccctgctggtcctgccgcctcccgccccctcggtggatgtggaagatggcgaattccttttcgtggaaccgctgcctccgcctctggaattctccaacagcttcgaaaagccagagtcgcccctcacgcctgggcctccccacccgctgcccgacacacctgcccctgccaccccgttaccccctgtgccacccccggctgtggccgcagcccctcccaccctggactccaccgcatccagcctgacatcctatgacagcgaggtggccaccctgacccagggggcctccgccgctcctggggacccccatccaccaggcccgcctgccccagcagcaccggctcccgctgccccacagcctggcccggaccctccgcctggcacggattctggcatcgaggaggtggacagtcggagcagcagtgaccacccactggagaccatcagcagcgcctccacgctgagcagcctatctgccgaaggtggtggcagcgcagggggtgggggcggggctggggccggtgtggccagtgggccggagcttctggacacctatgtggcctacctggacggccaggcctttgggggcagcagtactcccggcccgccataccctcctcagctcatgactccctctaagctccggggccgggcgctaggagccagcggaggcctgcggcctggccccagcgggggactccgagaccctgttacccccaccagccccaccgtctcggtgacaggggctggaaccgatgggctgctggccctgcgtgcttgttcaggaccccccacggcaggcgtggcggggggtccggtggctgtagagccagaagtcccaccggtgcccttgccgacggcctcctctctgccccggaagctgctgccctgggaggagggcccgggcccaccgccaccacctctgcccgggcccttggcccagcctcaggcctcagccttggccacagtaaaagccagcatcatcagtgaactcagctccaagcttcagcagtttgggggctcctcggcagctggcggcgctctgccctgggcccgaggaggcagtgggggaggcggagacagccaccacgggggagccagctatgtccccgagaggacctcctccctgcagcggcagagactctccgacgactcccagtcctcactcctctccaagcctgtcagcagcctgtttcagaactggcccaaaccacctctgccgccactccccaccggaacaggggtctcccctacagccgctgcggccccaggggccacctcaccctcagcctcctcctcctccacgtccacccgccacctccagggcgtggagttcgagatgcggccccctctgctccgccgggcccccagcccctcgctgctgcccgcctcggagcacaaggtcagccctgcgcccaggccctcgtccctgcccatcctgccttccggacccctctacccaggcctctttgacatccgtggctccccaactggaggggcaggaggctcggctgaccccttcgccccagtctttgtgccgccacacccggggatatccggggggctcgggggagccttgtcaggggcctcgcgctccctctcaccgacccgcctgctctcgctgcccccggacaagccgtttggcgctaaacctctggggttctggaccaagttcgacgtggctgattggctggagtggctgggtttggcggagcaccgagcccagttcctggaccacgagatcgatggctcccacctgcccgccttgaccaaggaggactacgtcgatctaggtgtgaccagggtgggccaccgcatgaacatcgaccgggctctcaaattcttcctggagaggtga

SEQ ID NO: 180996 - DNA, 4785 bp, Homo sapiens
  Payload ID: 15645
  Gene Symbol: SHANK1
  Gene Name: SH3 and multiple ankyrin repeat domains 1
  Uniprot ID: Q9Y566
  ENST ID: ENST00000391813
  CDS Start-End: 1-4647
atgcaattaatggccctggagcagaggtttgggtctgggttgccgggtgggggacagcctctgtgtctcatgatgtcttctccactccccccaccacccccccatttctcctgcctccctgccagcgattacatcattaaggagaagacagtcttgctgcagaagaaggacagtgaggggtttgggttcgtgctccggggggccaaggcgcagacccccatcgaggagttcacccccaccccggccttcccggcgctgcagtacctggagtcggtggacgagggtggcgtggcatggcgagctggactgcgaatgggagacttcctcatcgaggtgaacgggcagaatgtggtgaaggtcggccaccgacaggtggtgaacatgatccgccaagggggcaacacgctgatggtgaaggtggtgatggtcaccaggcacccggacatggatgaggcagtgcacaagaaagcaccccagcaggccaagcggctgccgcccccaaccatctccctgcgttccaaatctatgacctcagagctggaggagatggagtacgagcagcagccggcgccggtgcccagcatggagaaaaagcggaccgtgtatcagatggctctcaacaaactggacgaaatcctggccgcagctcaacagaccatcagtgcaagcgaaagccctggtcccggtggcctcgcgtccctgggcaaacaccgacccaaaggtttctttgccactgagtcgagcttcgatccccaccaccgtgcccagccaagttacgagcgtccttctttcctgcctccaggacctgggttgatgctccggcaaaaatctatcggtgcggcagaagatgacagaccttacctagcacccccagccatgaaattcagccgcagcctgtctgtgcctggttcggaggacattcccccgccacccaccacgtccccaccggagcctccctacagcacacctccagtcccctcctcctcagggcgcctcaccccctcccctcggggagggcccttcaaccctggctctggtggccccctccccgcctcctcccctgcatcctttgacgggccctcccctcccgacactcgcgtggggagccgcgagaagagcctgtaccacagtgggcccctgcccccggcccaccaccacccgccccaccaccaccaccaccacgccccgccccctcagccccaccaccaccacgcccacccccctcatcctcccgagatggagacaggcggctctcccgacgaccctccaccccgcctggctctggggccccagcccagcctgcgaggctggaggggcggcgggcccagcccgaccccgggggccccgtccccatcgcaccacggcagcgcgggcgggggcggcggctcctcccagggcccggctctacgctatttccagctgcccccgcgggcggccagcgcagccatgtacgtgcccgcccgctcgggccgcggccgcaagggcccgctggtcaagcagaccaaggtggaaggcgagccccagaagggcggcggcctcccgcccgcgccgtcgcccacgtccccggcctccccgcagccgccgcccgccgtggccgcgccctcggagaagaactccatccccatccccaccatcatcatcaaggccccgtccaccagtagcagcggccgcagcagccagggcagcagcaccgaggcggagccccccacccagccggagcccacgggaggcggcggcggcggcggctcctcgcccagccccgccccggccatgtcacccgtgcccccgtccccctcgcccgtgcccacccccgcctcgcccagcggcccggccacgctggacttcacgagccagttcggggccgccctggtgggggcggcccggagggaggggggctggcagaatgaggcgcgccggcgctccacgctgttcctgtccaccgacgcgggggacgaggacggcggggacggcgggctgggcacaggggcggccccgggcccgcggctgcgccactccaaatccatcgacgagggcatgttctccgccgagccctacctccgactggagtctgcgggcagcggcgcgggctacggcggctacggggccggtagccgagcctacgggggtggcgggggcagcagcgccttcaccagcttcctgcccccgcgacccctggtgcacccgctgaccggcaaggccctggatcccgcctccccgctggggctggccctggccgcccgcgagcgagcgctgaaggagtcctcggagggcggcggggccccccagccgcctcccaggcccccatcgccccgctacgaggccccgccgcccaccccgcaccaccactcgccccacgcccaccacgagccagtgctgcgtctctggggggcctccccgccggaccctgcgcgccgggagctggggtacagggccgggctgggcagccaggagaagtcccttcccgccagcccgcccgccgcccggcgttccctgctacaccgcctgccgcccaccgctcccggggtggggcccctcctgctgcagctggggacggagcccccggccccgcaccccggagtaagcaagccctggaggtccgcagcccccgaagaacccgagcggctgccgctgcacgtgcggttccttgaaaactgccagccccgggcccctgtgacgagcggaaggggtcccccctcggaggacgggccgggggtcccgccgcccagcccacgccggtccgtgcccccctccccgacctccccgagggccagcgaagagaacgggctgcccctgctggtcctgccgcctcccgccccctcggtggatgtggaagatggcgaattccttttcgtggaaccgctgcctccgcctctggaattctccaacagcttcgaaaagccagagtcgcccctcacgcctgggcctccccacccgctgcccgacacacctgcccctgccaccccgttaccccctgtgccacccccggctgtggccgcagcccctcccaccctggactccaccgcatccagcctgacatcctatgacagcgaggtggccaccctgacccagggggcctccgccgctcctggggacccccatccaccaggcccgcctgccccagcagcaccggctcccgctgccccacagcctggcccggaccctccgcctggcacggattctggcatcgaggaggtggacagtcggagcagcagtgaccacccactggagaccatcagcagcgcctccacgctgagcagcctatctgccgaaggtggtggcagcgcagggggtgggggcggggctggggccggtgtggccagtgggccggagcttctggacacctatgtggcctacctggacggccaggcctttgggggcagcagtactcccggcccgccataccctcctcagctcatgactccctctaagctccggggccgggcgctaggagccagcggaggcctgcggcctggccccagcgggggactccgagaccctgttacccccaccagccccaccgtctcggtgacaggggctggaaccgatgggctgctggccctgcgtgcttgttcaggaccccccacggcaggcgtggcggggggtccggtggctgtagagccagaagtcccaccggtgcccttgccgacggcctcctctctgccccggaagctgctgccctgggaggagggcccgggcccaccgccaccacctctgcccgggcccttggcccagcctcaggcctcagccttggccacagtaaaagccagcatcatcagtgaactcagctccaagcttcagcagtttgggggctcctcggcagctggcggcgctctgccctgggcccgaggaggcagtgggggaggcggagacagccaccacgggggagccagctatgtccccgagaggacctcctccctgcagcggcagagactctccgacgactcccagtcctcactcctctccaagcctgtcagcagcctgtttcagaactggcccaaaccacctctgccgccactccccaccggaacaggggtctcccctacagccgctgcggccccaggggccacctcaccctcagcctcctcctcctccacgtccacccgccacctccagggcgtggagttcgagatgcggccccctctgctccgccgggcccccagcccctcgctgctgcccgcctcggagcacaaggtcagccctgcgcccaggccctcgtccctgcccatcctgccttccggacccctctacccaggcctctttgacatccgtggctccccaactggaggggcaggaggctcggctgaccccttcgccccagtctttgtgccgccacacccggggatatccggggggctcgggggagccttgtcaggggcctcgcgctccctctcaccgacccgcctgctctcgctgcccccggacaagccgtttggcgctaaacctctggggttctggaccaagttcgacgtggctgattggctggagtggctgggtttggcggagcaccgagcccagttcctggaccacgagatcgatggctcccacctgcccgccttgaccaaggaggactacgtcgatctaggtgtgaccagggtgggccaccgcatgaacatcgaccgggctctcaaattcttcctggagaggtgatggctggcctggacggaccagccccgtccacagaactcttgagcctgctggcctcttgacctctgacccctgactgtcattctctccccgggccagggactctgttcaaactgcgccctgccctcatctcccaaggcc

SEQ ID NO: 180997 - DNA, 6622 bp, Homo sapiens
  Payload ID: 15645
  Gene Symbol: SHANK1
  Gene Name: SH3 and multiple ankyrin repeat domains 1
  ENST ID: ENST00000391814
  CDS Start-End: 89-6598
ggccgcgggcgccgccgaccgggactcagcagccccgccaggcagccgcctgtgatgctgccgtcccccgtcgccccgtggccccacaatgacccacagccccgcgacaagcgaggacgaggaacgccacagtgccagcgagtgtcccgaggggggctcagagtccgacagctccccagacgggccaggtcgaggcccccgggggacccggggccagggcagtggggcacctggtagcctggcctctgttagaggcctccagggccgctcaatgtccgtcccagacgacgcccacttcagcatgatggtcttcaggattggcatcccggacctgcaccagacaaaatgccttcgcttcaaccccgatgccaccatctggacggccaagcagcaggtgctctgtgccctgagcgagagcctgcaggatgtgctcaactatggcctgttccaaccggccacctccggccgcgatgccaacttcctggaggaggagaggctgctgcgggagtacccccagtcctttgagaagggggtcccctacctggagttccgatacaagacccgagtttacaaacagaccaacctggatgagaagcagctggccaagttgcacacgaagacggggttgaagaagttcctggagtatgtgcagctcgggacatctgacaaggtggcgcggctgctggacaaggggctggaccccaattaccatgactcggattcgggagagacccccttgacactggcggcccagaccgaaggctctgtagaggtgattcgaaccctgtgcctgggcggggcccacattgacttccgggcccgggatggcatgaccgcactgcataaggccgcatgcgcccgacactgcctggcactcacggcgctcctggaccttgggggttcccccaactacaaggaccgtcgggggctgacccctctgttccacacggccatggtgggtggtgacccccgatgctgcgagctgctcctgttcaacagggcccagctgggcatagctgatgagaacggctggcaggaaatccaccaggcctgccagcggggtcactctcagcacctggagcatctgcttttctacggggctgagcctggagcccagaacgcctcggggaacacggctctgcacatctgcgccctctacaacaaggagacctgtgccaggatcctcctgtatcgaggtgccgacaaggatgtgaagaacaacaacggacagacccccttccaggtggcagtgattgctgggaattttgagctgggggagctgatccgaaaccaccgagaacaggatgtggtgcccttccaggagtcccccaagtacgcggcccggcgacgggggcccccaggcacagggctgacggtgcccccggcgctgctgcgggccaacagtgacaccagcatggcgctgcccgactggatggtgttctccgccccgggggccgcgtcctctggggcccctggccctacctcagggtcccagggccagtcgcagccctcggcccccaccaccaagctcagcagcgggaccctccgaagtgccagcagcccccggggtgccagggcccgctctccatcccgagggaggcaccctgaggacgccaagaggcagccccgaggccggcccagctccagcgggacaccccgggaagggccagccgggggcacggggggctcagggggccccgggggctccctgggcagccgcgggaggcggaggaagctctactcagcggtacccggacgctccttcatggctgtgaagtcctaccaggcccaagccgagggggagatctccctgagcaagggcgagaagatcaaagtacttagcatcggggaaggaggcttctgggaaggccaggtcaaaggtcgtgttggctggttcccctctgactgcctggaagaagtggcgaatcgctctcaggagagcaagcaagaaagccgcagtgacaaggcaaagagactcttccggcattataccgtgggctcctacgacagctttgatgccccaagcttaatggatgggattggcccagggagcgattacatcattaaggagaagacagtcttgctgcagaagaaggacagtgaggggtttgggttcgtgctccggggggccaaggcgcagacccccatcgaggagttcacccccaccccggccttcccggcgctgcagtacctggagtcggtggacgagggtggcgtggcatggcgagctggactgcgaatgggagacttcctcatcgaggtgaacgggcagaatgtggtgaaggtcggccaccgacaggtggtgaacatgatccgccaagggggcaacacgctgatggtgaaggtggtgatggtcaccaggcacccggacatggatgaggcagtgcacaagaaagcaccccagcaggccaagcggctgccgcccccaaccatctccctgcgttccaaatctatgacctcagagctggaggagatggtctccccctggaagaagaagagtgagtacgagcagcagccggcgccggtgcccagcatggagaaaaagcggaccgtgtatcagatggctctcaacaaactggacgaaatcctggccgcagctcaacagaccatcagtgcaagcgaaagccctggtcccggtggcctcgcgtccctgggcaaacaccgacccaaaggtttctttgccactgagtcgagcttcgatccccaccaccgtgcccagccaagttacgagcgtccttctttcctgcctccaggacctgggttgatgctccggcaaaaatctatcggtgcggcagaagatgacagaccttacctagcacccccagccatgaaattcagccgcagcctgtctgtgcctggttcggaggacattcccccgccacccaccacgtccccaccggagcctccctacagcacacctccagtcccctcctcctcagggcgcctcaccccctcccctcggggagggcccttcaaccctggctctggtggccccctccccgcctcctcccctgcatcctttgacgggccctcccctcccgacactcgcgtggggagccgcgagaagagcctgtaccacagtgggcccctgcccccggcccaccaccacccgccccaccaccaccaccaccacgccccgccccctcagccccaccaccaccacgcccacccccctcatcctcccgagatggagacaggcggctctcccgacgaccctccaccccgcctggctctggggccccagcccagcctgcgaggctggaggggcggcgggcccagcccgaccccgggggccccgtccccatcgcaccacggcagcgcgggcgggggcggcggctcctcccagggcccggctctacgctatttccagctgcccccgcgggcggccagcgcagccatgtacgtgcccgcccgctcgggccgcggccgcaagggcccgctggtcaagcagaccaaggtggaaggcgagccccagaagggcggcggcctcccgcccgcgccgtcgcccacgtccccggcctccccgcagccgccgcccgccgtggccgcgccctcggagaagaactccatccccatccccaccatcatcatcaaggccccgtccaccagtagcagcggccgcagcagccagggcagcagcaccgaggcggagccccccacccagccggagcccacgggaggcggcggcggcggcggctcctcgcccagccccgccccggccatgtcacccgtgcccccgtccccctcgcccgtgcccacccccgcctcgcccagcggcccggccacgctggacttcacgagccagttcggggccgccctggtgggggcggcccggagggaggggggctggcagaatgaggcgcgccggcgctccacgctgttcctgtccaccgacgcgggggacgaggacggcggggacggcgggctgggcacaggggcggccccgggcccgcggctgcgccactccaaatccatcgacgagggcatgttctccgccgagccctacctccgactggagtctgcgggcagcggcgcgggctacggcggctacggggccggtagccgagcctacgggggtggcgggggcagcagcgccttcaccagcttcctgcccccgcgacccctggtgcacccgctgaccggcaaggccctggatcccgcctccccgctggggctggccctggccgcccgcgagcgagcgctgaaggagtcctcggagggcggcggggccccccagccgcctcccaggcccccatcgccccgctacgaggccccgccgcccaccccgcaccaccactcgccccacgcccaccacgagccagtgctgcgtctctggggggcctccccgccggaccctgcgcgccgggagctggggtacagggccgggctgggcagccaggagaagtcccttcccgccagcccgcccgccgcccggcgttccctgctacaccgcctgccgcccaccgctcccggggtggggcccctcctgctgcagctggggacggagcccccggccccgcaccccggagtaagcaagccctggaggtccgcagcccccgaagaacccgagcggctgccgctgcacgtgcggttccttgaaaactgccagccccgggcccctgtgacgagcggaaggggtcccccctcggaggacgggccgggggtcccgccgcccagcccacgccggtccgtgcccccctccccgacctccccgagggccagcgaagagaacgggctgcccctgctggtcctgccgcctcccgccccctcggtggatgtggaagatggcgaattccttttcgtggaaccgctgcctccgcctctggaattctccaacagcttcgaaaagccagagtcgcccctcacgcctgggcctccccacccgctgcccgacacacctgcccctgccaccccgttaccccctgtgccacccccggctgtggccgcagcccctcccaccctggactccaccgcatccagcctgacatcctatgacagcgaggtggccaccctgacccagggggcctccgccgctcctggggacccccatccaccaggcccgcctgccccagcagcaccggctcccgctgccccacagcctggcccggaccctccgcctggcacggattctggcatcgaggaggtggacagtcggagcagcagtgaccacccactggagaccatcagcagcgcctccacgctgagcagcctatctgccgaaggtggtggcagcgcagggggtgggggcggggctggggccggtgtggccagtgggccggagcttctggacacctatgtggcctacctggacggccaggcctttgggggcagcagtactcccggcccgccataccctcctcagctcatgactccctctaagctccggggccgggcgctaggagccagcggaggcctgcggcctggccccagcgggggactccgagaccctgttacccccaccagccccaccgtctcggtgacaggggctggaaccgatgggctgctggccctgcgtgcttgttcaggaccccccacggcaggcgtggcggggggtccggtggctgtagagccagaagtcccaccggtgcccttgccgacggcctcctctctgccccggaagctgctgccctgggaggagggcccgggcccaccgccaccacctctgcccgggcccttggcccagcctcaggcctcagccttggccacagtaaaagccagcatcatcagtgaactcagctccaagcttcagcagtttgggggctcctcggcagctggcggcgctctgccctgggcccgaggaggcagtgggggaggcggagacagccaccacgggggagccagctatgtccccgagaggacctcctccctgcagcggcagagactctccgacgactcccagtcctcactcctctccaagcctgtcagcagcctgtttcagaactggcccaaaccacctctgccgccactccccaccggaacaggggtctcccctacagccgctgcggccccaggggccacctcaccctcagcctcctcctcctccacgtccacccgccacctccagggcgtggagttcgagatgcggccccctctgctccgccgggcccccagcccctcgctgctgcccgcctcggagcacaaggtcagccctgcgcccaggccctcgtccctgcccatcctgccttccggacccctctacccaggcctctttgacatccgtggctccccaactggaggggcaggaggctcggctgaccccttcgccccagtctttgtgccgccacacccggggatatccggggggctcgggggagccttgtcaggggcctcgcgctccctctcaccgacccgcctgctctcgctgcccccggacaagccgtttggcgctaaacctctggggttctggaccaagttcgacgtggctgattggctggagtggctgggtttggcggagcaccgagcccagttcctggaccacgagatcgatggctcccacctgcccgccttgaccaaggaggactacgtcgatctaggtgtgaccagggtgggccaccgcatgaacatcgaccgggctctcaaattcttcctggagaggtgatggctggcctggacggaccagccc

SEQ ID NO: 180998 - DNA, 668 bp, Homo sapiens
  Payload ID: 15645
  Gene Symbol: SHANK1
  Gene Name: SH3 and multiple ankyrin repeat domains 1
  ENST ID: ENST00000468654
  CDS Start-End: 1-552
cccggcccgccataccctcctcagctcatgactccctctaagctccggggccgggcgctaggagccagcggaggcctgcggcctggccccagcgggggactccgagaccctgttacccccaccagccccaccgtctcggtgacaggggctggaaccgatgggctgctggccctgcgtgcttgttcaggaccccccacggcaggcgtggcggggggtccggtggctgtagagccagaagtcccaccggtgcccttgccgacggcctcctctctgccccggaagctgctgccctgggaggagggcccgggcccaccgccaccacctctgcccgggcccttggcccagcctcaggcctcagccttggccacagtaaaagccagcatcatcagtgaactcagctccaagcttcagcagtttgggggctcctcggcagctggcggcgctctgccctgggcccgaggaggcagtgggggaggcggagacagccaccacgggggagccagctatgtccccgagaggacctcctccctgcagcggcagagtatagaatagtggtgaagagctcagactttggtgccatataaccgggctctgccacttcctgtgtgtccttagactctccgacgactcccagtcctcactcctctccaagcctgtcagcagcctgt

SEQ ID NO: 180999 - DNA, 7271 bp, Homo sapiens
  Payload ID: 15646
  Gene Symbol: SHANK2
  Gene Name: SH3 and multiple ankyrin repeat domains 2
  ENST ID: ENST00000338508
  CDS Start-End: 52-3837
tcctttcctccatgctgcctggatctggcgagctggggtgattaattggctatgatgatgaacgtccccggcggaggagcggccgcggtgatgatgacgggctacaataatggtcgctgtccccggaattctctctacagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaagctcccccgcctccaaagcgggcaccgaccacagccctcaccctgcgctccaagtccatgacctcggagctggaggagctcgtggataaagcctcggtccggaagaagaaggataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgaggtacgatgcgaaggcagaaatcaatagacagcagaatctttctatcaggaataacagaggaagagcggcagtttctggctcctccaatgctgaagttcaccagaagcctgtccatgccggacacctctgaggacatcccccctccaccgcagtctgtgcccccgtccccaccaccaccttccccaaccacttacaactgccccaagtccccaactccaagagtctacgggacgattaagcctgcgttcaatcagaattctgccgccaaggtgtcccccgccaccaggtccgacaccgtggccaccatgatgagggagaaggggatgtacttcaggagagagctggaccgctactccttggactctgaagacctctacagtcggaatgccggcccgcaagccaacttccgcaacaagagaggccagatgccagaaaacccatactcagaggtggggaagatcgccagcaaagccgtctacgtccccgccaagcccgccaggcggaaggggatgctggtgaagcagtccaacgtggaggacagccccgagaagacgtgctccatccctatcccgaccatcatcgtgaaggagccgtccaccagcagcagcggcaagagcagccagggcagcagcatggagatcgacccccaggccccggagccaccgagccagctgcggcctgacgaaagcctgaccgtcagcagcccctttgccgccgccatcgccggagccgtccgcgaccgtgagaagcggctggaagccaggaggaactccccggccttcctctccacagacctgggggatgaggatgtgggcctggggccacccgcccccaggacgcggccctccatgttccccgaggagggggattttgctgacgaggacagcgctgagcagctgtcatcccccatgccgagtgccacgcccagggagcccgaaaaccatttcgtgggtggcgccgaggccagtgctccgggtgaggctgggaggccgctgaattccacgtccaaagcccaggggcccgagagcagcccagcagtgccctccgcgagcagcggcacagccggccccgggaattatgtccacccactcacagggcggctgcttgatcccagctccccgctggccctggcactctccgcaagggaccgagccatgaaggagtctcaacagggacccaaaggggaggcccccaaggccgacctcaacaaacctctttacattgataccaaaatgcggcccagcctggatgccggcttccctacggtcaccaggcagaacacccggggacccctgaggcggcaggagacggagaacaagtacgagaccgacctgggccgagaccggaaaggcgatgacaagaagaacatgctgatcgacatcatggacacgtcccagcagaagtcggctggcctgctgatggtgcacaccgtggacgccactaagctggacaacgccctgcaggaagaggacgagaaggcagaggtggagatgaagccagacagctcgccgtccgaggtgccagaaggtgtttccgaaaccgaaggtgctttacagatctccgctgcccccgagcccaccaccgtgcccggcagaaccatcgtcgcggtgggctccatggaagaggcggtgattttgccattccgcatccctcctccccctctggcatccgtggacttggatgaggattttatttttacagagccattgcctcctcccctggaatttgcaaatagttttgatatccccgatgaccgggcagcttctgtcccggctctctcagacttagtgaagcagaagaaaagcgacacccctcagtccccttcgttgaactccagccaaccaaccaactctgcagacagcaagaagccagccagtctttcaaactgtctgcctgcctcattcctgccaccccctgaaagctttgacgccgtcgccgactctgggatcgaggaggtggacagccggagtagcagcgaccaccacctcgagacgaccagcactatctccaccgtgtctagcatctccaccctgtcttccgaaggtggagagaatgtggacacctgcacagtctatgcagatgggcaagcatttatggttgacaaacccccagtacctcctaagccaaaaatgaagcccatcattcacaaaagcaatgcactttatcaagacgcgctcgtggaagaagatgtagatagctttgttatccccccgcccgctcccccgcccccgccgggcagtgcccagcctgggatggccaaggttctccagccaaggacctccaagttgtggggcgacgtcacagagatcaaaagcccgattctctcaggcccaaaggcaaacgttattagtgaattgaactctatcctacagcaaatgaaccgagagaaattggcaaagccgggggaaggactggattcaccaatgggagccaagtccgccagcctcgctccaagaagcccggagatcatgagcaccatctcaggtacacggagcacgacggtcaccttcactgttcgccccggcacctcccagcccatcaccctgcagagccggccccccgactatgaaagcaggacctcaggaacaagacgtgccccaagccctgtggtctcgccaacagagatgaacaaagagaccctgcccgcccccctgtctgctgccaccgcctctccttctcccgctctctcagatgtctttagccttccaagccagcccccttctggggatctatttggcttgaacccagcgggacgcagtaggtcgccatccccctcgatactgcaacagccaatctcaaataagccttttacaactaaacctgtccacctgtggactaaaccagatgtggccgattggctggaaagtctaaacttgggtgaacataaagaggccttcatggacaatgagatcgatggcagtcacttaccaaacctgcagaaggaggacctcatcgatcttggggtaactcgagtcgggcacagaatgaacatagaaagggctttgaaacagctgctggacagataaggacggctgctctccacctcgcagactgctcttgttataagtagagatgggctcgtgctgaaacatctgaatgccaagcgaagtctgtgagcatcaaccccactccatgggtttgtctcctggtacccaaagaaatactgagttgtgtccacaacatggctgggtcttcagacccctggctcaccatgtgggtgtcttgggcagtttctatcacacatgggacaaggggagggagtttttctaacatggaaaaagattctcagcctgccgcccagcatgcaggtggcctcgctttgccgggtccgagaggctccccgtcaattttgcacgggatcctagctcttgtaggcagacaccagtgcactctagatacctcctgagacctccgtcctctgctttccgggcagctctcaccaccccaggccccggcatgaggcctttcctcagtcctgtggcctctcagaggacacctgatgctcacctgcccctctttctcctgcacttggcttgcagtgagatgctcccagatgcatttgtccagtgccccatcatgggcctgaaaggcagagaaactttttcctacacagattcttttccccatctcctcctgtggtttgcatccatggctctttggccatgaggttcctggcagtgctgggagtttggatgggatcgtgcccagctttgcttagctttctttatttctgcaaatctgttagcataattccaaggtggccaagcagatgtcacatggagttagtcaaagcacaaagtcacgattccacaatggaggggagacctggccaagggagccagccagcgtgcaactgcccaagctccaggtctccaggacaagagcagttgtctgccatgagcacccatccaggatggagaataagggcttctctgcctctcagaattctttttaattgaagatgtcttgagctctgcaaagatcagagcaggtgagcatccactttgacatgaaggacaagaagacgcatggctcatggcgggcacatgcggctgccagtgagacagcgtctcctctgggagctgggcgggcacagcatcctcagttctgtgcccagccaagggtgagcatctctgctgagacagtccttttgctctcggaggccagggaagatggtacttagaggcttttcccctatcgctctgggtgtctaggaatcccaccagcttgtcttaacagtacaacagcttctttgaggacccagtgggtatggagtatagacagaacccagggttgagaacagaaggtgggcggcaggatcagagtgaaagcagaggcgtgaggagaggaaagcagggaggtctcctgggctgccaggtcagcctctctggcaaggctttcttgagccccgcccctttctttccccggagtccctccaccccataacaatacctcgaatttccaaaagaggtcaccagatgcacatgggccgcaaaacacacagtcaggcttccagcacattctcccccatttggaggatactcgaatgtcaggtttttggttttattattatttcagaactagctcagcccatctctaattataaaacatggttttgttttttttttttcctttttttcttgattaggtctggaacagctctagaatgaacacataaaatttagcaatttaaaatctttctttactgcaagtttaaatagttgtacagatagtttataagcacaatattttaagaaaaaaaagtggctggtctactaggcagcctttgtgccacttcagtgctagaaagttaaagaaaaaaaaacttttgtgatttaataatactatttctgtggaataattataaaagtatgacctttttaaatcaaccttatttggatgcatctgaaccagcagagctgtgttatattttctatctttgctagaacttcgtcattgaaggacaatttcttcaaagtggttacaattcataatgcagcagtttctccaaaaacaaaaacaaaacacacaccacacacacgcgcttttccagtcacacacccctgatgttggaaccaagtttttggaccttctgttccaaaaccttttgcaggtcaatctttgtatttgaaatgatccaatccaacttgaagtcaattgaatattaaggcgctttacttccgtgtgctttcagtttttccatcatgagatgaatgagcattactctagataaatttcaagacaggatactacaggtggcctgctgaggctgccccatattttagaaaatgtaaaaatggtggtttggccattaatttgtcttccatttgatgataccgcaaaattccgtgagtccattcctttggcatggcactttccctgggcctacagttggtattacctctgtgctcagtgccaggcaaaacactagctcaaaggagagtcaaggaaaccgctggcagacgataaccagtcgaaactcgtgacttcggtttgttgaactttggcagccagttggtgagggccagatgttattccctttcttaaagatactccaagccacatgccactaaccacaagcaagctggctgcaagactaaagagctgataacatagtttatttttacactgtcttattatagagaagtaatagacctatcagaacctgcactgaccaacaaataaacacatgttgccaagatgaatcggtctctatctctatctgcttattttggtactgaaagcaatagttcctcattcaaatcaccacccactgttctccccctttgggacatgttaggacgaggccctattccatgcccctctttaatggtggaacaaatgttaaactgctcatctaaagatcatgttgatattattccaggttttaagatcaacttttgttacatactgtaatttaaataaactgcatttacatgcctagtttctgtaatattgtgtatacaaaacccaaatctctcaaaatgtaaattatgtatacctgccaagataccttttccagggtgtctgcgcacattttaagttaattcacataatataaaaattactcaatgtgactgttgatttgctgaactttacatatcacaaagtgaattatttgtgatactttagttaataaaatggtaaatttttttctcagttattgaacaagcaagcattatccagttgatctggcaatgactttttgtgtgtgggccacaatattgattttcccattaacaatttttttttgttttttaaatactaatatgtttcacactatagtttgtgtaacaacacgtgttcgcattatctatgttgctgttacttttgtgcttttattctttttagactttataaaaaaaaaaaaaagctcctgtaatttgcactttctcccaatccttaaatctcttgtatggcaaccaaaattactgtaaaaaaataaatatactattgcact

SEQ ID NO: 181000 - DNA, 1373 bp, Homo sapiens
  Payload ID: 15646
  Gene Symbol: SHANK2
  Gene Name: SH3 and multiple ankyrin repeat domains 2
  ENST ID: ENST00000357171
  CDS Start-End: 35-769
gatgaacgtccccggcggaggagcggccgcggtgatgatgacgggctacaataatggtcgctgtccccggaattctctctacagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaagctcccccgcctccaaagcgggcaccgaccacagccctcaccctgcgctccaagtccatgacctcggagctggaggagctcgtgcaagcctcggtccggaagaagaaggataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgagaagcccggagatcatgagcaccatctcaggtacacggagcacgacggtcaccttcactgttcgccccggcacctcccagcccatcaccctgcagagccggccccccgactatgaaagcaggacctcaggaacaagacgtgccccaagccctgtggtctcgccaacagagatgaacaaagagaccctgcccgcccccctgtctgctgccaccgcctctccttctcccgctctctcagatgtctttagccttccaagccagcccccttctggggatctatttggcttgaacccagcgggacgcagtaggtcgccatccccctcgatactgcaacagccaatctcaaataagccttttacaactaaacctgtccacctgtggactaaaccagatgtggccgattggctggaaagtctaaacttgggtgaacataaagaggccttcatggacaatgagatcgatggcagtcacttaccaaacctgcagaaggaggacctcatcgatcttggggtaactcgagtcgggcacagaatgaacatagaaagggctttgaaacagctgctggacagataaggacggctgctctccacctcgcagactgctcttgttataagtagagatgg

SEQ ID NO: 181001 - DNA, 9208 bp, Homo sapiens
  Payload ID: 15646
  Gene Symbol: SHANK2
  Gene Name: SH3 and multiple ankyrin repeat domains 2
  ENST ID: ENST00000409161
  CDS Start-End: 434-4195
ttaaacccccttcaaggaaaagcaaaacaaaactgctgcctcatttctcctctggctgattttcccgggcttccctggaagatgcgtgtggtcgggacaagccggaggagctcattcccgacgccgccgctgctgaggccgccgctgccgccgccgccgttcgggccacttactttctttgccctgggcggcgtcctggccagccccccttgagcctccagctcagccatccctcaggcagccgccccaccatgtatgactccttcctccggctggctccggctctgcctgcccccaccctgcaagtctcattgtgccacgctcgcctatcccggtagccacccccctcttccttcgctcctcctgcaccctcgctgcctcctttcctccatgctgcctggatctggcgagctggggtgattaattggctatgatgatgaacgtccccggcggaggagcggccgcggtgatgatgacgggctacaataatggtcgctgtccccggaattctctctacagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaagctcccccgcctccaaagcgggcaccgaccacagccctcaccctgcgctccaagtccatgacctcggagctggaggagctcgtggataaagataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgaggtacgatgcgaaggcagaaatcaatagacagcagaatctttctatcaggaataacagaggaagagcggcagtttctggctcctccaatgctgaagttcaccagaagcctgtccatgccggacacctctgaggacatcccccctccaccgcagtctgtgcccccgtccccaccaccaccttccccaaccacttacaactgccccaagtccccaactccaagagtctacgggacgattaagcctgcgttcaatcagaattctgccgccaaggtgtcccccgccaccaggtccgacaccgtggccaccatgatgagggagaaggggatgtacttcaggagagagctggaccgctactccttggactctgaagacctctacagtcggaatgccggcccgcaagccaacttccgcaacaagagaggccagatgccagaaaacccatactcagaggtggggaagatcgccagcaaagccgtctacgtccccgccaagcccgccaggcggaaggggatgctggtgaagcagtccaacgtggaggacagccccgagaagacgtgctccatccctatcccgaccatcatcgtgaaggagccgtccaccagcagcagcggcaagagcagccagggcagcagcatggagatcgacccccaggccccggagccaccgagccagctgcggcctgacgaaagcctgaccgtcagcagcccctttgccgccgccatcgccggagccgtccgcgaccgtgagaagcggctggaagccaggaggaactccccggccttcctctccacagacctgggggatgaggatgtgggcctggggccacccgcccccaggacgcggccctccatgttccccgaggagggggattttgctgacgaggacagcgctgagcagctgtcatcccccatgccgagtgccacgcccagggagcccgaaaaccatttcgtgggtggcgccgaggccagtgctccgggtgaggctgggaggccgctgaattccacgtccaaagcccaggggcccgagagcagcccagcagtgccctccgcgagcagcggcacagccggccccgggaattatgtccacccactcacagggcggctgcttgatcccagctccccgctggccctggcactctccgcaagggaccgagccatgaaggagtctcaacagggacccaaaggggaggcccccaaggccgacctcaacaaacctctttacattgataccaaaatgcggcccagcctggatgccggcttccctacggtcaccaggcagaacacccggggacccctgaggcggcaggagacggagaacaagtacgagaccgacctgggccgagaccggaaaggcgatgacaagaagaacatgctgatcgacatcatggacacgtcccagcagaagtcggctggcctgctgatggtgcacaccgtggacgccactaagctggacaacgccctgcaggaagaggacgagaaggcagaggtggagatgaagccagacagctcgccgtccgaggtgccagaaggtgtttccgaaaccgaaggtgctttacagatctccgctgcccccgagcccaccaccgtgcccggcagaaccatcgtcgcggtgggctccatggaagaggcggtgattttgccattccgcatccctcctccccctctggcatccgtggacttggatgaggattttatttttacagagccattgcctcctcccctggaatttgcaaatagttttgatatccccgatgaccgggcagcttctgtcccggctctctcagacttagtgaagcagaagaaaagcgacacccctcagtccccttcgttgaactccagccaaccaaccaactctgcagacagcaagaagccagccagtctttcaaactgtctgcctgcctcattcctgccaccccctgaaagctttgacgccgtcgccgactctgggatcgaggaggtggacagccggagtagcagcgaccaccacctcgagacgaccagcactatctccaccgtgtctagcatctccaccctgtcttccgaaggtggagagaatgtggacacctgcacagtctatgcagatgggcaagcatttatggttgacaaacccccagtacctcctaagccaaaaatgaagcccatcattcacaaaagcaatgcactttatcaagacgcgctcgtggaagaagatgtagatagctttgttatccccccgcccgctcccccgcccccgccgggcagtgcccagcctgggatggccaaggttctccagccaaggacctccaagttgtggggcgacgtcacagagatcaaaagcccgattctctcaggcccaaaggcaaacgttattagtgaattgaactctatcctacagcaaatgaaccgagagaaattggcaaagccgggggaaggactggattcaccaatgggagccaagtccgccagcctcgctccaagaagcccggagatcatgagcaccatctcaggtacacggagcacgacggtcaccttcactgttcgccccggcacctcccagcccatcaccctgcagagccggccccccgactatgaaagcaggacctcaggaacaagacgtgccccaagccctgtggtctcgccaacagagatgaacaaagagaccctgcccgcccccctgtctgctgccaccgcctctccttctcccgctctctcagatgtctttagccttccaagccagcccccttctggggatctatttggcttgaacccagcgggacgcagtaggtcgccatccccctcgatactgcaacagccaatctcaaataagccttttacaactaaacctgtccacctgtggactaaaccagatgtggccgattggctggaaagtctaaacttgggtgaacataaagaggccttcatggacaatgagatcgatggcagtcacttaccaaacctgcagaaggaggacctcatcgatcttggggtaactcgagtcgggcacagaatgaacatagaaagggctttgaaacagctgctggacagataaggacggctgctctccacctcgcagactgctcttgttataagtagagatgggctcgtgctgaaacatctgaatgccaagcgaagtctgtgagcatcaaccccactccatgggtttgtctcctggtacccaaagaaatactgagttgtgtccacaacatggctgggtcttcagacccctggctcaccatgtgggtgtcttgggcagtttctatcacacatgggacaaggggagggagtttttctaacatggaaaaagattctcagcctgccgcccagcatgcaggtggcctcgctttgccgggtccgagaggctccccgtcaattttgcacgggatcctagctcttgtaggcagacaccagtgcactctagatacctcctgagacctccgtcctctgctttccgggcagctctcaccaccccaggccccggcatgaggcctttcctcagtcctgtggcctctcagaggacacctgatgctcacctgcccctctttctcctgcacttggcttgcagtgagatgctcccagatgcatttgtccagtgccccatcatgggcctgaaaggcagagaaactttttcctacacagattcttttccccatctcctcctgtggtttgcatccatggctctttggccatgaggttcctggcagtgctgggagtttggatgggatcgtgcccagctttgcttagctttctttatttctgcaaatctgttagcataattccaaggtggccaagcagatgtcacatggagttagtcaaagcacaaagtcacgattccacaatggaggggagacctggccaagggagccagccagcgtgcaactgcccaagctccaggtctccaggacaagagcagttgtctgccatgagcacccatccaggatggagaataagggcttctctgcctctcagaattctttttaattgaagatgtcttgagctctgcaaagatcagagcaggtgagcatccactttgacatgaaggacaagaagacgcatggctcatggcgggcacatgcggctgccagtgagacagcgtctcctctgggagctgggcgggcacagcatcctcagttctgtgcccagccaagggtgagcatctctgctgagacagtccttttgctctcggaggccagggaagatggtacttagaggcttttcccctatcgctctgggtgtctaggaatcccaccagcttgtcttaacagtacaacagcttctttgaggacccagtgggtatggagtatagacagaacccagggttgagaacagaaggtgggcggcaggatcagagtgaaagcagaggcgtgaggagaggaaagcagggaggtctcctgggctgccaggtcagcctctctggcaaggctttcttgagccccgcccctttctttccccggagtccctccaccccataacaatacctcgaatttccaaaagaggtcaccagatgcacatgggccgcaaaacacacagtcaggcttccagcacattctcccccatttggaggatactcgaatgtcaggtttttggttttattattatttcagaactagctcagcccatctctaattataaaacatggttttgttttttttttttcctttttttcttgattaggtctggaacagctctagaatgaacacataaaatttagcaatttaaaatctttctttactgcaagtttaaatagttgtacagatagtttataagcacaatattttaagaaaaaaaagtggctggtctactaggcagcctttgtgccacttcagtgctagaaagttaaagaaaaaaaaacttttgtgatttaataatactatttctgtggaataattataaaagtatgacctttttaaatcaaccttatttggatgcatctgaaccagcagagctgtgttatattttctatctttgctagaacttcgtcattgaaggacaatttcttcaaagtggttacaattcataatgcagcagtttctccaaaaacaaaaacaaaacacacaccacacacacgcgcttttccagtcacacacccctgatgttggaaccaagtttttggaccttctgttccaaaaccttttgcaggtcaatctttgtatttgaaatgatccaatccaacttgaagtcaattgaatattaaggcgctttacttccgtgtgctttcagtttttccatcatgagatgaatgagcattactctagataaatttcaagacaggatactacaggtggcctgctgaggctgccccatattttagaaaatgtaaaaatggtggtttggccattaatttgtcttccatttgatgataccgcaaaattccgtgagtccattcctttggcatggcactttccctgggcctacagttggtattacctctgtgctcagtgccaggcaaaacactagctcaaaggagagtcaaggaaaccgctggcagacgataaccagtcgaaactcgtgacttcggtttgttgaactttggcagccagttggtgagggccagatgttattccctttcttaaagatactccaagccacatgccactaaccacaagcaagctggctgcaagactaaagagctgataacatagtttatttttacactgtcttattatagagaagtaatagacctatcagaacctgcactgaccaacaaataaacacatgttgccaagatgaatcggtctctatctctatctgcttattttggtactgaaagcaatagttcctcattcaaatcaccacccactgttctccccctttgggacatgttaggacgaggccctattccatgcccctctttaatggtggaacaaatgttaaactgctcatctaaagatcatgttgatattattccaggttttaagatcaacttttgttacatactgtaatttaaataaactgcatttacatgcctagtttctgtaatattgtgtatacaaaacccaaatctctcaaaatgtaaattatgtatacctgccaagataccttttccagggtgtctgcgcacattttaagttaattcacataatataaaaattactcaatgtgactgttgatttgctgaactttacatatcacaaagtgaattatttgtgatactttagttaataaaatggtaaatttttttctcagttattgaacaagcaagcattatccagttgatctggcaatgactttttgtgtgtgggccacaatattgattttcccattaacaatttttttttgttttttaaatactaatatgtttcacactatagtttgtgtaacaacacgtgttcgcattatctatgttgctgttacttttgtgcttttattctttttagactttataaaaaaaaaaaaaagctcctgtaatttgcactttctcccaatccttaaatctcttgtatggcaaccaaaattactgtaaaaaaataaatatactattgcactaaggttgtggttctgattgcaaacaaacagtgaacactgtctgaattaaacaaaaagctgcccgacttgcaatctaatgtagattatctcaggcattgtggccagctctgcctctctaaaactgaccagaaaaatctctctcatcgagtaaacaggctcctgtcactgagctaatctgccttggttccatttccttattctcaatttatcaatggatacgtgcatgttatttcagaattatgcaaaacgtcaaaatctgcttctgtgaccgctgctataggcgtggagctgaggctcggcttttccttttgttctgggtggaagcagcggtgccgcggagggccagccagatccggacccttcccttagggtccagtctccccacaccccagcagggtgtcttctagccataaggccaagggagtggcagaactgggccgcctctctggttgacaagcaaaccacatgctaaggcttggagcaagagagaatttgtgtctattggcaaagaactaagccaggaagacatgggccatccctccgctttagggaagcatattttaaacctaaacgttgaacttcttctttggcctcaccagtgaaaacttgttgtctttagttcctaaagtttcttctactttggcacattccccagttgagcagcagcctctatgcttccacgttcaggaaaaattccagtcctcatatcttttgtagttcaccctcaagctctcccgcttcaccatccaatagtttctcccaaaccttggcacccccctagactttgcttccaatggtttcttccagaccacttttcctagatgaatatattcgtttaccttactaggaaaattattggaagattttttcttttacttgaaattggaggcattttaataactggcgaactggaatgtgtttctgtatttgtagacaaccatgaacccatgcaagtaggtgaacattccacagtggctgggtgaccacagcagctgcatgcagacaggactgcccgtgctttgtggggaatcagagaatttccaaacttgtttctcagacttccgcagatctcatcactttgatttctaatccatgctgtattggtgattttgtttatcgttcctgtaacttgttctacattccacagtctttaccgttttatgttcaaaattacaacaatccctgtccattgattccactctggaactctttgttcatgccaattttgaaattttaatacgagccttcaaataaacacagaaaagaaaaaaaaaaaggaaaaaaaataaagtgtgtgccttgggtgttttgaacctgatctgcataaaaccatattgtattcaaatgctgtatctttcatgaaaggataaatatatcttcaatgtattaatgtagctgataaaatagttatagtgccttgttttctgaactgagaagcccatatcaatgcacaacgtaaagaaaggacggttcgagctatgaaatgttgaggacacctacacgtgattctggagcctttctcatcataagactgtggaaaatacacagtcgtttaagttaaaaataaaaagtaaattga

SEQ ID NO: 181002 - DNA, 2123 bp, Homo sapiens
  Payload ID: 15646
  Gene Symbol: SHANK2
  Gene Name: SH3 and multiple ankyrin repeat domains 2
  Uniprot ID: Q9UPX8
  ENST ID: ENST00000409530
  CDS Start-End: 74-919
ctcctcctgcaccctcgctgcctcctttcctccatgctgcctggatctggcgagctggggtgattaattggctatgatgatgaacgtccccggcggaggagcggccgcggtgatgatgacgggctacaataatggtcgctgtccccggaattctctctacagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaagctcccccgcctccaaagcgggcaccgaccacagccctcaccctgcgctccaagtccatgacctcggagctggaggagctcgtggataaagcctcggtccggaagaagaaggataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgaggtacgatgcgaaggcagaaatcaataggtaagaagtgtggcactcccccacagaagttgcccctgggctttcaaacacagccttaggcccctcaggaattctgagccctgggcctctcacagttgccttggcgtcccaccccagcaaggccctgccagcccacccaccagagggtgggaacctggccttgcccactagggagccattggaacatctgagtggcatgaaactcatcccccctgaaggacacaaaatctagggtggcttctgtcatcttgaagcccagttatctgtgataattccagcagggtaaagcgggagggtgggcggggtggtgcgagccaacccccctcccccaccctgccctgctcagggtgggaagggtaagtgggttccctgcattccccagccaccaccaggcctggagtatgagctcagcagatgtacttccaagggtggttgggtcaggtctcgaaatgaaataatgtactgtgtgttgcagaaaactgccttcctttcttcttaatgtcacaattattcctattgaccctgttgcaggcaaaggtacacttgaccttgagacaaggtcacacttgaccctttgagacagtccctttgtgagataattcagcattgcctttactgtgtcaattctggtagaagctaaggcccttgccctgtgagagttgtggaggcaaccctgggactctggtctgcccagcccaccccaggggcactgtcctgtgtgttctggaaatgcctctgggctgctgtgcaaaagcgcagcgtgcttgtgagtctcaggtggataactgtaggcagtcactaggcagtaagtggccgtggaggtggtgtctgctgtgcttaaagctccccctgcaccagcaaactcagggaaagctgcgtatttgtcttgcggttactggttaataacaactgatttcctcctgtcagacagcagaatctttctatcaggttagtgaaccttacggtttggaatctgtaatctgaatgtaacccagtttactttataaggtgtattcttaaattagtactccttgggaacagaattgccagacagccaactcagagtgactggtcaatggagaacactttgaacgagccatctttgcaatgccaaaatgtcctcccacaaggagtatgttaaatttggaatacccttatcgaatggaagttttcattggaataaattattgtagtttgtcctaggactttttttcatttcaagtaatttattttgctacctctttgaaaacctgcatgctccca

SEQ ID NO: 181003 - DNA, 635 bp, Homo sapiens
  Payload ID: 15646
  Gene Symbol: SHANK2
  Gene Name: SH3 and multiple ankyrin repeat domains 2
  ENST ID: ENST00000458632
  CDS Start-End: 1-635
agacccccctgaccttagccgctcagctggacgactctgtggaggtcatcaaagctctcaaaaatggtggagctcacctggacttccgtgccaaagatgggatgaccgccctacacaaagctgcccgagcgaggaaccaagttgccctgaagacccttttagagcttggtgcatccccagattataaagacagttacggcctcaccccgctgtatcacacagccatcgtcggaggtgatccctactgctgcgagcttctcctgcacgaacacgccactgtgtgctgcaaagatgagaacggctggcacgagatccaccaggcctgcaggtacgggcacgtgcagcacctggagcacctgctgttctacggggcagacatgagtgcccagaatgcctcggggaacacggccttgcacatctgcgccctctacaaccaggacagctgtgcaagagtgcttctgtttcgaggcggaaataaggagttaaaaaactacaacagccagactccatttcagccacagaaagcagctaccagagaccataggtgggtgtcagttcccacacttctgctgctcaggcccccccggacacacgaagccagggccgccctgccatctgcgtcccccagagtgctg

SEQ ID NO: 181004 - DNA, 460 bp, Homo sapiens
  Payload ID: 15646
  Gene Symbol: SHANK2
  Gene Name: SH3 and multiple ankyrin repeat domains 2
  ENST ID: ENST00000426687
  CDS Start-End: 1-460
gtacagaaacccgcgctgaccgcagcaagaagcttttcaggcactacaccgtgggctcctatgacagcttcgacacttccagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaagataaacccgaggagatagtcccggcctccaagcc

SEQ ID NO: 181005 - DNA, 557 bp, Homo sapiens
  Payload ID: 15646
  Gene Symbol: SHANK2
  Gene Name: SH3 and multiple ankyrin repeat domains 2
  ENST ID: ENST00000425049
  CDS Start-End: 1-557
attctataaactgcagggcccaagctgcaggtttcaccttcctgagggtcgccacccgggaggcagaggcaccaggatggacgtgggaactacctccgctcttcctttctcacagtgcccttccgagaggccccggcgtactccaaccgccggcggcggccccccaacacgctggccgccccccgggtcctgctgcgctccaacagtgacaacaacctcaatgccagcgctcccgactgggccgtctgctccacggccacctcgcaccgcagcctgtcaccccagctgctgcagcagatgcccagcaagcccgagggggccgcgaagaccattgggagctacgtgcccgggccccgcagccggtccccatcgctcaacaggctgggcggcgcaggcgaggacggcaagaggccgcagcctctctggcatgtcgggtcgccttttgctcttggtgccaacaaggactcactctcggccttcgagtacccggggcccaagcggaagctctacagtgccgtgcccgggaggctcttcgtcgctgtcaagccataccaacc

SEQ ID NO: 181006 - DNA, 9426 bp, Homo sapiens
  Payload ID: 15646
  Gene Symbol: SHANK2
  Gene Name: SH3 and multiple ankyrin repeat domains 2
  Uniprot ID: Q9UPX8
  ENST ID: ENST00000423696
  CDS Start-End: 1-4413
atgaagtctttgttaaatgccttcaccaagaaggaagtgcccttccgagaggccccggcgtactccaaccgccggcggcggccccccaacacgctggccgccccccgggtcctgctgcgctccaacagtgacaacaacctcaatgccagcgctcccgactgggccgtctgctccacggccacctcgcaccgcagcctgtcaccccagctgctgcagcagatgcccagcaagcccgagggggccgcgaagaccattgggagctacgtgcccgggccccgcagccggtccccatcgctcaacaggctgggcggcgcaggcgaggacggcaagaggccgcagcctctctggcatgtcgggtcgccttttgctcttggtgccaacaaggactcactctcggccttcgagtacccggggcccaagcggaagctctacagtgccgtgcccgggaggctcttcgtcgctgtcaagccataccaaccccaagtggacggcgagatcccccttcaccgcggtgacagggtcaaagttctgagcatcggtgaagggggcttctgggaaggcagcgcccgcggccacatcggatggtttccggcggagtgcgtggaggaggtccagtgtaagcccagggacagccaggcagaaacccgcgctgaccgcagcaagaagcttttcaggcactacaccgtgggctcctatgacagcttcgacacttccagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaagctcccccgcctccaaagcgggcaccgaccacagccctcaccctgcgctccaagtccatgacctcggagctggaggagctcgtggataaagcctcggtccggaagaagaaggataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgaggtacgatgcgaaggcagaaatcaatagacagcagaatctttctatcaggaataacagaggaagagcggcagtttctggctcctccaatgctgaagttcaccagaagcctgtccatgccggacacctctgaggacatcccccctccaccgcagtctgtgcccccgtccccaccaccaccttccccaaccacttacaactgccccaagtccccaactccaagagtctacgggacgattaagcctgcgttcaatcagaattctgccgccaaggtgtcccccgccaccaggtccgacaccgtggccaccatgatgagggagaaggggatgtacttcaggagagagctggaccgctactccttggactctgaagacctctacagtcggaatgccggcccgcaagccaacttccgcaacaagagaggccagatgccagaaaacccatactcagaggtggggaagatcgccagcaaagccgtctacgtccccgccaagcccgccaggcggaaggggatgctggtgaagcagtccaacgtggaggacagccccgagaagacgtgctccatccctatcccgaccatcatcgtgaaggagccgtccaccagcagcagcggcaagagcagccagggcagcagcatggagatcgacccccaggccccggagccaccgagccagctgcggcctgacgaaagcctgaccgtcagcagcccctttgccgccgccatcgccggagccgtccgcgaccgtgagaagcggctggaagccaggaggaactccccggccttcctctccacagacctgggggatgaggatgtgggcctggggccacccgcccccaggacgcggccctccatgttccccgaggagggggattttgctgacgaggacagcgctgagcagctgtcatcccccatgccgagtgccacgcccagggagcccgaaaaccatttcgtgggtggcgccgaggccagtgctccgggtgaggctgggaggccgctgaattccacgtccaaagcccaggggcccgagagcagcccagcagtgccctccgcgagcagcggcacagccggccccgggaattatgtccacccactcacagggcggctgcttgatcccagctccccgctggccctggcactctccgcaagggaccgagccatgaaggagtctcaacagggacccaaaggggaggcccccaaggccgacctcaacaaacctctttacattgataccaaaatgcggcccagcctggatgccggcttccctacggtcaccaggcagaacacccggggacccctgaggcggcaggagacggagaacaagtacgagaccgacctgggccgagaccggaaaggcgatgacaagaagaacatgctgatcgacatcatggacacgtcccagcagaagtcggctggcctgctgatggtgcacaccgtggacgccactaagctggacaacgccctgcaggaagaggacgagaaggcagaggtggagatgaagccagacagctcgccgtccgaggtgccagaaggtgtttccgaaaccgaaggtgctttacagatctccgctgcccccgagcccaccaccgtgcccggcagaaccatcgtcgcggtgggctccatggaagaggcggtgattttgccattccgcatccctcctccccctctggcatccgtggacttggatgaggattttatttttacagagccattgcctcctcccctggaatttgcaaatagttttgatatccccgatgaccgggcagcttctgtcccggctctctcagacttagtgaagcagaagaaaagcgacacccctcagtccccttcgttgaactccagccaaccaaccaactctgcagacagcaagaagccagccagtctttcaaactgtctgcctgcctcattcctgccaccccctgaaagctttgacgccgtcgccgactctgggatcgaggaggtggacagccggagtagcagcgaccaccacctcgagacgaccagcactatctccaccgtgtctagcatctccaccctgtcttccgaaggtggagagaatgtggacacctgcacagtctatgcagatgggcaagcatttatggttgacaaacccccagtacctcctaagccaaaaatgaagcccatcattcacaaaagcaatgcactttatcaagacgcgctcgtggaagaagatgtagatagctttgttatccccccgcccgctcccccgcccccgccgggcagtgcccagcctgggatggccaaggttctccagccaaggacctccaagttgtggggcgacgtcacagagatcaaaagcccgattctctcaggcccaaaggcaaacgttattagtgaattgaactctatcctacagcaaatgaaccgagagaaattggcaaagccgggggaaggactggattcaccaatgggagccaagtccgccagcctcgctccaagaagcccggagatcatgagcaccatctcaggtacacggagcacgacggtcaccttcactgttcgccccggcacctcccagcccatcaccctgcagagccggccccccgactatgaaagcaggacctcaggaacaagacgtgccccaagccctgtggtctcgccaacagagatgaacaaagagaccctgcccgcccccctgtctgctgccaccgcctctccttctcccgctctctcagatgtctttagccttccaagccagcccccttctggggatctatttggcttgaacccagcgggacgcagtaggtcgccatccccctcgatactgcaacagccaatctcaaataagccttttacaactaaacctgtccacctgtggactaaaccagatgtggccgattggctggaaagtctaaacttgggtgaacataaagaggccttcatggacaatgagatcgatggcagtcacttaccaaacctgcagaaggaggacctcatcgatcttggggtaactcgagtcgggcacagaatgaacatagaaagggctttgaaacagctgctggacagataaggacggctgctctccacctcgcagactgctcttgttataagtagagatgggctcgtgctgaaacatctgaatgccaagcgaagtctgtgagcatcaaccccactccatgggtttgtctcctggtacccaaagaaatactgagttgtgtccacaacatggctgggtcttcagacccctggctcaccatgtgggtgtcttgggcagtttctatcacacatgggacaaggggagggagtttttctaacatggaaaaagattctcagcctgccgcccagcatgcaggtggcctcgctttgccgggtccgagaggctccccgtcaattttgcacgggatcctagctcttgtaggcagacaccagtgcactctagatacctcctgagacctccgtcctctgctttccgggcagctctcaccaccccaggccccggcatgaggcctttcctcagtcctgtggcctctcagaggacacctgatgctcacctgcccctctttctcctgcacttggcttgcagtgagatgctcccagatgcatttgtccagtgccccatcatgggcctgaaaggcagagaaactttttcctacacagattcttttccccatctcctcctgtggtttgcatccatggctctttggccatgaggttcctggcagtgctgggagtttggatgggatcgtgcccagctttgcttagctttctttatttctgcaaatctgttagcataattccaaggtggccaagcagatgtcacatggagttagtcaaagcacaaagtcacgattccacaatggaggggagacctggccaagggagccagccagcgtgcaactgcccaagctccaggtctccaggacaagagcagttgtctgccatgagcacccatccaggatggagaataagggcttctctgcctctcagaattctttttaattgaagatgtcttgagctctgcaaagatcagagcaggtgagcatccactttgacatgaaggacaagaagacgcatggctcatggcgggcacatgcggctgccagtgagacagcgtctcctctgggagctgggcgggcacagcatcctcagttctgtgcccagccaagggtgagcatctctgctgagacagtccttttgctctcggaggccagggaagatggtacttagaggcttttcccctatcgctctgggtgtctaggaatcccaccagcttgtcttaacagtacaacagcttctttgaggacccagtgggtatggagtatagacagaacccagggttgagaacagaaggtgggcggcaggatcagagtgaaagcagaggcgtgaggagaggaaagcagggaggtctcctgggctgccaggtcagcctctctggcaaggctttcttgagccccgcccctttctttccccggagtccctccaccccataacaatacctcgaatttccaaaagaggtcaccagatgcacatgggccgcaaaacacacagtcaggcttccagcacattctcccccatttggaggatactcgaatgtcaggtttttggttttattattatttcagaactagctcagcccatctctaattataaaacatggttttgttttttttttttcctttttttcttgattaggtctggaacagctctagaatgaacacataaaatttagcaatttaaaatctttctttactgcaagtttaaatagttgtacagatagtttataagcacaatattttaagaaaaaaaagtggctggtctactaggcagcctttgtgccacttcagtgctagaaagttaaagaaaaaaaaacttttgtgatttaataatactatttctgtggaataattataaaagtatgacctttttaaatcaaccttatttggatgcatctgaaccagcagagctgtgttatattttctatctttgctagaacttcgtcattgaaggacaatttcttcaaagtggttacaattcataatgcagcagtttctccaaaaacaaaaacaaaacacacaccacacacacgcgcttttccagtcacacacccctgatgttggaaccaagtttttggaccttctgttccaaaaccttttgcaggtcaatctttgtatttgaaatgatccaatccaacttgaagtcaattgaatattaaggcgctttacttccgtgtgctttcagtttttccatcatgagatgaatgagcattactctagataaatttcaagacaggatactacaggtggcctgctgaggctgccccatattttagaaaatgtaaaaatggtggtttggccattaatttgtcttccatttgatgataccgcaaaattccgtgagtccattcctttggcatggcactttccctgggcctacagttggtattacctctgtgctcagtgccaggcaaaacactagctcaaaggagagtcaaggaaaccgctggcagacgataaccagtcgaaactcgtgacttcggtttgttgaactttggcagccagttggtgagggccagatgttattccctttcttaaagatactccaagccacatgccactaaccacaagcaagctggctgcaagactaaagagctgataacatagtttatttttacactgtcttattatagagaagtaatagacctatcagaacctgcactgaccaacaaataaacacatgttgccaagatgaatcggtctctatctctatctgcttattttggtactgaaagcaatagttcctcattcaaatcaccacccactgttctccccctttgggacatgttaggacgaggccctattccatgcccctctttaatggtggaacaaatgttaaactgctcatctaaagatcatgttgatattattccaggttttaagatcaacttttgttacatactgtaatttaaataaactgcatttacatgcctagtttctgtaatattgtgtatacaaaacccaaatctctcaaaatgtaaattatgtatacctgccaagataccttttccagggtgtctgcgcacattttaagttaattcacataatataaaaattactcaatgtgactgttgatttgctgaactttacatatcacaaagtgaattatttgtgatactttagttaataaaatggtaaatttttttctcagttattgaacaagcaagcattatccagttgatctggcaatgactttttgtgtgtgggccacaatattgattttcccattaacaatttttttttgttttttaaatactaatatgtttcacactatagtttgtgtaacaacacgtgttcgcattatctatgttgctgttacttttgtgcttttattctttttagactttataaaaaaaaaaaaaagctcctgtaatttgcactttctcccaatccttaaatctcttgtatggcaaccaaaattactgtaaaaaaataaatatactattgcactaaggttgtggttctgattgcaaacaaacagtgaacactgtctgaattaaacaaaaagctgcccgacttgcaatctaatgtagattatctcaggcattgtggccagctctgcctctctaaaactgaccagaaaaatctctctcatcgagtaaacaggctcctgtcactgagctaatctgccttggttccatttccttattctcaatttatcaatggatacgtgcatgttatttcagaattatgcaaaacgtcaaaatctgcttctgtgaccgctgctataggcgtggagctgaggctcggcttttccttttgttctgggtggaagcagcggtgccgcggagggccagccagatccggacccttcccttagggtccagtctccccacaccccagcagggtgtcttctagccataaggccaagggagtggcagaactgggccgcctctctggttgacaagcaaaccacatgctaaggcttggagcaagagagaatttgtgtctattggcaaagaactaagccaggaagacatgggccatccctccgctttagggaagcatattttaaacctaaacgttgaacttcttctttggcctcaccagtgaaaacttgttgtctttagttcctaaagtttcttctactttggcacattccccagttgagcagcagcctctatgcttccacgttcaggaaaaattccagtcctcatatcttttgtagttcaccctcaagctctcccgcttcaccatccaatagtttctcccaaaccttggcacccccctagactttgcttccaatggtttcttccagaccacttttcctagatgaatatattcgtttaccttactaggaaaattattggaagattttttcttttacttgaaattggaggcattttaataactggcgaactggaatgtgtttctgtatttgtagacaaccatgaacccatgcaagtaggtgaacattccacagtggctgggtgaccacagcagctgcatgcagacaggactgcccgtgctttgtggggaatcagagaatttccaaacttgtttctcagacttccgcagatctcatcactttgatttctaatccatgctgtattggtgattttgtttatcgttcctgtaacttgttctacattccacagtctttaccgttttatgttcaaaattacaacaatccctgtccattgattccactctggaactctttgttcatgccaattttgaaattttaatacgagccttcaaataaacacagaaaagaaaaaaaaaaaggaaaaaaaataaagtgtgtgccttgggtgttttgaacctgatctgcataaaaccatattgtattcaaatgctgtatctttcatgaaaggataaatatatcttcaatgtattaatgtagctgataaaatagttatagtgccttgttttctgaactgagaagcccatatcaatgcacaacgtaaagaaaggacggttcgagctatgaaatgttgaggacacctacacgtgattctggagcctttctcatcataagactgtggaaaatacacagtcgtttaagttaaaaataaaaagtaaattga

SEQ ID NO: 181007 - DNA, 939 bp, Homo sapiens
  Payload ID: 15646
  Gene Symbol: SHANK2
  Gene Name: SH3 and multiple ankyrin repeat domains 2
  ENST ID: ENST00000449116
  CDS Start-End: 74-889
ctcctcctgcaccctcgctgcctcctttcctccatgctgcctggatctggcgagctggggtgattaattggctatgatgatgaacgtccccggcggaggagcggccgcggtgatgatgacgggctacaataatggtcgctgtccccggaattctctctacagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaagctcccccgcctccaaagcgggcaccgaccacagccctcaccctgcgctccaagtccatgacctcggagctggaggagctcgataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgaggtacgatgcgaaggcagaaatcaataggtaagaagtgtggcactcccccacagaagttgcccctgggctttcaaacacagccttaggcccctcaggaattctgagccctgggcctctcacagttgccttggcgtcc

SEQ ID NO: 181008 - DNA, 8850 bp, Homo sapiens
  Payload ID: 15646
  Gene Symbol: SHANK2
  Gene Name: SH3 and multiple ankyrin repeat domains 2
  ENST ID: ENST00000449833
  CDS Start-End: 52-3837
tcctttcctccatgctgcctggatctggcgagctggggtgattaattggctatgatgatgaacgtccccggcggaggagcggccgcggtgatgatgacgggctacaataatggtcgctgtccccggaattctctctacagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaagctcccccgcctccaaagcgggcaccgaccacagccctcaccctgcgctccaagtccatgacctcggagctggaggagctcggtttgcaagcctcggtccggaagaagaaggataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgaggtacgatgcgaaggcagaaatcaatagacagcagaatctttctatcaggaataacagaggaagagcggcagtttctggctcctccaatgctgaagttcaccagaagcctgtccatgccggacacctctgaggacatcccccctccaccgcagtctgtgcccccgtccccaccaccaccttccccaaccacttacaactgccccaagtccccaactccaagagtctacgggacgattaagcctgcgttcaatcagaattctgccgccaaggtgtcccccgccaccaggtccgacaccgtggccaccatgatgagggagaaggggatgtacttcaggagagagctggaccgctactccttggactctgaagacctctacagtcggaatgccggcccgcaagccaacttccgcaacaagagaggccagatgccagaaaacccatactcagaggtggggaagatcgccagcaaagccgtctacgtccccgccaagcccgccaggcggaaggggatgctggtgaagcagtccaacgtggaggacagccccgagaagacgtgctccatccctatcccgaccatcatcgtgaaggagccgtccaccagcagcagcggcaagagcagccagggcagcagcatggagatcgacccccaggccccggagccaccgagccagctgcggcctgacgaaagcctgaccgtcagcagcccctttgccgccgccatcgccggagccgtccgcgaccgtgagaagcggctggaagccaggaggaactccccggccttcctctccacagacctgggggatgaggatgtgggcctggggccacccgcccccaggacgcggccctccatgttccccgaggagggggattttgctgacgaggacagcgctgagcagctgtcatcccccatgccgagtgccacgcccagggagcccgaaaaccatttcgtgggtggcgccgaggccagtgctccgggtgaggctgggaggccgctgaattccacgtccaaagcccaggggcccgagagcagcccagcagtgccctccgcgagcagcggcacagccggccccgggaattatgtccacccactcacagggcggctgcttgatcccagctccccgctggccctggcactctccgcaagggaccgagccatgaaggagtctcaacagggacccaaaggggaggcccccaaggccgacctcaacaaacctctttacattgataccaaaatgcggcccagcctggatgccggcttccctacggtcaccaggcagaacacccggggacccctgaggcggcaggagacggagaacaagtacgagaccgacctgggccgagaccggaaaggcgatgacaagaagaacatgctgatcgacatcatggacacgtcccagcagaagtcggctggcctgctgatggtgcacaccgtggacgccactaagctggacaacgccctgcaggaagaggacgagaaggcagaggtggagatgaagccagacagctcgccgtccgaggtgccagaaggtgtttccgaaaccgaaggtgctttacagatctccgctgcccccgagcccaccaccgtgcccggcagaaccatcgtcgcggtgggctccatggaagaggcggtgattttgccattccgcatccctcctccccctctggcatccgtggacttggatgaggattttatttttacagagccattgcctcctcccctggaatttgcaaatagttttgatatccccgatgaccgggcagcttctgtcccggctctctcagacttagtgaagcagaagaaaagcgacacccctcagtccccttcgttgaactccagccaaccaaccaactctgcagacagcaagaagccagccagtctttcaaactgtctgcctgcctcattcctgccaccccctgaaagctttgacgccgtcgccgactctgggatcgaggaggtggacagccggagtagcagcgaccaccacctcgagacgaccagcactatctccaccgtgtctagcatctccaccctgtcttccgaaggtggagagaatgtggacacctgcacagtctatgcagatgggcaagcatttatggttgacaaacccccagtacctcctaagccaaaaatgaagcccatcattcacaaaagcaatgcactttatcaagacgcgctcgtggaagaagatgtagatagctttgttatccccccgcccgctcccccgcccccgccgggcagtgcccagcctgggatggccaaggttctccagccaaggacctccaagttgtggggcgacgtcacagagatcaaaagcccgattctctcaggcccaaaggcaaacgttattagtgaattgaactctatcctacagcaaatgaaccgagagaaattggcaaagccgggggaaggactggattcaccaatgggagccaagtccgccagcctcgctccaagaagcccggagatcatgagcaccatctcaggtacacggagcacgacggtcaccttcactgttcgccccggcacctcccagcccatcaccctgcagagccggccccccgactatgaaagcaggacctcaggaacaagacgtgccccaagccctgtggtctcgccaacagagatgaacaaagagaccctgcccgcccccctgtctgctgccaccgcctctccttctcccgctctctcagatgtctttagccttccaagccagcccccttctggggatctatttggcttgaacccagcgggacgcagtaggtcgccatccccctcgatactgcaacagccaatctcaaataagccttttacaactaaacctgtccacctgtggactaaaccagatgtggccgattggctggaaagtctaaacttgggtgaacataaagaggccttcatggacaatgagatcgatggcagtcacttaccaaacctgcagaaggaggacctcatcgatcttggggtaactcgagtcgggcacagaatgaacatagaaagggctttgaaacagctgctggacagataaggacggctgctctccacctcgcagactgctcttgttataagtagagatgggctcgtgctgaaacatctgaatgccaagcgaagtctgtgagcatcaaccccactccatgggtttgtctcctggtacccaaagaaatactgagttgtgtccacaacatggctgggtcttcagacccctggctcaccatgtgggtgtcttgggcagtttctatcacacatgggacaaggggagggagtttttctaacatggaaaaagattctcagcctgccgcccagcatgcaggtggcctcgctttgccgggtccgagaggctccccgtcaattttgcacgggatcctagctcttgtaggcagacaccagtgcactctagatacctcctgagacctccgtcctctgctttccgggcagctctcaccaccccaggccccggcatgaggcctttcctcagtcctgtggcctctcagaggacacctgatgctcacctgcccctctttctcctgcacttggcttgcagtgagatgctcccagatgcatttgtccagtgccccatcatgggcctgaaaggcagagaaactttttcctacacagattcttttccccatctcctcctgtggtttgcatccatggctctttggccatgaggttcctggcagtgctgggagtttggatgggatcgtgcccagctttgcttagctttctttatttctgcaaatctgttagcataattccaaggtggccaagcagatgtcacatggagttagtcaaagcacaaagtcacgattccacaatggaggggagacctggccaagggagccagccagcgtgcaactgcccaagctccaggtctccaggacaagagcagttgtctgccatgagcacccatccaggatggagaataagggcttctctgcctctcagaattctttttaattgaagatgtcttgagctctgcaaagatcagagcaggtgagcatccactttgacatgaaggacaagaagacgcatggctcatggcgggcacatgcggctgccagtgagacagcgtctcctctgggagctgggcgggcacagcatcctcagttctgtgcccagccaagggtgagcatctctgctgagacagtccttttgctctcggaggccagggaagatggtacttagaggcttttcccctatcgctctgggtgtctaggaatcccaccagcttgtcttaacagtacaacagcttctttgaggacccagtgggtatggagtatagacagaacccagggttgagaacagaaggtgggcggcaggatcagagtgaaagcagaggcgtgaggagaggaaagcagggaggtctcctgggctgccaggtcagcctctctggcaaggctttcttgagccccgcccctttctttccccggagtccctccaccccataacaatacctcgaatttccaaaagaggtcaccagatgcacatgggccgcaaaacacacagtcaggcttccagcacattctcccccatttggaggatactcgaatgtcaggtttttggttttattattatttcagaactagctcagcccatctctaattataaaacatggttttgttttttttttttcctttttttcttgattaggtctggaacagctctagaatgaacacataaaatttagcaatttaaaatctttctttactgcaagtttaaatagttgtacagatagtttataagcacaatattttaagaaaaaaaagtggctggtctactaggcagcctttgtgccacttcagtgctagaaagttaaagaaaaaaaaacttttgtgatttaataatactatttctgtggaataattataaaagtatgacctttttaaatcaaccttatttggatgcatctgaaccagcagagctgtgttatattttctatctttgctagaacttcgtcattgaaggacaatttcttcaaagtggttacaattcataatgcagcagtttctccaaaaacaaaaacaaaacacacaccacacacacgcgcttttccagtcacacacccctgatgttggaaccaagtttttggaccttctgttccaaaaccttttgcaggtcaatctttgtatttgaaatgatccaatccaacttgaagtcaattgaatattaaggcgctttacttccgtgtgctttcagtttttccatcatgagatgaatgagcattactctagataaatttcaagacaggatactacaggtggcctgctgaggctgccccatattttagaaaatgtaaaaatggtggtttggccattaatttgtcttccatttgatgataccgcaaaattccgtgagtccattcctttggcatggcactttccctgggcctacagttggtattacctctgtgctcagtgccaggcaaaacactagctcaaaggagagtcaaggaaaccgctggcagacgataaccagtcgaaactcgtgacttcggtttgttgaactttggcagccagttggtgagggccagatgttattccctttcttaaagatactccaagccacatgccactaaccacaagcaagctggctgcaagactaaagagctgataacatagtttatttttacactgtcttattatagagaagtaatagacctatcagaacctgcactgaccaacaaataaacacatgttgccaagatgaatcggtctctatctctatctgcttattttggtactgaaagcaatagttcctcattcaaatcaccacccactgttctccccctttgggacatgttaggacgaggccctattccatgcccctctttaatggtggaacaaatgttaaactgctcatctaaagatcatgttgatattattccaggttttaagatcaacttttgttacatactgtaatttaaataaactgcatttacatgcctagtttctgtaatattgtgtatacaaaacccaaatctctcaaaatgtaaattatgtatacctgccaagataccttttccagggtgtctgcgcacattttaagttaattcacataatataaaaattactcaatgtgactgttgatttgctgaactttacatatcacaaagtgaattatttgtgatactttagttaataaaatggtaaatttttttctcagttattgaacaagcaagcattatccagttgatctggcaatgactttttgtgtgtgggccacaatattgattttcccattaacaatttttttttgttttttaaatactaatatgtttcacactatagtttgtgtaacaacacgtgttcgcattatctatgttgctgttacttttgtgcttttattctttttagactttataaaaaaaaaaaaaagctcctgtaatttgcactttctcccaatccttaaatctcttgtatggcaaccaaaattactgtaaaaaaataaatatactattgcactaaggttgtggttctgattgcaaacaaacagtgaacactgtctgaattaaacaaaaagctgcccgacttgcaatctaatgtagattatctcaggcattgtggccagctctgcctctctaaaactgaccagaaaaatctctctcatcgagtaaacaggctcctgtcactgagctaatctgccttggttccatttccttattctcaatttatcaatggatacgtgcatgttatttcagaattatgcaaaacgtcaaaatctgcttctgtgaccgctgctataggcgtggagctgaggctcggcttttccttttgttctgggtggaagcagcggtgccgcggagggccagccagatccggacccttcccttagggtccagtctccccacaccccagcagggtgtcttctagccataaggccaagggagtggcagaactgggccgcctctctggttgacaagcaaaccacatgctaaggcttggagcaagagagaatttgtgtctattggcaaagaactaagccaggaagacatgggccatccctccgctttagggaagcatattttaaacctaaacgttgaacttcttctttggcctcaccagtgaaaacttgttgtctttagttcctaaagtttcttctactttggcacattccccagttgagcagcagcctctatgcttccacgttcaggaaaaattccagtcctcatatcttttgtagttcaccctcaagctctcccgcttcaccatccaatagtttctcccaaaccttggcacccccctagactttgcttccaatggtttcttccagaccacttttcctagatgaatatattcgtttaccttactaggaaaattattggaagattttttcttttacttgaaattggaggcattttaataactggcgaactggaatgtgtttctgtatttgtagacaaccatgaacccatgcaagtaggtgaacattccacagtggctgggtgaccacagcagctgcatgcagacaggactgcccgtgctttgtggggaatcagagaatttccaaacttgtttctcagacttccgcagatctcatcactttgatttctaatccatgctgtattggtgattttgtttatcgttcctgtaacttgttctacattccacagtctttaccgttttatgttcaaaattacaacaatccctgtccattgattccactctggaactctttgttcatgccaattttgaaattttaatacgagccttcaaataaacacagaaaagaaaaaaaaaaaggaaaaaaaataaagtgtgtgccttgggtgttttgaacctgatctgcataaaaccatattgtattcaaatgctgtatctttcatgaaaggataaatatatcttcaatgtattaatgtagctgataaaatagttatagtgccttgttttctgaactgagaagcccatatcaatgcacaacgtaaagaaaggacggttcgagctatgaaatgttgaggacacctacacgtgattctggagcctttctcatcataagactgtggaaaatacacagtcgtttaagttaaaaataaaaagtaaattga

SEQ ID NO: 181009 - DNA, 6821 bp, Homo sapiens
  Payload ID: 15646
  Gene Symbol: SHANK2
  Gene Name: SH3 and multiple ankyrin repeat domains 2
  ENST ID: ENST00000424924
  CDS Start-End: 1-3387
ctggtccttaaggtggtcacggtgaccaggaatctggaccccgacgacaccgccaggaagaaagctcccccgcctccaaagcgggcaccgaccacagccctcaccctgcgctccaagtccatgacctcggagctggaggagctcgataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgaggtacgatgcgaaggcagaaatcaatagacagcagaatctttctatcaggaataacagaggaagagcggcagtttctggctcctccaatgctgaagttcaccagaagcctgtccatgccggacacctctgaggacatcccccctccaccgcagtctgtgcccccgtccccaccaccaccttccccaaccacttacaactgccccaagtccccaactccaagagtctacgggacgattaagcctgcgttcaatcagaattctgccgccaaggtgtcccccgccaccaggtccgacaccgtggccaccatgatgagggagaaggggatgtacttcaggagagagctggaccgctactccttggactctgaagacctctacagtcggaatgccggcccgcaagccaacttccgcaacaagagaggccagatgccagaaaacccatactcagaggtggggaagatcgccagcaaagccgtctacgtccccgccaagcccgccaggcggaaggggatgctggtgaagcagtccaacgtggaggacagccccgagaagacgtgctccatccctatcccgaccatcatcgtgaaggagccgtccaccagcagcagcggcaagagcagccagggcagcagcatggagatcgacccccaggccccggagccaccgagccagctgcggcctgacgaaagcctgaccgtcagcagcccctttgccgccgccatcgccggagccgtccgcgaccgtgagaagcggctggaagccaggaggaactccccggccttcctctccacagacctgggggatgaggatgtgggcctggggccacccgcccccaggacgcggccctccatgttccccgaggagggggattttgctgacgaggacagcgctgagcagctgtcatcccccatgccgagtgccacgcccagggagcccgaaaaccatttcgtgggtggcgccgaggccagtgctccgggtgaggctgggaggccgctgaattccacgtccaaagcccaggggcccgagagcagcccagcagtgccctccgcgagcagcggcacagccggccccgggaattatgtccacccactcacagggcggctgcttgatcccagctccccgctggccctggcactctccgcaagggaccgagccatgaaggagtctcaacagggacccaaaggggaggcccccaaggccgacctcaacaaacctctttacattgataccaaaatgcggcccagcctggatgccggcttccctacggtcaccaggcagaacacccggggacccctgaggcggcaggagacggagaacaagtacgagaccgacctgggccgagaccggaaaggcgatgacaagaagaacatgctgatcgacatcatggacacgtcccagcagaagtcggctggcctgctgatggtgcacaccgtggacgccactaagctggacaacgccctgcaggaagaggacgagaaggcagaggtggagatgaagccagacagctcgccgtccgaggtgccagaaggtgtttccgaaaccgaaggtgctttacagatctccgctgcccccgagcccaccaccgtgcccggcagaaccatcgtcgcggtgggctccatggaagaggcggtgattttgccattccgcatccctcctccccctctggcatccgtggacttggatgaggattttatttttacagagccattgcctcctcccctggaatttgcaaatagttttgatatccccgatgaccgggcagcttctgtcccggctctctcagacttagtgaagcagaagaaaagcgacacccctcagtccccttcgttgaactccagccaaccaaccaactctgcagacagcaagaagccagccagtctttcaaactgtctgcctgcctcattcctgccaccccctgaaagctttgacgccgtcgccgactctgggatcgaggaggtggacagccggagtagcagcgaccaccacctcgagacgaccagcactatctccaccgtgtctagcatctccaccctgtcttccgaaggtggagagaatgtggacacctgcacagtctatgcagatgggcaagcatttatggttgacaaacccccagtacctcctaagccaaaaatgaagcccatcattcacaaaagcaatgcactttatcaagacgcgctcgtggaagaagatgtagatagctttgttatccccccgcccgctcccccgcccccgccgggcagtgcccagcctgggatggccaaggttctccagccaaggacctccaagttgtggggcgacgtcacagagatcaaaagcccgattctctcaggcccaaaggcaaacgttattagtgaattgaactctatcctacagcaaatgaaccgagagaaattggcaaagccgggggaaggactggattcaccaatgggagccaagtccgccagcctcgctccaagaagcccggagatcatgagcaccatctcaggtacacggagcacgacggtcaccttcactgttcgccccggcacctcccagcccatcaccctgcagagccggccccccgactatgaaagcaggacctcaggaacaagacgtgccccaagccctgtggtctcgccaacagagatgaacaaagagaccctgcccgcccccctgtctgctgccaccgcctctccttctcccgctctctcagatgtctttagccttccaagccagcccccttctggggatctatttggcttgaacccagcgggacgcagtaggtcgccatccccctcgatactgcaacagccaatctcaaataagccttttacaactaaacctgtccacctgtggactaaaccagatgtggccgattggctggaaagtctaaacttgggtgaacataaagaggccttcatggacaatgagatcgatggcagtcacttaccaaacctgcagaaggaggacctcatcgatcttggggtaactcgagtcgggcacagaatgaacatagaaagggctttgaaacagctgctggacagataaggacggctgctctccacctcgcagactgctcttgttataagtagagatgggctcgtgctgaaacatctgaatgccaagcgaagtctgtgagcatcaaccccactccatgggtttgtctcctggtacccaaagaaatactgagttgtgtccacaacatggctgggtcttcagacccctggctcaccatgtgggtgtcttgggcagtttctatcacacatgggacaaggggagggagtttttctaacatggaaaaagattctcagcctgccgcccagcatgcaggtggcctcgctttgccgggtccgagaggctccccgtcaattttgcacgggatcctagctcttgtaggcagacaccagtgcactctagatacctcctgagacctccgtcctctgctttccgggcagctctcaccaccccaggccccggcatgaggcctttcctcagtcctgtggcctctcagaggacacctgatgctcacctgcccctctttctcctgcacttggcttgcagtgagatgctcccagatgcatttgtccagtgccccatcatgggcctgaaaggcagagaaactttttcctacacagattcttttccccatctcctcctgtggtttgcatccatggctctttggccatgaggttcctggcagtgctgggagtttggatgggatcgtgcccagctttgcttagctttctttatttctgcaaatctgttagcataattccaaggtggccaagcagatgtcacatggagttagtcaaagcacaaagtcacgattccacaatggaggggagacctggccaagggagccagccagcgtgcaactgcccaagctccaggtctccaggacaagagcagttgtctgccatgagcacccatccaggatggagaataagggcttctctgcctctcagaattctttttaattgaagatgtcttgagctctgcaaagatcagagcaggtgagcatccactttgacatgaaggacaagaagacgcatggctcatggcgggcacatgcggctgccagtgagacagcgtctcctctgggagctgggcgggcacagcatcctcagttctgtgcccagccaagggtgagcatctctgctgagacagtccttttgctctcggaggccagggaagatggtacttagaggcttttcccctatcgctctgggtgtctaggaatcccaccagcttgtcttaacagtacaacagcttctttgaggacccagtgggtatggagtatagacagaacccagggttgagaacagaaggtgggcggcaggatcagagtgaaagcagaggcgtgaggagaggaaagcagggaggtctcctgggctgccaggtcagcctctctggcaaggctttcttgagccccgcccctttctttccccggagtccctccaccccataacaatacctcgaatttccaaaagaggtcaccagatgcacatgggccgcaaaacacacagtcaggcttccagcacattctcccccatttggaggatactcgaatgtcaggtttttggttttattattatttcagaactagctcagcccatctctaattataaaacatggttttgttttttttttttcctttttttcttgattaggtctggaacagctctagaatgaacacataaaatttagcaatttaaaatctttctttactgcaagtttaaatagttgtacagatagtttataagcacaatattttaagaaaaaaaagtggctggtctactaggcagcctttgtgccacttcagtgctagaaagttaaagaaaaaaaaacttttgtgatttaataatactatttctgtggaataattataaaagtatgacctttttaaatcaaccttatttggatgcatctgaaccagcagagctgtgttatattttctatctttgctagaacttcgtcattgaaggacaatttcttcaaagtggttacaattcataatgcagcagtttctccaaaaacaaaaacaaaacacacaccacacacacgcgcttttccagtcacacacccctgatgttggaaccaagtttttggaccttctgttccaaaaccttttgcaggtcaatctttgtatttgaaatgatccaatccaacttgaagtcaattgaatattaaggcgctttacttccgtgtgctttcagtttttccatcatgagatgaatgagcattactctagataaatttcaagacaggatactacaggtggcctgctgaggctgccccatattttagaaaatgtaaaaatggtggtttggccattaatttgtcttccatttgatgataccgcaaaattccgtgagtccattcctttggcatggcactttccctgggcctacagttggtattacctctgtgctcagtgccaggcaaaacactagctcaaaggagagtcaaggaaaccgctggcagacgataaccagtcgaaactcgtgacttcggtttgttgaactttggcagccagttggtgagggccagatgttattccctttcttaaagatactccaagccacatgccactaaccacaagcaagctggctgcaagactaaagagctgataacatagtttatttttacactgtcttattatagagaagtaatagacctatcagaacctgcactgaccaacaaataaacacatgttgccaagatgaatcggtctctatctctatctgcttattttggtactgaaagcaatagttcctcattcaaatcaccacccactgttctccccctttgggacatgttaggacgaggccctattccatgcccctctttaatggtggaacaaatgttaaactgctcatctaaagatcatgttgatattattccaggttttaagatcaacttttgttacatactgtaatttaaataaactgcatttacatgcctagtttctgtaatattgtgtatacaaaacccaaatctctcaaaatgtaaattatgtatacctgccaagataccttttccagggtgtctgcgcacattttaagttaattcacataatataaaaattactcaatgtgactgttgatttgctgaactttacatatcacaaagtgaattatttgtgatactttagttaataaaatggtaaatttttttctcagttattgaacaagcaagcattatccagttgatctggcaatgactttttgtgtgtgggccacaatattgattttcccattaacaatttttttttgttttttaaatactaatatgtttcacactatagtttgtgtaacaacacgtgttcgcattatctatgttgctgttacttttgtgcttttattctttttagactttataaaaaaaaaaaaaagctcctgtaatttgcactttctcccaatccttaaatctcttgtatggcaaccaaaattactgtaaaaaaataaatatactattgcact

SEQ ID NO: 181010 - DNA, 1376 bp, Homo sapiens
  Payload ID: 15646
  Gene Symbol: SHANK2
  Gene Name: SH3 and multiple ankyrin repeat domains 2
  ENST ID: ENST00000412252
  CDS Start-End: 1-772
gatgaacgtccccggcggaggagcggccgcggtgatgatgacgggctacaataatggtcgctgtccccggaattctctctacagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaagctcccccgcctccaaagcgggcaccgaccacagccctcaccctgcgctccaagtccatgacctcggagctggaggagctcgtggataaagcctcggtccggaagaagaaggataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgagaagcccggagatcatgagcaccatctcaggtacacggagcacgacggtcaccttcactgttcgccccggcacctcccagcccatcaccctgcagagccggccccccgactatgaaagcaggacctcaggaacaagacgtgccccaagccctgtggtctcgccaacagagatgaacaaagagaccctgcccgcccccctgtctgctgccaccgcctctccttctcccgctctctcagatgtctttagccttccaagccagcccccttctggggatctatttggcttgaacccagcgggacgcagtaggtcgccatccccctcgatactgcaacagccaatctcaaataagccttttacaactaaacctgtccacctgtggactaaaccagatgtggccgattggctggaaagtctaaacttgggtgaacataaagaggccttcatggacaatgagatcgatggcagtcacttaccaaacctgcagaaggaggacctcatcgatcttggggtaactcgagtcgggcacagaatgaacatagaaagggctttgaaacagctgctggacagataaggacggctgctctccacctcgcagactgctcttgttataagtagagatgg

SEQ ID NO: 181011 - DNA, 9062 bp, Homo sapiens
  Payload ID: 15646
  Gene Symbol: SHANK2
  Gene Name: SH3 and multiple ankyrin repeat domains 2
  Uniprot ID: Q9UPX8
  ENST ID: ENST00000601538
  CDS Start-End: 79-5628
ctctagaatacagacagttcctgctctaagaggccatctgtgaggctcagtctcccaacacctctgacacaggcagccatgccgcgcagcccaacatccagcgaggacgagatggcccagagcttctccgactactccgtggggtcggagtcagacagctccaaagaagagaccatctatgacacgatccgggccactgcggagaagccgggcggtgccaggacggaggagagccagggcaacacgctggtgatccgcgtggtcatccatgacctgcagcagacgaaatgcattcgatttaacccggatgccacagtgtgggttgcaaagcagcggatcctgtgtacattaacccagagtttgaaagatgtcctgaactacggcctgttccagccggccagcaatgggcgtgacggcaagttcctggatgaggagcggctcctgcgcgagtacccacagcccgtgggtgagggcgttccttccctggagtttcgatacaagaagcgggtgtataaacaagccagtctcgatgagaaacagttggccaagctccacacgaagaccaatctgaagaaatgcatggatcacattcagcatcgcttggtggagaagatcaccaagatgctggaccgaggcctggatcccaatttccacgacccggagaccggagagacccccctgaccttagccgctcagctggacgactctgtggaggtcatcaaagctctcaaaaatggtggagctcacctggacttccgtgccaaagatgggatgaccgccctacacaaagctgcccgagcgaggaaccaagttgccctgaagacccttttagagcttggtgcatccccagattataaagacagttacggcctcaccccgctgtatcacacagccatcgtcggaggtgatccctactgctgcgagcttctcctgcacgaacacgccactgtgtgctgcaaagatgagaacggctggcacgagatccaccaggcctgcaggtacgggcacgtgcagcacctggagcacctgctgttctacggggcagacatgagtgcccagaatgcctcggggaacacggccttgcacatctgcgccctctacaaccaggacagctgtgcaagagtgcttctgtttcgaggcggaaataaggagttaaaaaactacaacagccagactccatttcaggtggccataatagcaggcaactttgagctggcagaatacatcaagaaccacaaggaaacagacattgtgcccttccgagaggccccggcgtactccaaccgccggcggcggccccccaacacgctggccgccccccgggtcctgctgcgctccaacagtgacaacaacctcaatgccagcgctcccgactgggccgtctgctccacggccacctcgcaccgcagcctgtcaccccagctgctgcagcagatgcccagcaagcccgagggggccgcgaagaccattgggagctacgtgcccgggccccgcagccggtccccatcgctcaacaggctgggcggcgcaggcgaggacggcaagaggccgcagcctctctggcatgtcgggtcgccttttgctcttggtgccaacaaggactcactctcggccttcgagtacccggggcccaagcggaagctctacagtgccgtgcccgggaggctcttcgtcgctgtcaagccataccaaccccaagtggacggcgagatcccccttcaccgcggtgacagggtcaaagttctgagcatcggtgaagggggcttctgggaaggcagcgcccgcggccacatcggatggtttccggcggagtgcgtggaggaggtccagtgtaagcccagggacagccaggcagaaacccgcgctgaccgcagcaagaagcttttcaggcactacaccgtgggctcctatgacagcttcgacacttccagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaagctcccccgcctccaaagcgggcaccgaccacagccctcaccctgcgctccaagtccatgacctcggagctggaggagctcgtggataaagcctcggtccggaagaagaaggataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgaggtacgatgcgaaggcagaaatcaatagacagcagaatctttctatcaggaataacagaggaagagcggcagtttctggctcctccaatgctgaagttcaccagaagcctgtccatgccggacacctctgaggacatcccccctccaccgcagtctgtgcccccgtccccaccaccaccttccccaaccacttacaactgccccaagtccccaactccaagagtctacgggacgattaagcctgcgttcaatcagaattctgccgccaaggtgtcccccgccaccaggtccgacaccgtggccaccatgatgagggagaaggggatgtacttcaggagagagctggaccgctactccttggactctgaagacctctacagtcggaatgccggcccgcaagccaacttccgcaacaagagaggccagatgccagaaaacccatactcagaggtggggaagatcgccagcaaagccgtctacgtccccgccaagcccgccaggcggaaggggatgctggtgaagcagtccaacgtggaggacagccccgagaagacgtgctccatccctatcccgaccatcatcgtgaaggagccgtccaccagcagcagcggcaagagcagccagggcagcagcatggagatcgacccccaggccccggagccaccgagccagctgcggcctgacgaaagcctgaccgtcagcagcccctttgccgccgccatcgccggagccgtccgcgaccgtgagaagcggctggaagccaggaggaactccccggccttcctctccacagacctgggggatgaggatgtgggcctggggccacccgcccccaggacgcggccctccatgttccccgaggagggggattttgctgacgaggacagcgctgagcagctgtcatcccccatgccgagtgccacgcccagggagcccgaaaaccatttcgtgggtggcgccgaggccagtgctccgggtgaggctgggaggccgctgaattccacgtccaaagcccaggggcccgagagcagcccagcagtgccctccgcgagcagcggcacagccggccccgggaattatgtccacccactcacagggcggctgcttgatcccagctccccgctggccctggcactctccgcaagggaccgagccatgaaggagtctcaacagggacccaaaggggaggcccccaaggccgacctcaacaaacctctttacattgataccaaaatgcggcccagcctggatgccggcttccctacggtcaccaggcagaacacccggggacccctgaggcggcaggagacggagaacaagtacgagaccgacctgggccgagaccggaaaggcgatgacaagaagaacatgctgatcgacatcatggacacgtcccagcagaagtcggctggcctgctgatggtgcacaccgtggacgccactaagctggacaacgccctgcaggaagaggacgagaaggcagaggtggagatgaagccagacagctcgccgtccgaggtgccagaaggtgtttccgaaaccgaaggtgctttacagatctccgctgcccccgagcccaccaccgtgcccggcagaaccatcgtcgcggtgggctccatggaagaggcggtgattttgccattccgcatccctcctccccctctggcatccgtggacttggatgaggattttatttttacagagccattgcctcctcccctggaatttgcaaatagttttgatatccccgatgaccgggcagcttctgtcccggctctctcagacttagtgaagcagaagaaaagcgacacccctcagtccccttcgttgaactccagccaaccaaccaactctgcagacagcaagaagccagccagtctttcaaactgtctgcctgcctcattcctgccaccccctgaaagctttgacgccgtcgccgactctgggatcgaggaggtggacagccggagtagcagcgaccaccacctcgagacgaccagcactatctccaccgtgtctagcatctccaccctgtcttccgaaggtggagagaatgtggacacctgcacagtctatgcagatgggcaagcatttatggttgacaaacccccagtacctcctaagccaaaaatgaagcccatcattcacaaaagcaatgcactttatcaagacgcgctcgtggaagaagatgtagatagctttgttatccccccgcccgctcccccgcccccgccgggcagtgcccagcctgggatggccaaggttctccagccaaggacctccaagttgtggggcgacgtcacagagatcaaaagcccgattctctcaggcccaaaggcaaacgttattagtgaattgaactctatcctacagcaaatgaaccgagagaaattggcaaagccgggggaaggactggattcaccaatgggagccaagtccgccagcctcgctccaagaagcccggagatcatgagcaccatctcaggtacacggagcacgacggtcaccttcactgttcgccccggcacctcccagcccatcaccctgcagagccggccccccgactatgaaagcaggacctcaggaacaagacgtgccccaagccctgtggtctcgccaacagagatgaacaaagagaccctgcccgcccccctgtctgctgccaccgcctctccttctcccgctctctcagatgtctttagccttccaagccagcccccttctggggatctatttggcttgaacccagcgggacgcagtaggtcgccatccccctcgatactgcaacagccaatctcaaataagccttttacaactaaacctgtccacctgtggactaaaccagatgtggccgattggctggaaagtctaaacttgggtgaacataaagaggccttcatggacaatgagatcgatggcagtcacttaccaaacctgcagaaggaggacctcatcgatcttggggtaactcgagtcgggcacagaatgaacatagaaagggctttgaaacagctgctggacagataaggacggctgctctccacctcgcagactgctcttgttataagtagagatgggctcgtgctgaaacatctgaatgccaagcgaagtctgtgagcatcaaccccactccatgggtttgtctcctggtacccaaagaaatactgagttgtgtccacaacatggctgggtcttcagacccctggctcaccatgtgggtgtcttgggcagtttctatcacacatgggacaaggggagggagtttttctaacatggaaaaagattctcagcctgccgcccagcatgcaggtggcctcgctttgccgggtccgagaggctccccgtcaattttgcacgggatcctagctcttgtaggcagacaccagtgcactctagatacctcctgagacctccgtcctctgctttccgggcagctctcaccaccccaggccccggcatgaggcctttcctcagtcctgtggcctctcagaggacacctgatgctcacctgcccctctttctcctgcacttggcttgcagtgagatgctcccagatgcatttgtccagtgccccatcatgggcctgaaaggcagagaaactttttcctacacagattcttttccccatctcctcctgtggtttgcatccatggctctttggccatgaggttcctggcagtgctgggagtttggatgggatcgtgcccagctttgcttagctttctttatttctgcaaatctgttagcataattccaaggtggccaagcagatgtcacatggagttagtcaaagcacaaagtcacgattccacaatggaggggagacctggccaagggagccagccagcgtgcaactgcccaagctccaggtctccaggacaagagcagttgtctgccatgagcacccatccaggatggagaataagggcttctctgcctctcagaattctttttaattgaagatgtcttgagctctgcaaagatcagagcaggtgagcatccactttgacatgaaggacaagaagacgcatggctcatggcgggcacatgcggctgccagtgagacagcgtctcctctgggagctgggcgggcacagcatcctcagttctgtgcccagccaagggtgagcatctctgctgagacagtccttttgctctcggaggccagggaagatggtacttagaggcttttcccctatcgctctgggtgtctaggaatcccaccagcttgtcttaacagtacaacagcttctttgaggacccagtgggtatggagtatagacagaacccagggttgagaacagaaggtgggcggcaggatcagagtgaaagcagaggcgtgaggagaggaaagcagggaggtctcctgggctgccaggtcagcctctctggcaaggctttcttgagccccgcccctttctttccccggagtccctccaccccataacaatacctcgaatttccaaaagaggtcaccagatgcacatgggccgcaaaacacacagtcaggcttccagcacattctcccccatttggaggatactcgaatgtcaggtttttggttttattattatttcagaactagctcagcccatctctaattataaaacatggttttgttttttttttttcctttttttcttgattaggtctggaacagctctagaatgaacacataaaatttagcaatttaaaatctttctttactgcaagtttaaatagttgtacagatagtttataagcacaatattttaagaaaaaaaagtggctggtctactaggcagcctttgtgccacttcagtgctagaaagttaaagaaaaaaaaacttttgtgatttaataatactatttctgtggaataattataaaagtatgacctttttaaatcaaccttatttggatgcatctgaaccagcagagctgtgttatattttctatctttgctagaacttcgtcattgaaggacaatttcttcaaagtggttacaattcataatgcagcagtttctccaaaaacaaaaacaaaacacacaccacacacacgcgcttttccagtcacacacccctgatgttggaaccaagtttttggaccttctgttccaaaaccttttgcaggtcaatctttgtatttgaaatgatccaatccaacttgaagtcaattgaatattaaggcgctttacttccgtgtgctttcagtttttccatcatgagatgaatgagcattactctagataaatttcaagacaggatactacaggtggcctgctgaggctgccccatattttagaaaatgtaaaaatggtggtttggccattaatttgtcttccatttgatgataccgcaaaattccgtgagtccattcctttggcatggcactttccctgggcctacagttggtattacctctgtgctcagtgccaggcaaaacactagctcaaaggagagtcaaggaaaccgctggcagacgataaccagtcgaaactcgtgacttcggtttgttgaactttggcagccagttggtgagggccagatgttattccctttcttaaagatactccaagccacatgccactaaccacaagcaagctggctgcaagactaaagagctgataacatagtttatttttacactgtcttattatagagaagtaatagacctatcagaacctgcactgaccaacaaataaacacatgttgccaagatgaatcggtctctatctctatctgcttattttggtactgaaagcaatagttcctcattcaaatcaccacccactgttctccccctttgggacatgttaggacgaggccctattccatgcccctctttaatggtggaacaaatgttaaactgctcatctaaagatcatgttgatattattccaggttttaagatcaacttttgttacatactgtaatttaaataaactgcatttacatgcctagtttctgtaatattgtgtatacaaaacccaaatctctcaaaatgtaaattatgtatacctgccaagataccttttccagggtgtctgcgcacattttaagttaattcacataatataaaaattactcaatgtgactgttgatttgctgaactttacatatcacaaagtgaattatttgtgatactttagttaataaaatggtaaatttttttctcagttattgaacaagcaagcattatccagttgatctggcaatgactttttgtgtgtgggccacaatattgattttcccattaacaatttttttttgttttttaaatactaatatgtttcacactatagtttgtgtaacaacacgtgttcgcattatctatgttgctgttacttttgtgcttttattctttttagactttataaaaaaaaaaaaaagctcctgtaatttgcactttctcccaatccttaaatctcttgtatggcaaccaaaattactgtaaaaaaataaatatactattgcact

SEQ ID NO: 181012 - DNA, 1879 bp, Homo sapiens
  Payload ID: 15646
  Gene Symbol: SHANK2
  Gene Name: SH3 and multiple ankyrin repeat domains 2
  ENST ID: ENST00000608988
  CDS Start-End: 371-751
cttccccaccccctgcacctgagccgcggcggcggctcctgagctccggcggggctgggcgcggcgccgctcgggttcccgcggccgatccaggtgtgcgcggacgctggcgctcccggggggctcggacccgcccccgactcgccgagccaggatatttttgttggtataaaattatggattgagaatacttttctttcatcacttgaaaattactgtgccactttcttttggtctccacagtttctgatgagaaatgtctggaaatctctccaggcaccctgctttggccctctagaatacagacagttcctgctctaagaggccatctgtgaggctcagtctcccaacacctctgacacaggcagccatgccgcgcagcccaacatccagcgaggacgagatggcccagagcttctccgactactccgtggggtcggagtcagacagctccaaagaagagaccatctatgacacgatccgggccactgcggagaagccgggcggtgccaggacggaggagagccagggcaacacgctggtgatccgcgtggtcatccatgacctgcagcagacgaaatgcattcgatttaacccggatgccacagtgtgggttgcaaagcagcggatcctgtgtacattaacccagagtttgaaagatgtcctgaactacggcctgttccagccggccagcaatgggcgtgacgggcgttccttccctggagtttcgatacaagaagcgggtgtataaacaagccagtctcgatgagaaacagttggccaagctccacacgaagaccaatctgaagaaatgcatggatcacattcagcatcgcttggtggagaagatcaccaagatgctggaccgaggcctggatcccaatttccacgacccggagaccggagagacccccctgaccttagccgctcagctggacgactctgtggaggtcatcaaagctctcaaaaatggtggagctcacctggacttccgtgccaaagatgggatgaccgccctacacaaagctgcccgagcgaggaaccaagttgccctgaagacccttttagagcttggtgcatccccagattataaagacagttacggcctcaccccgctgtatcacacagccatcgtcggaggtgatccctactgctgcgagcttctcctgcacgaacacgccactgtgtgctgcaaagatgagaacggctggcacgagatccaccaggcctgcaggtacgggcacgtgcagcacctggagcacctgctgttctacggggcagacatgagtgcccagaatgcctcggggaacacggccttgcacatctgcgccctctacaaccaggacagctgtgcaagagtgcttctgtttcgaggcggaaataaggagttaaaaaactacaacagccagactccatttcagatggactctcactctgttgcgcagagtgcaatggcacgatcccggctcactgcaacctccacttcccgggttcaagcgattctcctgcctcagcctcccaagtagctgggattacaggttcgtgccaccatgcctggctagtttttgtatttttggtggagatgggttttgctatgttggccagactggtctcgaactcttgaccttaagtgatctgcctgcctctacctccgaaattgttgggattacaggcatgagccttcatgtctgacccagtctattaagttttatcatgaatctatgttgtcatatccgatgtgtcttgataaaatatttatccaaaatccgatcctgcaactgtcaaagatgattatgtagatttcccctgcttatctgctaatgcgatgaattatatttgtcaattttcttatttctaaaataaactcacctagccatga

SEQ ID NO: 181013 - DNA, 434 bp, Homo sapiens
  Payload ID: 15646
  Gene Symbol: SHANK2
  Gene Name: SH3 and multiple ankyrin repeat domains 2
  ENST ID: ENST00000618363
  CDS Start-End: 1-326
acgaacacgccactgtgtgctgcaaagatgagaacggctggcacgagatccaccaggcctgcaggtacgggcacgtgcagcacctggagcacctgctgttctacggggcagacatgagtgcccagaatgcctcggggaacacggccttgcacatctgcgccctctacaaccaggacagctgtgcaagagtgcttctgtttcgaggcggaaataaggagttaaaaaactacaacagccagactccatttcaggtggccataatagcaggcaactttgagctggcagaatacatcaagaaccacaaggaaacagacattggtgagtaggcacgtggagaaactgtgttgggatttggtttggagatgctctgaggaatcagtcactcaccagctttttaaaattctcctaagattggtttagagcctgcttttagc

SEQ ID NO: 181014 - DNA, 2775 bp, Homo sapiens
  Payload ID: 15646
  Gene Symbol: SHANK2
  Gene Name: SH3 and multiple ankyrin repeat domains 2
  ENST ID: ENST00000468619
  CDS Start-End: 1-223
agccgggtttgagagcagcccgtctacgtgcagttggttcccagctgacagacagaatatggggtgggctttgtcaccagcacgctgggtctggcatgcccagctatgctcggaagtgcaccgtgcccagacacccgccacctctccccgggtcccagctgctctagcaccgaggggccgggctgcacgcctgtccttcctcccatccaggaaggttatataatgagcggaccgctgccaaagtcagagggaaaatgaagtctttgttaaatgccttcaccaagaaggaagtgcccttccgagaggccccggcgtactccaaccgccggcggcggccccccaacacgctggccgccccccgggtcctgctgcgctccaacagtgacaacaacctcaatgccagcgctcccgactgggccgtctgctccacggccacctcgcaccgcagcctgtcaccccagctgctgcagcagatgcccagcaagcccgagggggccgcgaagaccattgggagctacgtgcccgggccccgcagccggtccccatcgctcaacaggctgggcggcgcaggcgaggacggcaagaggccgcagcctctctggcatgtcgggtcgccttttgctcttggtgccaacaaggactcactctcggccttcgagtacccggggcccaagcggaagctctacagtgccgtgcccgggaggctcttcgtcgctgtcaagccataccaaccccaagtggacggcgagatcccccttcaccgcggtgacagggtcaaagttctgagcatcggtgaagggggcttctgggaaggcagcgcccgcggccacatcggatggtttccggcggagtgcgtggaggaggtccagtgtaagcccagggacagccaggcagaaacccgcgctgaccgcagcaagaagcttttcaggcactacaccgtgggctcctatgacagcttcgacacttccaggttgcagacacatttgggggtccctgcaaccctcggagacagctggagtctggacctgtagggcctggttgtggaaacagccccgctgcctcctgcccggtggctctggaggccccttccgcacatccagggcgggtcggctgctccagttctgccttcccacccagtgctgggatgtgcaacgccccccaccgaatgctcagatgtgcagccccctcctctgctggcctggaccttggacctcacacgtgcacatgttctgacatcagtgcctcatccgatgtccaaccccggccagaggaaccaccgtcgcttcagccccactctgaccttggaagccccaccctgcatggaggcagaggtgggaactctgtcatccaccgttccccacagaccactcacagccgctttaagagaacagccagggcttctaggcaggagcacgacagtgttcacgctgatggccagggagcctcctcagccagcagcagccgactcgtgcttgtgcattgttcagatggaagcatgatcattggatggaagttcctggcacaggtgcaagttgaccctgagtcattccagaaggattcgggcctcaccggaaagaacgccaggaaaagccatagggcaacagctcttctgccatttcagtcctcatgggtgaaactggggtaaagcgtgagtggctggggccctgctgacacctgcacttgtgcgtcaccgccaagctgtgtccctagactgccctgggtgagtaggcagccaacgtctgcagccccgtgtggtcagctgctcctgccctcccgcctcatcacggcccttcagacatcagggccggctgcctaccttccaaccccactctgtctggaatgttcttttctcttctgtcccctccccagtcctccaacccattctcctatgtatacttcagtcctcctcctccaggaagtcttccaggtgcccgtatggttctcacagaaccacgtcctgcactgttgaaggcacacatttctgtgactgtggattgatgtttatcttcctcacttgcccggcctttgctctaacgatcaccacagactagggggctcaaaacaagagaagtcacttacctgtcacagccctggaggccagaggtccaaaaccaagatgacagcagggccacgctccctccgggggctccaggggagagtcttcctcctccacctctgctgttggcctgcagtccttggtgctcctcagctgggccacatcactccagcctccacatcactccagcctctgcctccaccttcccatggcctcctctgcactgcctctgggtgtcaacctccctctgcttttctcgcgtaagggcacagtcattggtttaggaccctccctaaatccaggaagatctcaactcaagacccttaactaattatacctgcaaagacccaaattccaagtgtcgtcactttcacagacgctgggggttaggaattggacacatttttttgggtgggttgagtcaccattcaactgaccacaccagacaactctataaggaccagactgggcctggtttgttccttcctaaatgcccagcacccagttcatcccctgactctcagtgggtattcaggatgtaacagctggattgatttattgatttacacggcggcttgacactggccccagttacttctgaactttgaaacccagtcccagctggtcacggaagaactaaagctgtcaccagacggggccaccaacccagctgggatcctgagagctatgagtaaagccatctggtctaccccaataac

SEQ ID NO: 181015 - DNA, 7091 bp, Homo sapiens
  Payload ID: 15647
  Gene Symbol: SHANK3
  Gene Name: SH3 and multiple ankyrin repeat domains 3
  ENST ID: ENST00000262795
  CDS Start-End: 1-5193
atggacggccccggggccagcgccgtggtcgtgcgcgtcggcatcccggacctgcagcagacgaagtgcctgcgcctggacccggccgcgcccgtgtgggccgccaagcagcgcgtgctctgcgccctcaaccacagcctccaggacgcgctcaactatgggcttttccagccgccctcccggggccgcgccggcaagttcctggatgaggagcggctcctgcaggagtacccgcccaacctggacacgcccctgccctacctggagtttcgatacaagcggcgagtttatgcccagaacctcatcgatgataagcagtttgcaaagcttcacacaaaggcgaacctgaagaagttcatggactacgtccagctgcatagcacggacaaggtggcacgcctgttggacaaggggctggaccccaacttccatgaccctgactcaggagagtgccccctgagcctcgcagcccagctggacaacgccacggacctgctaaaggtgctgaagaatggtggtgcccacctggacttccgcactcgcgatgggctcactgccgtgcactgtgccacacgccagcggaatgcggcagcactgacgaccctgctggacctgggggcttcacctgactacaaggacagccgcggcttgacacccctctaccacagcgccctggggggtggggatgccctctgctgtgagctgcttctccacgaccacgctcagctggggatcaccgacgagaatggctggcaggagatccaccaggcctgccgctttgggcacgtgcagcatctggagcacctgctgttctatggggcagacatgggggcccagaacgcctcggggaacacagccctgcacatctgtgccctctacaaccaggagagctgtgctcgtgtcctgctcttccgtggagctaacagggatgtccgcaactacaacagccagacagccttccaggtggccatcatcgcagggaactttgagcttgcagaggttatcaagacccacaaagactcggatgttgtaccattcagggaaacccccagctatgcgaagcggcggcgactggctggccccagtggcttggcatcccctcggcctctgcagcgctcagccagcgatatcaacctgaagggggaggcacagccagcagcttctcctggaccctcgctgagaagcctcccccaccagctgctgctccagcggctgcaagaggagaaagatcgtgaccgggatgccgaccaggagagcaacatcagtggccctttagcaggcagggccggccaaagcaagatcagtccagctggcccaggggatccgggccctggacctggagggcccgcgccccctgcgccccccgcaccgccgccccggggcccgaagcggaaactttacagcgccgtccccggccgcaagttcatcgccgtgaaggcgcacagcccgcagggtgaaggcgagatcccgctgcaccgcggcgaggccgtgaaggtgctcagcattggggagggcggtttctgggagggaaccgtgaaaggccgcacgggctggttcccggccgactgcgtggaggaagtgcagatgaggcagcatgacacacggcctgaaacgcgggaggaccggacgaagcggctctttcggcactacacagtgggctcctacgacagcctcacctcacacagcgattatgtcattgatgacaaagtggctgtcctgcagaaacgggaccacgagggctttggttttgtgctccggggagccaaagcagagacccccatcgaggagttcacgcccacgccagccttcccggcgctgcagtatctcgagtcggtggacgtggagggtgtggcctggagggccgggctgcgcacgggagacttcctcatcgaggtgaacggggtgaacgtggtgaaggtcggacacaagcaggtggtggctctgattcgccagggtggcaaccgcctcgtcatgaaggttgtgtctgtgacaaggaagccagaagaggacggggctcggcgcagagccccaccgccccccaagagggcccccagcaccacactgaccctgcgctccaagtccatgacagctgagctcgaggaacttgcctccattcggagaagaaaaggggagaagctggacgagatgctggcagccgccgcagagccaacgctgcggccagacatcgcagacgcagactccagagccgccaccgtcaaacagaggcccaccagtcggaggatcacacccgccgagattagctcattgtttgaacgccagggcctcccaggcccagagaagctgccgggctccttgcggaaggggattccacggaccaagtctgtaggggaggacgagaagctggcgtccctgctggaagggcgcttcccgcggagcacctcgatgcaagacccggtgcgcgagggtcgcggcatcccgcccccgccgcagaccgcgccgcctcccccgcccgcgccctactacttcgactcggggccgcccccggccttctcgccgccgcccccgccgggccgcgcctacgacacggtgcgctccagcttcaagcccggcctggaggcgcgcctgggcgcgggcgctgccggcctgtacgagccgggcgcggccctcggcccgctgccgtatcccgagcggcagaagcgcgcgcgctccatgatcatcctgcaggactcggcgcccgagtcgggcgacgcccctcgacccccgcccgcggccaccccgcccgagcgacccaagcgccggccgcggccgcccggccccgacagcccctacgccaacctgggcgccttcagcgccagcctcttcgctccgtccaagccgcagcgccgcaagagccccctggtgaagcagctgcaggtggaggacgcgcaggagcgcgcggccctggccgtgggcagccccggtcccggcggcggcagcttcgcccgcgagccctccccgacccaccgcggtccgcgcccgggtggcctcgactacggcgcgggcgatggcccggggctcgcgttcggcggcccgggcccggccaaggaccggcggctggaggagcggcgccgctccactgtgttcctgtccgtgggggccatcgagggcagcgcccccggcgcggatctgccatccctacagccctcccgctccatcgacgagcgcctcctggggaccggccccaccgccggccgcgacctgctgctgccctccccggtgtctgccctgaagccgttggtcagcggcccgagcctggggccctcgggttccaccttcatccacccactcaccggcaaacccctggaccccagctcacccctggcccttgccctggctgcccgagagcgagctctggcctcccaggcgccctcccggtcccccacacccgtgcacagtcccgacgccgaccgccccggacccctgtttgtggatgtacaggcccgggacccagagcgagggtccctggcttccccggctttctccccacggagcccagcctggattcctgtgcctgctcgcagggaggcagagaaggtcccccgggaggagcggaagtcacccgaggacaagaagtccatgatcctcagcgtcctggacacatccctgcagcggccagctggcctcatcgttgtgcacgccaccagcaacgggcaggagcccagcaggctggggggggccgaagaggagcgcccgggcaccccggagttggccccggcccccatgcagtcagcggctgtggcagagcccctgcccagcccccgggcccagccccctggtggcaccccggcagacgccgggccaggccagggcagctcagaggaagagccagagctggtgtttgctgtgaacctgccacctgcccagctgtcgtccagcgatgaggagaccagggaggagctggcccgaattgggttggtgccaccccctgaagagtttgccaacggggtcctgctggccaccccactcgctggcccgggcccctcgcccaccacggtgcccagcccggcctcagggaagcccagcagtgagccaccccctgcccctgagtctgcagccgactctggggtggaggaggctgacacacgcagctccagcgacccccacctggagaccacaagcaccatctccacggtgtccagcatgtccaccttgagctcggagagcggggaactcactgacacccacacctccttcgctgacggacacacttttctactcgagaagccaccagtgcctcccaagcccaagctcaagtccccgctggggaaggggccggtgaccttcagggacccgctgctgaagcagtcctcggacagcgagctcatggcccagcagcaccacgccgcctctgccgggctggcctctgccgccgggcctgcccgccctcgctacctcttccagagaaggtccaagctatggggggaccccgtggagagccgggggctccctgggcctgaagacgacaaaccaactgtgatcagtgagctcagctcccgcctgcagcagctgaacaaggacacgcgttccctgggggaggaaccagttggtggcctgggcagcctgctggaccctgccaagaagtcgcccatcgcagcagctcggctcttcagcagcctcggtgagctgagctccatttcagcgcagcgcagccccgggggcccgggcggcggggcctcgtactcggtgaggcccagtggccgctaccccgtggcgagacgcgccccgagcccggtgaagcccgcgtcgctggagcgggtggaggggctgggggcgggcgcggggggcgcagggcggcccttcggcctcacgccccccaccatcctcaagtcgtccagcctctccatcccgcacgagcccaaggaggtgcgcttcgtggtgcgcagcgtgagcgcgcgcagtcgctccccctcgccgtcgccgctgccctcgcccgcgtccggccccggccccggcgcccccggcccacgccgacccttccagcagaagccgctgcagctctggagcaagttcgacgtgggcgactggctggagagcatccacctaggcgagcaccgcgaccgcttcgaggaccatgagatagaaggcgcgcacctacccgcgcttaccaaggacgacttcgtggagctgggcgtcacgcgcgtgggccaccgcatgaacatcgagcgcgcgctcaggcagctggacggcagctgacgccccacccccactcccgccccggccgtgccctgccggcagggccccccacccccaccccgggccgcgggctcggcctgccccttacgacggcgcccgggccaggaatgttgcatgaatcgtcctgtttgctgttgctcggagactcgccctgtacattgcttagtgccctcaccggccgcccagcccacccagcgcacagtcaggaagggcgtggaccagggaggctggggcgggaggtgccgggggtggggtgccctagcgtgaccacctccttcgcagctcctggtggccattctcccagagggggaacctagtccagcatgcgaggtcaggacccgccttggtgactcggggggaggggggagacattgggattctcgatgggggccaaggagcccccctgttttgcatattttaatccactctatatttggaacgagaaaaggaacaaatatctctgtccgtaatagtttcctctcccctcccttctacttccactggtcccactgcagctgcccagtcttccatctccggcccctcactgccactgccaccccacaacggggcaggggacgctccagctggtctggggttggccagggccctagtggcccgccctggggccccagctcggcccctcgcctcgctgagctctagtgtgccccaccgacccttcaggtgctgctcgtggtgggaggggcggcaggccgcgggtcctgctgtgcacccgcgggaccagccggcctgggagaccatcggccgggggggatgagggcagggccctgccgctccaccgcagccatcttcctcacagggtctctccccaaggagggggctagcttggtccccatgctcttgggcaactacagcagagaagcctccctgccttggaccccaaagtctcctgtcctgccctttatgtgtgtgggtgaaactgggtgcgtctgagcacgtgggagccgtgtgtgtgcctgattactgagtggccaccaggggccgctctggactagcgcggggccgtggaggcgtgcaccgtgtgcatgcgtggggtgtacctgtgagagcaccctgtctcctcttccaaagaaagtcagaggccatcctgcaccctgggtccagctgtttgcccagcctgtccttccagagcctcacccagcctgagcggggttccctggtgaatccctgctgcttggggaggccccaagggccccttggaggcagcgcccccaccttgggcttctgagggcatcatagggggacccctagagtcagttcaccacaggccctggggagagtcaaagacccccgagggtgcccagccccccacactgtgactcctcacactcagcgatgacctgtggggtggggggccctgggacgtttttaaacctagggtttggagtctggactaagctccatccacgtcactcacaagtttctgtttatatttctagctttttttaataaaataaaaaaaaaaagaaaacagaagttttcacaacccaggggcctggcacgccggtctgtgcctgcccgccccgccctggcccaccggccccactccctgggcacagagtcacacccactcatccttccgccaacagtccaggtcacacagcagcagtcactgtaacagactgccacatacacactcggtctcacactcacctgtgggttttggttccgttcaatttgggtttttaactttacagggtcagttccgcttcacctccttttgtatggagttccatccggggggtttcaccccctgctccagtcctgaggcctcctgaccctgacgttgtgatacgccccacagagatctatgtttcttatattattattattgataataattattataatattattatgtaataaatttataagaaatg

SEQ ID NO: 181016 - DNA, 5175 bp, Homo sapiens
  Payload ID: 15647
  Gene Symbol: SHANK3
  Gene Name: SH3 and multiple ankyrin repeat domains 3
  ENST ID: ENST00000445220
  CDS Start-End: 1-5175
atggacggccccggggccagcgccgtggtcgtgcgcgtcggcatcccggacctgcagcagacgaagtgcctgcgcctggacccggccgcgcccgtgtgggccgccaagcagcgcgtgctctgcgccctcaaccacagcctccaggacgcgctcaactatgggcttttccagccgccctcccggggccgcgccggcaagttcctggatgaggagcggctcctgcaggagtacccgcccaacctggacacgcccctgccctacctggagtttcgatacaagcggcgagtttatgcccagaacctcatcgatgataagcagtttgcaaagcttcacacaaaggcgaacctgaagaagttcatggactacgtccagctgcatagcacggacaaggtggcacgcctgttggacaaggggctggaccccaacttccatgaccctgactcaggagagtgccccctgagcctcgcagcccagctggacaacgccacggacctgctaaaggtgctgaagaatggtggtgcccacctggacttccgcactcgcgatgggctcactgccgtgcactgtgccacacgccagcggaatgcggcagcactgacgaccctgctggacctgggggcttcacctgactacaaggacagccgcggcttgacacccctctaccacagcgccctggggggtggggatgccctctgctgtgagctgcttctccacgaccacgctcagctggggatcaccgacgagaatggctggcaggagatccaccaggcctgccgctttgggcacgtgcagcatctggagcacctgctgttctatggggcagacatgggggcccagaacgcctcggggaacacagccctgcacatctgtgccctctacaaccaggagagctgtgctcgtgtcctgctcttccgtggagctaacagggatgtccgcaactacaacagccagacagccttccaggtggccatcatcgcagggaactttgagcttgcagaggttatcaagacccacaaagactcggatgttgtaccattcagggaaacccccagctatgcgaagcggcggcgactggctggccccagtggcttggcatcccctcggcctctgcagcgctcagccagcgatatcaacctgaagggggaggcacagccagcagcttctcctggaccctcgctgagaagcctcccccaccagctgctgctccagcggctgcaagaggagaaagatcgtgaccgggatgccgaccaggagagcaacatcagtggccctttagcaggcagggccggccaaagcaagatcagggagggggctggcaggccctgccccgcgccccctgcgccccccgcaccgccgccccggggcccgaagcggaaactttacagcgccgtccccggccgcaagttcatcgccgtgaaggcgcacagcccgcagggtgaaggcgagatcccgctgcaccgcggcgaggccgtgaaggtgctcagcattggggagggcggtttctgggagggaaccgtgaaaggccgcacgggctggttcccggccgactgcgtggaggaagtgcagatgaggcagcatgacacacggcctgaaacgcgggaggaccggacgaagcggctctttcggcactacacagtgggctcctacgacagcctcacctcacacagcgattatgtcattgatgacaaagtggctgtcctgcagaaacgggaccacgagggctttggttttgtgctccggggagccaaagcagagacccccatcgaggagttcacgcccacgccagccttcccggcgctgcagtatctcgagtcggtggacgtggagggtgtggcctggagggccgggctgcgcacgggagacttcctcatcgaggtgaacggggtgaacgtggtgaaggtcggacacaagcaggtggtggctctgattcgccagggtggcaaccgcctcgtcatgaaggttgtgtctgtgacaaggaagccagaagaggacggggctcggcgcagagccccaccgccccccaagagggcccccagcaccacactgaccctgcgctccaagtccatgacagctgagctcgaggaacttgcctccattcggagaagaaaaggggagaagctggacgagatgctggcagccgccgcagagccaacgctgcggccagacatcgcagacgcagactccagagccgccaccgtcaaacagaggcccaccagtcggaggatcacacccgccgagattagctcattgtttgaacgccagggcctcccaggcccagagaagctgccgggctccttgcggaaggggattccacggaccaagtctgtaggggaggacgagaagctggcgtccctgctggaagggcgcttcccgcggagcacctcgatgcaagacccggtgcgcgagggtcgcggcatcccgcccccgccgcagaccgcgccgcctcccccgcccgcgccctactacttcgactcggggccgcccccggccttctcgccgccgcccccgccgggccgcgcctacgacacggtgcgctccagcttcaagcccggcctggaggcgcgcctgggcgcgggcgctgccggcctgtacgagccgggcgcggccctcggcccgctgccgtatcccgagcggcagaagcgcgcgcgctccatgatcatcctgcaggactcggcgcccgagtcgggcgacgcccctcgacccccgcccgcggccaccccgcccgagcgacccaagcgccggccgcggccgcccggccccgacagcccctacgccaacctgggcgccttcagcgccagcctcttcgctccgtccaagccgcagcgccgcaagagccccctggtgaagcagctgcaggtggaggacgcgcaggagcgcgcggccctggccgtgggcagccccggtcccggcggcggcagcttcgcccgcgagccctccccgacccaccgcggtccgcgcccgggtggcctcgactacggcgcgggcgatggcccggggctcgcgttcggcggcccgggcccggccaaggaccggcggctggaggagcggcgccgctccactgtgttcctgtccgtgggggccatcgagggcagcgcccccggcgcggatctgccatccctacagccctcccgctccatcgacgagcgcctcctggggaccggccccaccgccggccgcgacctgctgctgccctccccggtgtctgccctgaagccgttggtcagcggcccgagcctggggccctcgggttccaccttcatccacccactcaccggcaaacccctggaccccagctcacccctggcccttgccctggctgcccgagagcgagctctggcctcccaggcgccctcccggtcccccacacccgtgcacagtcccgacgccgaccgccccggacccctgtttgtggatgtacaggcccgggacccagagcgagggtccctggcttccccggctttctccccacggagcccagcctggattcctgtgcctgctcgcagggaggcagagaaggtcccccgggaggagcggaagtcacccgaggacaagaagtccatgatcctcagcgtcctggacacatccctgcagcggccagctggcctcatcgttgtgcacgccaccagcaacgggcaggagcccagcaggctggggggggccgaagaggagcgcccgggcaccccggagttggccccggcccccatgcagtcagcggctgtggcagagcccctgcccagcccccgggcccagccccctggtggcaccccggcagacgccgggccaggccagggcagctcagaggaagagccagagctggtgtttgctgtgaacctgccacctgcccagctgtcgtccagcgatgaggagaccagggaggagctggcccgaattgggttggtgccaccccctgaagagtttgccaacggggtcctgctggccaccccactcgctggcccgggcccctcgcccaccacggtgcccagcccggcctcagggaagcccagcagtgagccaccccctgcccctgagtctgcagccgactctggggtggaggaggctgacacacgcagctccagcgacccccacctggagaccacaagcaccatctccacggtgtccagcatgtccaccttgagctcggagagcggggaactcactgacacccacacctccttcgctgacggacacacttttctactcgagaagccaccagtgcctcccaagcccaagctcaagtccccgctggggaaggggccggtgaccttcagggacccgctgctgaagcagtcctcggacagcgagctcatggcccagcagcaccacgccgcctctgccgggctggcctctgccgccgggcctgcccgccctcgctacctcttccagagaaggtccaagctatggggggaccccgtggagagccgggggctccctgggcctgaagacgacaaaccaactgtgatcagtgagctcagctcccgcctgcagcagctgaacaaggacacgcgttccctgggggaggaaccagttggtggcctgggcagcctgctggaccctgccaagaagtcgcccatcgcagcagctcggctcttcagcagcctcggtgagctgagctccatttcagcgcagcgcagccccgggggcccgggcggcggggcctcgtactcggtgaggcccagtggccgctaccccgtggcgagacgcgccccgagcccggtgaagcccgcgtcgctggagcgggtggaggggctgggggcgggcgcggggggcgcagggcggcccttcggcctcacgccccccaccatcctcaagtcgtccagcctctccatcccgcacgagcccaaggaggtgcgcttcgtggtgcgcagcgtgagcgcgcgcagtcgctccccctcgccgtcgccgctgccctcgcccgcgtccggccccggccccggcgcccccggcccacgccgacccttccagcagaagccgctgcagctctggagcaagttcgacgtgggcgactggctggagagcatccacctaggcgagcaccgcgaccgcttcgaggaccatgagatagaaggcgcgcacctacccgcgcttaccaaggacgacttcgtggagctgggcgtcacgcgcgtgggccaccgcatgaacatcgagcgcgcgctcaggcagctggacggcagctga

SEQ ID NO: 181017 - DNA, 11245 bp, Homo sapiens
  Payload ID: 15648
  Gene Symbol: SH3PXD2A
  Gene Name: SH3 and PX domains 2A
  Uniprot ID: Q5TCZ1
  ENST ID: ENST00000355946
  CDS Start-End: 141-3458
ccgggagtccgggcagcgttcggcgcgccgggccggggtggcgggcggccccgggaccccggcagctggagaaggagccggagcccggccgggatgagaaggtgacgccgccgggggcgccactcgctttgtgggggaagatgctcgcctactgcgtgcaggatgccaccgtggtggacgtggagaagcggaggaacccctccaagcactacgtatacataatcaatgtgacctggtctgactccacctcccagactatctaccggaggtacagcaagttctttgacctgcagatgcagcttttggataagtttcccattgaaggtggccagaaggaccccaagcaaaggatcatccccttcctcccaggcaagatcctcttccgcagaagccacatccgggacgtagctgtgaagagactgaagcccatcgatgaatactgccgggcacttgtccggctgcccccccacatctcacagtgtgacgaagtcttccggttcttcgaggctcgacccgaggatgtcaaccctccaaaagaggactatggcagttccaagaggaaatcagtgtggctgtccagctgggctgagtcgcccaagaaggacgtgacaggtgccgacgccaccgccgagcccatgatcctggaacagtacgtggtggtgtccaactataagaagcaggagaactcggagctgagcctccaggccggggaggtggtggatgtcatcgagaagaacgagagcggctggtggttcgtgagcacttctgaggagcagggctgggtccctgccacctacctggaggcccagaatggtactcgggatgactccgacatcaacacctctaagactggagaagaggagaagtatgtcaccgtgcagccttacaccagccaaagcaaggacgagattggctttgagaagggcgtcacagtggaggtgatccggaagaatctggaaggctggtggtatatcagatacctgggcaaagagggctgggcgccagcatcctacctgaagaaggccaaggatgacctgccaacccggaagaagaacctggccggcccagtggagatcattgggaacatcatggagatcagcaacctgctgaacaagaaggcgtctggggacaaggaaactccaccagccgaaggcgagggccatgaggcccccattgccaagaaggagatcagcctgcccatcctctgcaatgcctccaatggcagtgccgtgggcgttcctgacaggactgtctccaggctggcccagggctctccagctgtggccaggattgcccctcagcgggcccagatcagctccccgaacctacggacaagacctccaccacgcagagaatccagcctggggttccaactgccaaagccaccagagcccccttctgttgaggtggagtactacaccattgccgaattccagtcgtgcatttccgatggcatcagctttcggggtggacagaaggcagaggtcattgataagaactcaggtggctggtggtacgtgcagatcggtgagaaggagggctgggcccccgcatcatacatcgataagcgcaagaagcccaacctgagccgccgcacaagcacgctgacccggcccaaggtgcccccgccagcaccccccagcaagcccaaggaggccgaggagggccctacgggggccagtgagagccaggactccccgcggaagctcaagtatgaggagcctgagtatgacatccctgcattcggctttgactcagagcctgagctgagcgaggagcccgtggaggacagagcctcaggggagaggcggcctgcccagccccaccggccctcgccggcctcttctctgcagcgggcccgcttcaaggtgggtgagtcttcagaggatgtggccctggaagaggagaccatctatgagaatgagggcttccggccatatgcagaggacaccctgtcagccagaggctcctccggggacagcgactccccaggcagctcctcgctgtccctgaccaggaaaaactcccccaaatcaggctcccccaagtcatcatcactcctaaagctcaaggcagagaagaatgcccaggcagaaatggggaagaaccactcctcagcctccttttcctcatccatcaccatcaacaccacttgctgctcctcctcttcctcctcctcctcttccttgtccaaaaccagtggcgacctgaagccccgctctgcttcggacgcaggcatccgcggcactcccaaggtcagggcaaagaaggatgctgatgcgaacgctgggctgacctcctgtccccgggccaagccatcggtccggcccaagccattcctaaaccgagcagagtcgcagagccaagagaagatggacatcagcactttacggcgccagctgagacccacaggccagctccgtggagggctcaagggctccaagagtgaggattcggagctgcccccgcagacggcctccgaggctcccagtgaggggtctaggagaagctcatccgacctcatcaccctcccagccaccactcccccatgtcccaccaagaaggaatgggaagggccagccacctcgtacatgacatgcagcgcctaccagaaggtccaggactcggagatcagcttccccgcgggcgtggaggtgcaggtgctggagaagcaggagagcgggtggtggtatgtgaggtttggggagctggagggctgggccccttcccactatttggtgctggatgagaacgagcaacctgacccctctggcaaagagctggacacagtgcccgccaagggcaggcagaacgaaggcaaatcagacagcctggagaagatcgagaggcgcgtccaagcactgaacaccgtcaaccagagcaagaaggccacgccccccatcccctccaaacctcccgggggcttcggcaagacctcaggcactccagcggtgaagatgaggaacggagtgcggcaggtggcggtcaggccccagtcggtgtttgtgtccccgccacccaaggacaacaacctgtcctgcgccctgcggaggaatgagtcactcacggccactgatggcctccgaggcgtccgacggaactcctcctttagcactgctcgctccgctgccgccgaggccaagggccgcctggccgaacgggctgccagccagggttcagactcacccctactgcccgcccagcgcaacagcatacccgtgtcccctgtgcgccccaagcccatcgagaagtctcagttcatccacaataacctcaaagatgtgtacgtctctatcgcagactacgagggggatgaggagacagcaggcttccaggagggggtgtccatggaggttctggagaggaaccctaatggctggtggtactgccagatcctggatggtgtgaagcccttcaaaggctgggtgccttccaactaccttgagaaaaagaactagcagagggcctgggctcttccagcctcagtgtgcctctctggccgcccactggatgagcggtgagacgaacaaaagggaaaggaaaaaatgggggtggggggtggggggtggacaacattcaacactgcagaatgggtgacctcaaagatgccccctgtccaagccatcccacagctggaaggtaggggatgggggtgcccacactgagtgaggaagggaatggaccagggagtcccaggcctgggacccagagccaagaaagctgagatatcctgtgcaccatagggacttcaccaatggattacatgccatctgggacaggccatgtgggagaccccagttgtgcctttgctacagatctggaaaagacaaggtcatgggggcctccagtgtcctgcccctgcttggcccagttttgattgctggcatcttgccaccccaggtatccctggtattgtcctaagctgtatttgtgaattgtgctggtttcctgggcattgccacgcctaccacaggtgggtacattagaagccaccactggctttcaggcttgggggtgtcttctgagctcaagcctgcttctgggccaggccattgtcactgttagttgaagaaaaagcagttcccaggtgccagcaaagaccatctttcataactgtcactgtcttggccttgagaagagagcccgctctccgtggggcaccccatggaggacacagtaccagagtttacagagagggtgggcgaagccaccggtctcttcctaatctgcacagactattttgggtatttctgggcgggcagttcctttgcatgtttcgggagaggtttgttgatttggggcttatatgtcaggcctttggtttgcgtcttattttaggggttgtttgggggcctgggtggtcggcctcacatgggaaggggatgggtagtggatggggtttctgttgtatcttgtgggcgggtgattttgcttttgtttttgtttcacattcttccccctccacaagccaaagtcgtttcatttggtttccactgtgtggactgtgctggagcttggcgcctgccagaaaaatttggggctaggcaagccccaggttgcagacatggtgaagcagagaaactgttcttctggttcctgcacaacctcagaggggcaaaaaccctccccaggaaggaggagggtgttcaggagccagacttttggagagaaggcagctcccagcctgctgggtgaccgccattctgcgtgtgttccccagctgggcagggctggaagccttacgtatgaagcatggagaagcagccattgtccccactatgggcagaggggggacccggctggccccttgggtcagactggagccaacaccgccagccaccccctctggcctgctggcaatgccacaggtgcccaagaagatggaggatccctgtgccaggagccaacctggtcttcccgagggtcagtgccccagtgaagacagaagcgagagaataaagttccctgtaggtcctctgtcacctttgggttgtgtttttcaattgttgacatttcagaggggaccctccagaagcccagccggcttcccccaaggactcccccttcgctgggagtggatttccacacgtgcctttgatttcggacagattgggcctcacagccaccgattcagctgccagggtccctggactgggggttggtgttttctatagaggaggaaaggccctccctcaccctgctccccacccaggcagggcagcatgggacccagtgtctcagtgccttcaaaacccacccccacccctaccctaccccaccacaccccatcccagaggccttgcctgggcaaccctaagcccctgtccctcgccatacactgatgcctggcagctagagcaaatggctcgtgttctttgtcgaaggcctgtggtgagattgttttgtttccttttgttttgtgagtttgtttaaaattgaaattagttattttcttctgctggacagtattaaatagagcaggatgttgagttaatctgctagattgcagtactaatggtagtggtttagtgtcttcatgttaatattatttgtacttatttgaacaataatgataaagaagtggttcattattttttaattaatgcactttaaataaggtagaatggaaaaaacccagagagcaaagtgcattacttaaagatgcagtatatacttttctcatttttaaacagcacatatttattaagagaaaaaaagtaatttatgactatttaaaataaaatttaaaagtagagtgactgtcaggtaaagaaccttcaatgtagctatcttccagggggagggccctgcagcctcgctcctcagatgtctgcactgagccagttcagtcactagtgcgccagccaggccaggagggagtgcagagcatgtctgccaagcacagagcatctcagttggactggaccacagtgctcccgagagcctgcctttcctgcccttccccaccacctgcactgccccccacattctcccagccccccccaaggaccccctctccttgacccccagtgctgtaagtaatagagtcattaaaatgcaggactgaaagagacctcagaggtctctatcccatcccttcctgttactgcggcccaaggacaggaaacaacttttccaaaatcccacagctagttaatgacagatctccccactacattaatcccgtgctcctcctcactgccattatagtttattgtgtggtcatgtttacattgtgacatccagccccaaggatggctgggagttgctcaggcatccaggaaaagtggggaatgctgccatctggtgacagcatgtagatttgggcagtgaacagggattgccatgccccagtcttcgcacctcgccccctcaccccctaactcacagcacaaaccctgcaaacccaaagagaatattaatacttgaagcaagaagggtgcatgccagtccttctccgacatggccagggggtaccaggccttgtgcgcctggcctcctagccctagccagggcgagagggcctttcccttgagctactgagctgctttgtgatgctgaaggatactgccggcagcaggcagaggagggagggggcctagggctctgacccatctggaggaaaaccagatcggactaaaaaaggaaaaagaaaaacaaaatctccgcagtgtccaaacctagtttcccatgagttgcgactgaaaatgtgaaacgacactgtattgctgtatactgcaactttaaccataatgagcccttctgaggtcattattgaggttcatataatgcccgaagatgcagcatttggtgctttgttttcctttccgtttcaagacctttttcttttattgcaaggggaaaaaaatgtcatctccccccacctcatccctctttgtgacagcagacctggctgtgttgcccctctcctcctcactattctcaccaggccatgggactttgggggcagtgagagagagctggaaaggggcaaccctgagcagcaggtgtgccccatgccctgtgggtttcccctatgtccaatgactgtagacgggctgtcttgccaggcctcagccccgtctaccctaagcctggccccaaaggtttctctttcttcctccttgattttccatcttgacgaaggcattatatagaatcattttaatcactttcagatgttagagcagcgtattttacaggcatttatatccattgctttcctcagcaaggcatgttactacttttatcatctaaggaaaaaagacaagggaattccagtcaggcattattttcctattactagtgtttgcagaataggtgtaggactatttaagtttagaccttggtttggtagttcttgtttttaataaggggaaaaagataaaataacccctatttttcctgttattgtatttaactaatatattatttctttaaggttactcacttcccctacccctccaaataccttgcattctcaatcaaaaatggaaacaatctgagagacaggaaaagtgcaatattaccaagatggatgccagggctcattggggacaatggagggaataccagtggcgctcagagagcaagaggcagggagcggggtgctgaaggaatcctagctgtggaacaggtgggtgggttggtggagtttgatcttgtggcgttctcctctcccccttctttgggaagatgataggggtccctgccagatccacccagaagaaagggattcaggcatggggcccttgacctctaggccccagtccctggagcagaggcaggccctcgggagctgttccttgttttgatttctgttgtggtgcagccagctgctcagagagacctggcctaaaaatgactcccagcagccctctctcaccccagtgtcctgatatttgggctgtgatccttctggtgtatgtttgaatctttctaaaactgggtgccctcagttcagtttctaggcaggaagcctagaagtcaccagatctttttgggggatgtgagaaccttgagccgcgcacaccctggtgagacaccaattcccacaagcctgcagcagggcctggggctgagcctgggctgcccattcatctcagcgacttcagcctgagaagtgagccctgcctgggctccacacccagagagtccatacaaattctgctccgggaagagtcggggggtctattcaagtttctctgcagacaaaacttcccacaacaggtaccaatctggcctccttcctcagcaccggtagagaaagcaacagaatgggaagtttcctctgggttggagcctcagagctctgcccctcaaggtgacagggacgtccctgtggcttgttccctccacctccagtactgtatgcttgctacttcaaccccctatttggtgaatttctgcacagacacagatctctgtgcctggaatgggactgtgccctgtgcgggtctctcccttggcgtatatccatctagatatttagtctttgagaatctcaaagcagagctctctgggaagagaactgtccacattgctaaataattaagattccctcacttttttgagggccatgtgttgtgagagagagagagagagagagagtgtgtgtgtgtgtgtgtgtgtgtgtgtgtctgtgtatgcaagtgttggtaacttcccacttgaactaaataacatggggttagagaaaaaaaaataccaggcaagctgtctccattgaacaagtccttggcaatgggcaggtcccaagggactcacagcttctggcagcaagtgtgtcattcacacacatcattctggctggagagtgcaatgtgtcatttttttttctttttgtaattattttattaagtatttagttggaaatttcacactggcattaacaggtctagcataagtggcctaggcagtcatcccaggctccaaaatgaagatgtgcaaaagagatgccactgggaatagaaacactgagttggttcagttaggtcatcccctgcagacgtgtcatcgagcaggctgactcccacccctcagccatgccatgggtatgagaagccccttataatgaaagctgccagccctttcgtccttgtttcagagggtgggtcaggtggttggggtgagaacttgctcacggtgcacccaacaagacctgcaggtgcatataagtttagtcccaactgcagggccagaccaaacacttcctgggaagtgtgtggagggctgtgctagaccttcctgagtttctggctaaatcatcagccctgtttggtgcagtctcatgtctctgtggttcccaagctgcatgatcagagccagtgagaagacaggatcagtgacccacagctttggggaaaaacagccccactgttaacttccctcctgcaaacctgggtccccaggccataaggtgggcacactggtgcttacagactgggtggagagccctaccttccaaggtcttgatcccagcctgcctataaggttgggattagcatgcaatcccccttccccaatcctgtctttttaaaatctcaagtttgcacttaaccttgacaacagcaccctctcctactccagtcctagaactcagtggccttagagaatggggtcccctgcactgaaggtccccgccttgctcccagttccatcctggccaataggctgcgcctcaagaggtgaaagagaaaaaagggagggagggaggaagaattatttagaacaaaaggatggctcgagcacgttagaggcaagtgagaggcacgttggtgagaagagcatgtgcatgtttggggtagctggggcctactgtcccttcattagggaaggaggcttccagaagcggatgtcttctagaaagaaaaattgtgtgaaggctgaaaaggggcttggagttttgtctttgttgattagaaagaaggaagaagtcagctctgagtgtttcaggaagaagagagcaggtagaaagggaatttagtgatttaacacccaagggtccagccatagcaggttggaaaatcctccaaatttggccacagaaactggctaggaaaaaactgccactcattgggccacacgctgggtccccatcagttctcaatgaatggtcattgatttacttagcagagagaagtcaccagccacaaaccaatctttgagtttgcaggccctgattccagaatatatgcatccagctcccgggttctcagctggttttgcccacttccctttgactgtccaatccaaagccagtctctcaagttgtatggctcaaagagcagtgaccacaatgggtcatacagtagggacccacctccacaaattagaaccagagttcagactccattgggcacatctgggaggaaggcaacctcctttgtcgtcttgttggtaccagtcattctcaagtatctctgacacctgtggtggttcagtttgctgagcctgccacctggtatgaattagactgggtgtgatgaacattcatccatggatataccctaccattttgcgttgccttataaccaaggcacactccccataagagtttactgcagagaaagaacagcaaaacagccaccctccttgaatttacaactcattatctgcaacaggttttctttaaatccaagacacaggatgggaaatgggtttccccaccaggtactcagaggtctgcaggaagtgactcccgggcaaggcagacttcagtaatccctgaagcgtgagcatgtggactgcatggctgggtggggactggtggatgtctctggagctccagaaccttggagaattcctcatggaattcccctcccagctcttagtgggctctgtggggtcaggaggagcccttcctccaggttttccttctttcctcctcagcagagaaactggagaaaggacattaaactcagtgcagtcgatttgagtgctgaaatatttccagaatcaatggtggtgctaaactatctccatgtttctagcatttttaatagtggagttggtttgtttttaatctcatcacaaaaatgcagtgcccttggggaagggaccagccccttggcctgccactttccaggtgtcctttatcactttgacgggactctttggtctgcagaaaatgctctgtcttggcatgcttctagactgtaagatttgggttttgttttgtattttatgtttacatgcatcttatatttccctgaaaactaaataaagttttgggcctttttaaccg

SEQ ID NO: 181018 - DNA, 11468 bp, Homo sapiens
  Payload ID: 15648
  Gene Symbol: SH3PXD2A
  Gene Name: SH3 and PX domains 2A
  Uniprot ID: Q5TCZ1
  ENST ID: ENST00000369774
  CDS Start-End: 278-3679
gcgagcgggcgagcgcagcgcggcggccgcgcgggagtgaaggggcgcgcggcaggccggcggggagtcccccggggcgcacggagcccgcgcgccctccgggaccctcccccgtccctgggccggacctgtgggcgccgggagtccgggcagcgttcggcgcgccgggccggggtggcgggcggccccgggaccccggcagctggagaaggagccggagcccggccgggatgagaaggtgacgccgccgggggcgccactcgctttgtgggggaagatgctcgcctactgcgtgcaggatgccaccgtggtggacgtggagaagcggaggaacccctccaagcactacgtatacataatcaatgtgacctggtctgactccacctcccagactatctaccggaggtacagcaagttctttgacctgcagatgcagcttttggataagtttcccattgaaggtggccagaaggaccccaagcaaaggatcatccccttcctcccaggcaagatcctcttccgcagaagccacatccgggacgtagctgtgaagagactgaagcccatcgatgaatactgccgggcacttgtccggctgcccccccacatctcacagtgtgacgaagtcttccggttcttcgaggctcgacccgaggatgtcaaccctccaaaagaggactatggcagttccaagaggaaatcagtgtggctgtccagctgggctgagtcgcccaagaaggacgtgacaggtgccgacgccaccgccgagcccatgatcctggaacagtacgtggtggtgtccaactataagaagcaggagaactcggagctgagcctccaggccggggaggtggtggatgtcatcgagaagaacgagagcggctggtggttcgtgagcacttctgaggagcagggctgggtccctgccacctacctggaggcccagaatggtactcgggatgactccgacatcaacacctctaagactggagaagtgtccaagagacgcaaggcccatctgcggcgcctggatcgccggtggaccctgggcgggatggtcaacaggcagcacagccgagaggagaagtatgtcaccgtgcagccttacaccagccaaagcaaggacgagattggctttgagaagggcgtcacagtggaggtgatccggaagaatctggaaggctggtggtatatcagatacctgggcaaagagggctgggcgccagcatcctacctgaagaaggccaaggatgacctgccaacccggaagaagaacctggccggcccagtggagatcattgggaacatcatggagatcagcaacctgctgaacaagaaggcgtctggggacaaggaaactccaccagccgaaggcgagggccatgaggcccccattgccaagaaggagatcagcctgcccatcctctgcaatgcctccaatggcagtgccgtgggcgttcctgacaggactgtctccaggctggcccagggctctccagctgtggccaggattgcccctcagcgggcccagatcagctccccgaacctacggacaagacctccaccacgcagagaatccagcctggggttccaactgccaaagccaccagagcccccttctgttgaggtggagtactacaccattgccgaattccagtcgtgcatttccgatggcatcagctttcggggtggacagaaggcagaggtcattgataagaactcaggtggctggtggtacgtgcagatcggtgagaaggagggctgggcccccgcatcatacatcgataagcgcaagaagcccaacctgagccgccgcacaagcacgctgacccggcccaaggtgcccccgccagcaccccccagcaagcccaaggaggccgaggagggccctacgggggccagtgagagccaggactccccgcggaagctcaagtatgaggagcctgagtatgacatccctgcattcggctttgactcagagcctgagctgagcgaggagcccgtggaggacagagcctcaggggagaggcggcctgcccagccccaccggccctcgccggcctcttctctgcagcgggcccgcttcaaggtgggtgagtcttcagaggatgtggccctggaagaggagaccatctatgagaatgagggcttccggccatatgcagaggacaccctgtcagccagaggctcctccggggacagcgactccccaggcagctcctcgctgtccctgaccaggaaaaactcccccaaatcaggctcccccaagtcatcatcactcctaaagctcaaggcagagaagaatgcccaggcagaaatggggaagaaccactcctcagcctccttttcctcatccatcaccatcaacaccacttgctgctcctcctcttcctcctcctcctcttccttgtccaaaaccagtggcgacctgaagccccgctctgcttcggacgcaggcatccgcggcactcccaaggtcagggcaaagaaggatgctgatgcgaacgctgggctgacctcctgtccccgggccaagccatcggtccggcccaagccattcctaaaccgagcagagtcgcagagccaagagaagatggacatcagcactttacggcgccagctgagacccacaggccagctccgtggagggctcaagggctccaagagtgaggattcggagctgcccccgcagacggcctccgaggctcccagtgaggggtctaggagaagctcatccgacctcatcaccctcccagccaccactcccccatgtcccaccaagaaggaatgggaagggccagccacctcgtacatgacatgcagcgcctaccagaaggtccaggactcggagatcagcttccccgcgggcgtggaggtgcaggtgctggagaagcaggagagcgggtggtggtatgtgaggtttggggagctggagggctgggccccttcccactatttggtgctggatgagaacgagcaacctgacccctctggcaaagagctggacacagtgcccgccaagggcaggcagaacgaaggcaaatcagacagcctggagaagatcgagaggcgcgtccaagcactgaacaccgtcaaccagagcaagaaggccacgccccccatcccctccaaacctcccgggggcttcggcaagacctcaggcactccagcggtgaagatgaggaacggagtgcggcaggtggcggtcaggccccagtcggtgtttgtgtccccgccacccaaggacaacaacctgtcctgcgccctgcggaggaatgagtcactcacggccactgatggcctccgaggcgtccgacggaactcctcctttagcactgctcgctccgctgccgccgaggccaagggccgcctggccgaacgggctgccagccagggttcagactcacccctactgcccgcccagcgcaacagcatacccgtgtcccctgtgcgccccaagcccatcgagaagtctcagttcatccacaataacctcaaagatgtgtacgtctctatcgcagactacgagggggatgaggagacagcaggcttccaggagggggtgtccatggaggttctggagaggaaccctaatggctggtggtactgccagatcctggatggtgtgaagcccttcaaaggctgggtgccttccaactaccttgagaaaaagaactagcagagggcctgggctcttccagcctcagtgtgcctctctggccgcccactggatgagcggtgagacgaacaaaagggaaaggaaaaaatgggggtggggggtggggggtggacaacattcaacactgcagaatgggtgacctcaaagatgccccctgtccaagccatcccacagctggaaggtaggggatgggggtgcccacactgagtgaggaagggaatggaccagggagtcccaggcctgggacccagagccaagaaagctgagatatcctgtgcaccatagggacttcaccaatggattacatgccatctgggacaggccatgtgggagaccccagttgtgcctttgctacagatctggaaaagacaaggtcatgggggcctccagtgtcctgcccctgcttggcccagttttgattgctggcatcttgccaccccaggtatccctggtattgtcctaagctgtatttgtgaattgtgctggtttcctgggcattgccacgcctaccacaggtgggtacattagaagccaccactggctttcaggcttgggggtgtcttctgagctcaagcctgcttctgggccaggccattgtcactgttagttgaagaaaaagcagttcccaggtgccagcaaagaccatctttcataactgtcactgtcttggccttgagaagagagcccgctctccgtggggcaccccatggaggacacagtaccagagtttacagagagggtgggcgaagccaccggtctcttcctaatctgcacagactattttgggtatttctgggcgggcagttcctttgcatgtttcgggagaggtttgttgatttggggcttatatgtcaggcctttggtttgcgtcttattttaggggttgtttgggggcctgggtggtcggcctcacatgggaaggggatgggtagtggatggggtttctgttgtatcttgtgggcgggtgattttgcttttgtttttgtttcacattcttccccctccacaagccaaagtcgtttcatttggtttccactgtgtggactgtgctggagcttggcgcctgccagaaaaatttggggctaggcaagccccaggttgcagacatggtgaagcagagaaactgttcttctggttcctgcacaacctcagaggggcaaaaaccctccccaggaaggaggagggtgttcaggagccagacttttggagagaaggcagctcccagcctgctgggtgaccgccattctgcgtgtgttccccagctgggcagggctggaagccttacgtatgaagcatggagaagcagccattgtccccactatgggcagaggggggacccggctggccccttgggtcagactggagccaacaccgccagccaccccctctggcctgctggcaatgccacaggtgcccaagaagatggaggatccctgtgccaggagccaacctggtcttcccgagggtcagtgccccagtgaagacagaagcgagagaataaagttccctgtaggtcctctgtcacctttgggttgtgtttttcaattgttgacatttcagaggggaccctccagaagcccagccggcttcccccaaggactcccccttcgctgggagtggatttccacacgtgcctttgatttcggacagattgggcctcacagccaccgattcagctgccagggtccctggactgggggttggtgttttctatagaggaggaaaggccctccctcaccctgctccccacccaggcagggcagcatgggacccagtgtctcagtgccttcaaaacccacccccacccctaccctaccccaccacaccccatcccagaggccttgcctgggcaaccctaagcccctgtccctcgccatacactgatgcctggcagctagagcaaatggctcgtgttctttgtcgaaggcctgtggtgagattgttttgtttccttttgttttgtgagtttgtttaaaattgaaattagttattttcttctgctggacagtattaaatagagcaggatgttgagttaatctgctagattgcagtactaatggtagtggtttagtgtcttcatgttaatattatttgtacttatttgaacaataatgataaagaagtggttcattattttttaattaatgcactttaaataaggtagaatggaaaaaacccagagagcaaagtgcattacttaaagatgcagtatatacttttctcatttttaaacagcacatatttattaagagaaaaaaagtaatttatgactatttaaaataaaatttaaaagtagagtgactgtcaggtaaagaaccttcaatgtagctatcttccagggggagggccctgcagcctcgctcctcagatgtctgcactgagccagttcagtcactagtgcgccagccaggccaggagggagtgcagagcatgtctgccaagcacagagcatctcagttggactggaccacagtgctcccgagagcctgcctttcctgcccttccccaccacctgcactgccccccacattctcccagccccccccaaggaccccctctccttgacccccagtgctgtaagtaatagagtcattaaaatgcaggactgaaagagacctcagaggtctctatcccatcccttcctgttactgcggcccaaggacaggaaacaacttttccaaaatcccacagctagttaatgacagatctccccactacattaatcccgtgctcctcctcactgccattatagtttattgtgtggtcatgtttacattgtgacatccagccccaaggatggctgggagttgctcaggcatccaggaaaagtggggaatgctgccatctggtgacagcatgtagatttgggcagtgaacagggattgccatgccccagtcttcgcacctcgccccctcaccccctaactcacagcacaaaccctgcaaacccaaagagaatattaatacttgaagcaagaagggtgcatgccagtccttctccgacatggccagggggtaccaggccttgtgcgcctggcctcctagccctagccagggcgagagggcctttcccttgagctactgagctgctttgtgatgctgaaggatactgccggcagcaggcagaggagggagggggcctagggctctgacccatctggaggaaaaccagatcggactaaaaaaggaaaaagaaaaacaaaatctccgcagtgtccaaacctagtttcccatgagttgcgactgaaaatgtgaaacgacactgtattgctgtatactgcaactttaaccataatgagcccttctgaggtcattattgaggttcatataatgcccgaagatgcagcatttggtgctttgttttcctttccgtttcaagacctttttcttttattgcaaggggaaaaaaatgtcatctccccccacctcatccctctttgtgacagcagacctggctgtgttgcccctctcctcctcactattctcaccaggccatgggactttgggggcagtgagagagagctggaaaggggcaaccctgagcagcaggtgtgccccatgccctgtgggtttcccctatgtccaatgactgtagacgggctgtcttgccaggcctcagccccgtctaccctaagcctggccccaaaggtttctctttcttcctccttgattttccatcttgacgaaggcattatatagaatcattttaatcactttcagatgttagagcagcgtattttacaggcatttatatccattgctttcctcagcaaggcatgttactacttttatcatctaaggaaaaaagacaagggaattccagtcaggcattattttcctattactagtgtttgcagaataggtgtaggactatttaagtttagaccttggtttggtagttcttgtttttaataaggggaaaaagataaaataacccctatttttcctgttattgtatttaactaatatattatttctttaaggttactcacttcccctacccctccaaataccttgcattctcaatcaaaaatggaaacaatctgagagacaggaaaagtgcaatattaccaagatggatgccagggctcattggggacaatggagggaataccagtggcgctcagagagcaagaggcagggagcggggtgctgaaggaatcctagctgtggaacaggtgggtgggttggtggagtttgatcttgtggcgttctcctctcccccttctttgggaagatgataggggtccctgccagatccacccagaagaaagggattcaggcatggggcccttgacctctaggccccagtccctggagcagaggcaggccctcgggagctgttccttgttttgatttctgttgtggtgcagccagctgctcagagagacctggcctaaaaatgactcccagcagccctctctcaccccagtgtcctgatatttgggctgtgatccttctggtgtatgtttgaatctttctaaaactgggtgccctcagttcagtttctaggcaggaagcctagaagtcaccagatctttttgggggatgtgagaaccttgagccgcgcacaccctggtgagacaccaattcccacaagcctgcagcagggcctggggctgagcctgggctgcccattcatctcagcgacttcagcctgagaagtgagccctgcctgggctccacacccagagagtccatacaaattctgctccgggaagagtcggggggtctattcaagtttctctgcagacaaaacttcccacaacaggtaccaatctggcctccttcctcagcaccggtagagaaagcaacagaatgggaagtttcctctgggttggagcctcagagctctgcccctcaaggtgacagggacgtccctgtggcttgttccctccacctccagtactgtatgcttgctacttcaaccccctatttggtgaatttctgcacagacacagatctctgtgcctggaatgggactgtgccctgtgcgggtctctcccttggcgtatatccatctagatatttagtctttgagaatctcaaagcagagctctctgggaagagaactgtccacattgctaaataattaagattccctcacttttttgagggccatgtgttgtgagagagagagagagagagagagtgtgtgtgtgtgtgtgtgtgtgtgtgtgtctgtgtatgcaagtgttggtaacttcccacttgaactaaataacatggggttagagaaaaaaaaataccaggcaagctgtctccattgaacaagtccttggcaatgggcaggtcccaagggactcacagcttctggcagcaagtgtgtcattcacacacatcattctggctggagagtgcaatgtgtcatttttttttctttttgtaattattttattaagtatttagttggaaatttcacactggcattaacaggtctagcataagtggcctaggcagtcatcccaggctccaaaatgaagatgtgcaaaagagatgccactgggaatagaaacactgagttggttcagttaggtcatcccctgcagacgtgtcatcgagcaggctgactcccacccctcagccatgccatgggtatgagaagccccttataatgaaagctgccagccctttcgtccttgtttcagagggtgggtcaggtggttggggtgagaacttgctcacggtgcacccaacaagacctgcaggtgcatataagtttagtcccaactgcagggccagaccaaacacttcctgggaagtgtgtggagggctgtgctagaccttcctgagtttctggctaaatcatcagccctgtttggtgcagtctcatgtctctgtggttcccaagctgcatgatcagagccagtgagaagacaggatcagtgacccacagctttggggaaaaacagccccactgttaacttccctcctgcaaacctgggtccccaggccataaggtgggcacactggtgcttacagactgggtggagagccctaccttccaaggtcttgatcccagcctgcctataaggttgggattagcatgcaatcccccttccccaatcctgtctttttaaaatctcaagtttgcacttaaccttgacaacagcaccctctcctactccagtcctagaactcagtggccttagagaatggggtcccctgcactgaaggtccccgccttgctcccagttccatcctggccaataggctgcgcctcaagaggtgaaagagaaaaaagggagggagggaggaagaattatttagaacaaaaggatggctcgagcacgttagaggcaagtgagaggcacgttggtgagaagagcatgtgcatgtttggggtagctggggcctactgtcccttcattagggaaggaggcttccagaagcggatgtcttctagaaagaaaaattgtgtgaaggctgaaaaggggcttggagttttgtctttgttgattagaaagaaggaagaagtcagctctgagtgtttcaggaagaagagagcaggtagaaagggaatttagtgatttaacacccaagggtccagccatagcaggttggaaaatcctccaaatttggccacagaaactggctaggaaaaaactgccactcattgggccacacgctgggtccccatcagttctcaatgaatggtcattgatttacttagcagagagaagtcaccagccacaaaccaatctttgagtttgcaggccctgattccagaatatatgcatccagctcccgggttctcagctggttttgcccacttccctttgactgtccaatccaaagccagtctctcaagttgtatggctcaaagagcagtgaccacaatgggtcatacagtagggacccacctccacaaattagaaccagagttcagactccattgggcacatctgggaggaaggcaacctcctttgtcgtcttgttggtaccagtcattctcaagtatctctgacacctgtggtggttcagtttgctgagcctgccacctggtatgaattagactgggtgtgatgaacattcatccatggatataccctaccattttgcgttgccttataaccaaggcacactccccataagagtttactgcagagaaagaacagcaaaacagccaccctccttgaatttacaactcattatctgcaacaggttttctttaaatccaagacacaggatgggaaatgggtttccccaccaggtactcagaggtctgcaggaagtgactcccgggcaaggcagacttcagtaatccctgaagcgtgagcatgtggactgcatggctgggtggggactggtggatgtctctggagctccagaaccttggagaattcctcatggaattcccctcccagctcttagtgggctctgtggggtcaggaggagcccttcctccaggttttccttctttcctcctcagcagagaaactggagaaaggacattaaactcagtgcagtcgatttgagtgctgaaatatttccagaatcaatggtggtgctaaactatctccatgtttctagcatttttaatagtggagttggtttgtttttaatctcatcacaaaaatgcagtgcccttggggaagggaccagccccttggcctgccactttccaggtgtcctttatcactttgacgggactctttggtctgcagaaaatgctctgtcttggcatgcttctagactgtaagatttgggttttgttttgtattttatgtttacatgcatcttatatttccctgaaaactaaataaagttttgggcctttttaaccgaa

SEQ ID NO: 181019 - DNA, 3251 bp, Homo sapiens
  Payload ID: 15648
  Gene Symbol: SH3PXD2A
  Gene Name: SH3 and PX domains 2A
  ENST ID: ENST00000420222
  CDS Start-End: 1-3181
gttctttgacctgcagatgcagcttttggataagtttcccattgaaggtggccagaaggaccccaagcaaaggatcatccccttcctcccaggcaagatcctcttccgcagaagccacatccgggacgtagctgtgaagagactgaagcccatcgatgaatactgccgggcacttgtccggctgcccccccacatctcacagtgtgacgaagtcttccggttcttcgaggctcgacccgaggatgtcaaccctccaaaagaggactatggcagttccaagaggaaatcagtgtggctgtccagctgggctgagtcgcccaagaaggacgtgacaggtgccgacgccaccgccgagcccatgatcctggaacagtacgtggtggtgtccaactataagaagcaggagaactcggagctgagcctccaggccggggaggtggtggatgtcatcgagaagaacgagagcggctggtggttcgtgagcacttctgaggagcagggctgggtccctgccacctacctggaggcccagaatggtactcgggatgactccgacatcaacacctctaagactggagaagaggagaagtatgtcaccgtgcagccttacaccagccaaagcaaggacgagattggctttgagaagggcgtcacagtggaggtgatccggaagaatctggaaggctggtggtatatcagatacctgggcaaagagggctgggcgccagcatcctacctgaagaaggccaaggatgacctgccaacccggaagaagaacctggccggcccagtggagatcattgggaacatcatggagatcagcaacctgctgaacaagaaggcgtctggggacaaggaaactccaccagccgaaggcgagggccatgaggcccccattgccaagaaggagatcagcctgcccatcctctgcaatgcctccaatggcagtgccgtgggcgttcctgacaggactgtctccaggctggcccagggctctccagctgtggccaggattgcccctcagcgggcccagatcagctccccgaacctacggacaagacctccaccacgcagagaatccagcctggggttccaactgccaaagccaccagagcccccttctgttgaggtggagtactacaccattgccgaattccagtcgtgcatttccgatggcatcagctttcggggtggacagaaggcagaggtcattgataagaactcaggtggctggtggtacgtgcagatcggtgagaaggagggctgggcccccgcatcatacatcgataagcgcaagaagcccaacctgagccgccgcacaagcacgctgacccggcccaaggtgcccccgccagcaccccccagcaagcccaaggaggccgaggagggccctacgggggccagtgagagccaggactccccgcggaagctcaagtatgaggagcctgagtatgacatccctgcattcggctttgactcagagcctgagctgagcgaggagcccgtggaggacagagcctcaggggagaggcggcctgcccagccccaccggccctcgccggcctcttctctgcagcgggcccgcttcaaggtgggtgagtcttcagaggatgtggccctggaagaggagaccatctatgagaatgagggcttccggccatatgcagaggacaccctgtcagccagaggctcctccggggacagcgactccccaggcagctcctcgctgtccctgaccaggaaaaactcccccaaatcaggctcccccaagtcatcatcactcctaaagctcaaggcagagaagaatgcccaggcagaaatggggaagaaccactcctcagcctccttttcctcatccatcaccatcaacaccacttgctgctcctcctcttcctcctcctcctcttccttgtccaaaaccagtggcgacctgaagccccgctctgcttcggacgcaggcatccgcggcactcccaaggtcagggcaaagaaggatgctgatgcgaacgctgggctgacctcctgtccccgggccaagccatcggtccggcccaagccattcctaaaccgagcagagtcgcagagccaagagaagatggacatcagcactttacggcgccagctgagacccacaggccagctccgtggagggctcaagggctccaagagtgaggattcggagctgcccccgcagacggcctccgaggctcccagtgaggggtctaggagaagctcatccgacctcatcaccctcccagccaccactcccccatgtcccaccaagaaggaatgggaagggccagccacctcgtacatgacatgcagcgcctaccagaaggtccaggactcggagatcagcttccccgcgggcgtggaggtgcaggtgctggagaagcaggagagcgggtggtggtatgtgaggtttggggagctggagggctgggccccttcccactatttggtgctggatgagaacgagcaacctgacccctctggcaaagagctggacacagtgcccgccaagggcaggcagaacgaaggcaaatcagacagcctggagaagatcgagaggcgcgtccaagcactgaacaccgtcaaccagagcaagaaggccacgccccccatcccctccaaacctcccgggggcttcggcaagacctcaggcactccagcggtgaagatgaggaacggagtgcggcaggtggcggtcaggccccagtcggtgtttgtgtccccgccacccaaggacaacaacctgtcctgcgccctgcggaggaatgagtcactcacggccactgatggcctccgaggcgtccgacggaactcctcctttagcactgctcgctccgctgccgccgaggccaagggccgcctggccgaacgggctgccagccagggttcagactcacccctactgcccgcccagcgcaacagcatacccgtgtcccctgtgcgccccaagcccatcgagaagtctcagttcatccacaataacctcaaagatgtgtacgtctctatcgcagactacgagggggatgaggagacagcaggcttccaggagggggtgtccatggaggttctggagaggaaccctaatggctggtggtactgccagatcctggatggtgtgaagcccttcaaaggctgggtgccttccaactaccttgagaaaaagaactagcagagggcctgggctcttccagcctcagtgtgcctctctggccgcccactggatgagcggtgagacgaac

SEQ ID NO: 181020 - DNA, 7777 bp, Homo sapiens
  Payload ID: 15649
  Gene Symbol: SH3PXD2B
  Gene Name: SH3 and PX domains 2B
  Uniprot ID: A1X283
  ENST ID: ENST00000311601
  CDS Start-End: 172-2907
agtgcgcgccgagcgaagggcggcggcggtggcggcggcggctcgtgctcggccccggctgcgattgcgctcagctccaggttccctgcccgcggcggcgcgcccccagcgctccctgcaccccgcgccacccgcacccgcgctcggcccgctgcgggcggaggagcggccatgccgccgcggcgcagcatcgtggaggtgaaggtgctagacgtgcagaagcggcgggtgcccaacaagcattatgtctacatcatccgggtcacgtggtccagcggctccaccgaggccatttaccggcgctacagcaagttttttgacctccagatgcagatgttggacaaatttcccatggaaggaggacagaaggaccccaagcagcggatcatcccctttctgccaggtaagattctcttcagacgaagccacatccgggacgtggctgtcaaacgcctgataccaattgatgaatactgtaaggccctcatccagctgcccccctacatctctcagtgtgatgaggtgctgcagttctttgagacaagacctgaggacctgaatccccccaaagaggagcacattgggaaaaagaaatctgggggtgaccaaacctcagtggaccccatggtcctggagcagtatgtggtggtagccaactaccagaagcaggagagttcggagatcagcctcagcgtggggcaggtggtggacatcatcgagaagaatgagtcaggttggtggttcgtcagcactgccgaggagcaaggctgggtccctgcaacgtgcctcgaaggccaggatggggtgcaggatgagttttctctgcagcctgaagaagaggagaagtacacagtcatctacccgtacacagctcgggaccaggatgaaatgaacctggagagaggggctgtggtggaggtcatccagaaaaacctggaaggctggtggaagatcaggtaccagggcaaagaaggctgggcccccgcctcctacctaaagaagaacagtggggagcccttgcccccgaagccaggccctggctcaccctcccacccgggtgcccttgacttggatggtgtttcccggcagcagaacgcggtgggcagggagaaggagctgctcagcagccagagggacgggcggtttgaaggccgcccggtgcccgacggtgacgccaagcagagatcaccaaagatgaggcagagaccccctcctcgccgggacatgaccattcctcgaggcctcaacctgccgaagccgcccatcccgccccaagtggaggaagagtattacaccatcgccgaattccagacaaccatcccagacggcatcagcttccaggcaggcctgaaggtcgaggtgatcgagaaaaacttgagtggctggtggtacattcagattgaagataaggaagggtgggccccggccaccttcattgacaagtacaagaagacgagcaacgcgtcgagacccaactttctggctcccctgccccacgaggtgacccagctccggctgggggaagcagcagcgctggagaacaacacgggcagcgaagccacgggcccctcccggcccctgcctgacgcaccgcatggtgtcatggactcggggttgccatggtctaaagactggaagggcagtaaggatgtcctgaggaaggcatcttcagacatgtctgcgtcagcaggctacgaggagatctcagaccccgacatggaggagaagcccagcctccctccgcggaaagaatccatcatcaagtcggagggggagctgctggagcgggagcgggagcggcagaggacggagcagctccggggccccactcccaagcctccgggcgtgattttgccgatgatgccagccaaacacatccctccagcccgggacagcaggaggccagagcccaaacctgacaaaagcagactgttccagctgaaaaatgacatggggctggagtgtggccacaaggtcttggccaaggaagtgaagaagcccaacctccggcccatctccaaatccaaaactgacctgccagaggagaagccagatgccactccccagaatcccttcttgaagtccagacctcaggttaggccaaaaccagctccttcccccaaaacggagccacctcagggcgaagaccaagtcgacatctgcaacctcaggagtaagctcaggcctgccaagtcccaagacaagtccttgttggatggggagggcccccaggcagtagggggccaagacgtggccttcagccgaagcttcctcccaggagaggggcctggccgcgcccaggacaggacgggcaaacaggatggtctcagcccaaaagagatttcctgcagagcccctccgaggccagccaagaccacagatcctgtgtctaagagcgtgcctgttcctctccaagaggctccccagcagagacctgtggtcccaccccgcagaccacctcccccaaagaaaacctcttcgtcatccaggccgctcccagaggtcagaggtccacagtgtgaaggccacgaaagcagggcagctcccaccccaggccgtgctctcctcgtccctccaaaagccaaaccttttctctccaactctttggggggccaggatgacacgcgaggcaaaggcagcctggggccatgggggaccggcaagattggagaaaacagggagaaagcagctgcagcctctgtccccaatgccgacggcctgaaggactctttgtatgtggccgtggccgactttgaaggagacaaagacaccagcagcttccaggaagggacagtgtttgaagtccgggagaagaacagcagtggctggtggttctgccaggtcctgagcggagccccttcctgggaagggtggattccttccaactatctcagaaagaagccgtagccgactccctttctgcctagagggcccgctggtccttgctggctttacccacgtatttaatacgcctcttaatttatcattctccacgcagcttccaaggcagacagactctggggtactgtgacttcttgcctcccatgggtggagagtgagtttcggacacctcgggcgcccctgggcctgatccctcctatcacagcatcactggaggctcagaacccacagcctttgctttctgtccatgtcagcatccctgccttaagagaactcctcctggccaatggcattgccacccagcagtgggaccaagactctccaagacctccaggactggatcccattgcctggagaaactccagcaagggtctctcatggcttggacatggcacagtaaggggcagccaacccagtccatgatgacttttgctccaacttcttcatgtttctaaaagcccagtggctttattcactcctcctaaattgcctgctaccagaaggaacttcatcctgaagaaatgcattccattaccagttccagggaaagtgtccccttccccaaagcctcaggcccgtgggcctctgaggttccactggatgcggctcccccaggagtgggcctggagatccgctcagccgccctgcctcccaccttctatcttgggaccgtggtcagccctgaagggtggttccagccccgcgtatgctgcgctttgctgctgcaggctccggtccctccagggcttttcaatgagagttcccaccccaacttggagcatttcatttttgcctacctaaagcaagaatctcaaagtttgtttgaataagaggcccattcacaagtcgtgcccttgtgagcacccctttgctgagtgcctcgtgggtgccaaacactgtacttggcgctttgcattcatgctttgaccctcacaacctccctttatagatgaggaaattcacgctccatgtgcccaaggacacaccagccaggaggaagagggaagaggatttgagtccaggcctgcctgacttcagtgcctgtgccctcccctctgtaaaagacaaaccaggcagggaagagatagaagctggctaagtggtggccaagtggcttcattgtgaggggggtgagggggcattcgtggctgctcccacacccaccatccctccagcccacagcagcctataccaaaggctgccctggactcaacagctgcatctccatgacaggagaatgccagggtcctggtggttgacacagagccctgttccctcttctaagctgttgccccctggggaatagagcttatggagcaacgggagctgaggtggcctcgagggccagcctggagggctctgagcatagcatgcagcggtcccatagggaggcaggtaaccaagggccaggcagagctgcttcctgtgcctctccggcatttgtaatgtttttttcttttttcacgcactgccaaatctgttttctcccttgaagaaacccagggcagatgtggtcatctgtcaaactgaggtctggagaggcatgactaaatcactgcagaagcaaaatcaggacccagcatttctagctcccagcccagagtaagagagcagagcagaaccccttcccattctacccgaccgaggcagccctgccctgccctgccccgcccctccccaccctgccctgccccagagatctccagttcacagtgttcatcaggcgagatacttttggacccacaaagccagttttttggggggatgctcagtgtctacctgcagtgccaaagttttgcttgaacagccctcttctgccgcgcctcccagctccaccccctatcacgtgggtgctggctgcttctgcgtgaggagcttcctctgatcacctgtagcatctttagtgccttcgtccagtcggcctgcaaatcccatttcccagagaggcttgggcagggcccacttgccacttggccctgtgcccagagcgttgggggcagatggcagccaggggaagaagggaggtggggaagggccgccaccgcttgagggtcccctcccttgagaggaggccccatggcagttttcctgagttcttgatccactttggtttaaacaacttttgtgaagctatgtgagatttgactgcatttcaaaagacaaaacacatgtttttttctgatttgctctttgcctttcagcgacgctttcagatactttgtgagtgtctactctgtgctaggtgctgagtagactgggatgtgtgtggctccatccctggctggaagagctttgagtcctgtctgctgacttcactgaaggagtttctctcttgcttcattccttcctcccgggggtcagctgggtaggagcagacttgccctgccttcctctaggcagaaagttttcctgcaaatgaaagaatctgccattctcttttgctatgatgatgatgattattctgacatgacccgcgggtactgaagccacagtcctctctgttcactgttctctccttgagtcatatctatggcctgaggacgtctgtatccagctccttttcctacaatggtagacacttccccaggcagtgggtgggtcagggtggccagtcactctcctagctgtccttgcctggggacttagatttaccccatccaggactgtggtcgctattctgtgagcgattgatggcgcatatgcagaactcccctggagtcatggctctagaaagtgtccaggcccatcgtgacaatggtgccaagcaccgggctggtgaccagtgcctaaacacacacgctcctttaatccttacggcaagcctgtgaggcggataggaccagccctgatctatagtgagaaaattaaggttcagagggagaaggtccaaatagtggccaagctgggactgagatctcgagtttgggtttgtttggttttgttgttgttgttctttccctcgtgtccatgacttttctctgccattagcagggaagtgtgcggagggcttccagggaatcaagtgaccctccctctgaatttcggtgcctcttccccccgccccttgctcacacatttcagtaggtcacaggccaaatggcagcccaaaaggtgggcagagatttttttttcttcccctcacccctgcttattaacacaattgtgacaactactttaccttacatcccagggcaaacggacagcttgcggtacctccaaaaatttggaaaaccctgagtctaagaccacctcttgataaaagaggcctttgctcacatgttctgctcggaatctttctttgccattggtgggtgtatgtcgtcccagctgagactgcgggagagctgagctccagcttaaaccgcttttaatggcccttccctactgggggatcgctggagcccatgccaggttacggtagtcattttaaacctctgccacaaggccacgccatagaatcaatttccaagtcaatgttcttggccctaaaatgtttgcgcccactgaggatttcattaccaggtggaagatgggggaacatatgccacgttaaagagcaagtgctgagtgtgccaggacttgagaaggaccttaggctgaggagtggacagtctggtatttatttcgcctctcccaagtacccagcacagagtgggaaaaagaagaaactgctcctgccttccagtagctggcaacttgacatcaagaacaaaaacattcgtagctggacccccgtcctttcatcgtgcccaagtcttacatgttggcttaagctgcccccttggaggccgtacctttctctttggactgtgacagtggacacctaacagcctgagccatgtgtggctgtcttatcccccaagggttgtccaggcccgttctgcagggctgttgtgtagactgcagacatccatacctcaccacagaccaaagatgacctcgtgtcagactgtgggctgatgagaggtagagcagcatgcatcgaggcctgagggtgcagggcgccctctcttggcctggaggaattgctcctaactagagtaagtttccacgagggtcccaggcagagctgcagagctggaaccggaggctccacagtccttgcctgctcatggacctccttcagagcacctttctacagactggactgcccagctccgtggggtggcatctggtttctggtgctattctgccaagttatcgagctcctcctcatgtttcaacattccatcttcccgtttctatcctcgactccaaagtaagccttcttagctccaatcagggatgaggggctcaacctcttctgtcctcaaagaggccaaacgcagtgccacagtcggtagccttcacttttagatgtcctattcatgtaaaaaagaaggtgcccccaccaggcttacatcagcaataagcaattctaatgcaacgatggtgtccacattttaccccagtgtgtgcccatgtatgcctttgtgcccgtgtaattattgttagcgcccctttcacttagaggggtgatgataaactgtggccaccttgattacaacccacatttcctgctttggggagcttccaagtaacaggccatttcttacctccctccaggaacagtgggcactgcccaccacctcgtgtctgctcataggatgacgctggagatccccacacttactctaccctcttggcaaattggcattccggtggtggtttttgtttcctttaacacattaaataaatgagtatataggatgtgaggggaggggtgagaacaactagctgtagcatgtgtaggctatatactttaccatttgacttctttcctttttttttttttaaataaaaaaagtgcttgactggtttcaagcttcatcatgaa

SEQ ID NO: 181021 - DNA, 471 bp, Homo sapiens
  Payload ID: 15649
  Gene Symbol: SH3PXD2B
  Gene Name: SH3 and PX domains 2B
  ENST ID: ENST00000518522
  CDS Start-End: 1-245
tgcccgacggtgacgccaagcagagatcaccaaagatgaggcagagaccccctcctcgccgggacatgaccattcctcgaggcctcaacctgccgaagccgcccatcccgccccaagtggaggaagagtattacaccatcgccgaattccagacaaccatcccagacggcatcagcttccaggcaggcctgaaggtcgaggaacagtgggcactgcccaccacctcgtgtctgctcataggatgacgctggagatccccacacttactctaccctcttggcaaattggcattccggtggtggtttttgtttcctttaacacattaaataaatgagtatataggatgtgaggggaggggtgagaacaactagctgtagcatgtgtaggctatatactttaccatttgacttctttcctttttttttttttaaataaaaaaagtgcttgactggtttcaagcttcatcatgaa

SEQ ID NO: 181022 - DNA, 1394 bp, Homo sapiens
  Payload ID: 15649
  Gene Symbol: SH3PXD2B
  Gene Name: SH3 and PX domains 2B
  ENST ID: ENST00000519643
  CDS Start-End: 7-1299
gcggccatgccgccgcggcgcagcatcgtggaggtgaaggtgctagacgtgcagaagcggcgggtgcccaacaagcattatgtctacatcatccgggtcacgtggtccagcggctccaccgaggccatttaccggcgctacagcaagttttttgacctccagatgcagatgttggacaaatttcccatggaaggaggacagaaggaccccaagcagcggatcatcccctttctgccaggtaagattctcttcagacgaagccacatccgggacgtggctgtcaaacgcctgataccaattgatgaatactgtaaggccctcatccagctgcccccctacatctctcagtgtgatgaggtgctgcagttctttgagacaagacctgaggacctgaatccccccaaagaggagcacattgggaaaaagaaatctgggggtgaccaaacctcagtggaccccatggtcctggagcagtatgtggtggtagccaactaccagaagcaggagagttcggagatcagcctcagcgtggggcaggtggtggacatcatcgagaagaatgagtcaggttggtggttcgtcagcactgccgaggagcaaggctgggtccctgcaacgtgcctcgaaggccaggatggggtgcaggatgagttttctctgcagcctgaagaagaggagaagtacacagtcatctacccgtacacagctcgggaccaggatgaaatgaacctggagagaggggctgtggtggaggtcatccagaaaaacctggaaggctggtggaagatcaggtaccagggcaaagaaggctgggcccccgcctcctacctaaagaagaacagtggggagcccttgcccccgaagccaggccctggctcaccctcccacccgggtgcccttgacttggatggtgtttcccggcagcagaacgcggtgggcagggagaaggagctgctcagcagccagagggacgggcggtttgaaggccgcccggtgcccgacggtgacgccaagcagagatcaccaaagatgaggcagagaccccctcctcgccgggacatgaccattcctcgaggcctcaacctgccgaagccgcccatcccgccccaagtggaggaagagtattacaccatcgccgaattccagacaaccatcccagacggcatcagcttccaggcaggcctgaaggtcgaggatcataagaatgttcacttggagagccctgtggaagtccctcttagaagaatcaagatgcggacagcacttgggaagcacgtggcagcttccatggagatgtgagaaccacgtcatgtccttgctgctgtgaacatgaatttgctaaactgcttttactgtatttttttttgtcgtggtaaaatatgcgtaatacaaaa

SEQ ID NO: 181023 - DNA, 1763 bp, Homo sapiens
  Payload ID: 15650
  Gene Symbol: SH3YL1
  Gene Name: SH3 and SYLF domain containing 1
  Uniprot ID: Q96HL8
  ENST ID: ENST00000356150
  CDS Start-End: 82-1110
ctccttgtccgcggggcggggcagcgcgccttcctcttcctgggcagcctcgggacggggcgccgcggccgggcgggcagcatgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgaggtatcagacttggtgataattctgaattatgaccgtgctgtagaagcttttgcaaaaggcggaaatctgaccctcggagggaacttgactgtggcggttgggcccttgggaaggaacttggaaggaaacgtggccctgagaagctccgctgccgtcttcacgtactgcaagtcaaggggactctttgcaggcgtgtctttagaagggagctgtttgattgaaaggaaagaaactaatagaaaattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgctaaagaattacctccaaagccattgtcaagaccacagcagtcatctgcaccagtccagctgaactctggctctcaaagtaacagaaatgaatataagctctatcctggactttccagctatcatgagagagttggcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaaagcgtatactattttcttctttgagaattacaaaaaaattatttctacactgacaggatttactagttaagcaatgtttaatataaattttaaaaaacttctgttctacaaaatttccattccgtatgtaaaagattttgtttttctatataaaaagagctgactgacatatctttaaatactttgtactaactttatcacacttactgtgtcatagaatatcatacagtttatacgctcatagttctcttgtgaacacttcaaacatcgctaagcatttgatctggccatgtatatggtagctgtgttttaatttgagaatcttgagggtagagccacaaatttcaattcttacatttccatttgcaaagtgactagagaaaaagaaatcagcttaaatgaggtattaagtaatgtttagagtcgtaggtattaactagaatataaatccttagaaattgtctttataccttcaaaaattatactatgcatttatcatagaaatgtgattacaaagaagtctgactaccatgtctttaaacatatggcatctctcaacttttcttccttatggggctacatttgttcatttccagcagtagcataaacttacggtgacatggtagacttgtctctaaataaaatttttaaat

SEQ ID NO: 181024 - DNA, 1279 bp, Homo sapiens
  Payload ID: 15650
  Gene Symbol: SH3YL1
  Gene Name: SH3 and SYLF domain containing 1
  Uniprot ID: Q96HL8
  ENST ID: ENST00000403658
  CDS Start-End: 451-1134
agtgcgcctgcggaggcggtcctatgacgtgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgagacacatttacagctacatattccctctgagcattgccctggctgccttccataagtgtggagtgccactccagctttcttaggttgccatctgcatgacacatctttctccatccttttactgtcaatctaatggtatcagacttggtgataattctgaattatgaccgtgctgtagaagcttttgcaaaaggcggaaatctgaccctcggagggaacttgactgtggcggttgggcccttgggaaggaacttggaaggaaacgtggccctgagaagctccgctgccgtcttcacgtactgcaagtcaaggggactctttgcaggcgtgtctttagaagggagctgtttgattgaaaggaaagaaactaatagaaaattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgctaaagaattacctccaaagccattgtcaagaccacagcagtcatctgcaccagtccagctgaactctggctctcaaagcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaaagcgtatactattttcttctttgagaattacaaaaaaattatttctacactgacaggatttactagttaagcaatgtttaatataaattttaaaaaacttctgttctacaaaatttccattccgtatgtaaaagattttgttttt

SEQ ID NO: 181025 - DNA, 2064 bp, Homo sapiens
  Payload ID: 15650
  Gene Symbol: SH3YL1
  Gene Name: SH3 and SYLF domain containing 1
  Uniprot ID: Q96HL8
  ENST ID: ENST00000405430
  CDS Start-End: 378-1406
cgaaggcctgagcgcggcccggcgggcgcgtggtttttgtcccgcgaaacgtacacggcgggtgttttgcgccgcctccttcgtcacctgccgcaggaagtgtggaactggtctcaatcggttgaccaccttaaggaaataggatttacactgtggacagagatgtgtcctttacacttcatttgaaccaatatgcccatgctcctgtggaggctgagttggaaagtgacacgaagctgcccccccgcaagagagcagaaataaggatctggcatgtcaacacaaacataggaagttgaggcagtcaaagggaaataactgctaccctgactctgctgagagcctcacaagtccctgtgcacgccagcttgtttgccatgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgaggtatcagacttggtgataattctgaattatgaccgtgctgtagaagcttttgcaaaaggcggaaatctgaccctcggagggaacttgactgtggcggttgggcccttgggaaggaacttggaaggaaacgtggccctgagaagctccgctgccgtcttcacgtactgcaagtcaaggggactctttgcaggcgtgtctttagaagggagctgtttgattgaaaggaaagaaactaatagaaaattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgctaaagaattacctccaaagccattgtcaagaccacagcagtcatctgcaccagtccagctgaactctggctctcaaagtaacagaaatgaatataagctctatcctggactttccagctatcatgagagagttggcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaaagcgtatactattttcttctttgagaattacaaaaaaattatttctacactgacaggatttactagttaagcaatgtttaatataaattttaaaaaacttctgttctacaaaatttccattccgtatgtaaaagattttgtttttctatataaaaagagctgactgacatatctttaaatactttgtactaactttatcacacttactgtgtcatagaatatcatacagtttatacgctcatagttctcttgtgaacacttcaaacatcgctaagcatttgatctggccatgtatatggtagctgtgttttaatttgagaatcttgagggtagagccacaaatttcaattcttacatttccatttgcaaagtgactagagaaaaagaaatcagcttaaatgaggtattaagtaatgtttagagtcgtaggtattaactagaatataaatccttagaaattgtctttataccttcaaaaattatactatgcatttatcatagaaatgtgattacaaagaagtctgactaccatgtctttaaacatatggcatctctcaacttttcttccttatggggctacatttgttcatttccagcagtagcataaacttacggtgacatggtagacttgtctctaaataaaatttttaaatgttta

SEQ ID NO: 181026 - DNA, 1695 bp, Homo sapiens
  Payload ID: 15650
  Gene Symbol: SH3YL1
  Gene Name: SH3 and SYLF domain containing 1
  Uniprot ID: Q96HL8
  ENST ID: ENST00000403712
  CDS Start-End: 49-1020
ctcttcctgggcagcctcgggacggggcgccgcggccgggcgggcagcatgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgaggtatcagacttggtgataattctgaattatgaccgtgctgtagaagcttttgcaaaaggcggaaatctgaccctcggagggaacttgactgtggcggttgggcccttgggaaggaacttggaaggaaacgtggccctgagaagctccgctgccgtcttcacgtactgcaagtcaaggggactctttgcaggcgtgtctttagaagggagctgtttgattgaaaggaaagaaactaatagaaaattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgctaaagaattacctccaaagccattgtcaagaccacagcagtcatctgcaccagtccagctgaactctggctctcaaagcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaaagcgtatactattttcttctttgagaattacaaaaaaattatttctacactgacaggatttactagttaagcaatgtttaatataaattttaaaaaacttctgttctacaaaatttccattccgtatgtaaaagattttgtttttctatataaaaagagctgactgacatatctttaaatactttgtactaactttatcacacttactgtgtcatagaatatcatacagtttatacgctcatagttctcttgtgaacacttcaaacatcgctaagcatttgatctggccatgtatatggtagctgtgttttaatttgagaatcttgagggtagagccacaaatttcaattcttacatttccatttgcaaagtgactagagaaaaagaaatcagcttaaatgaggtattaagtaatgtttagagtcgtaggtattaactagaatataaatccttagaaattgtctttataccttcaaaaattatactatgcatttatcatagaaatgtgattacaaagaagtctgactaccatgtctttaaacatatggcatctctcaacttttcttccttatggggctacatttgttcatttccagcagtagcataaacttacggtgacatggtagacttgtctctaaataaaatttttaaatgtttactaagttaatatttcaa

SEQ ID NO: 181027 - DNA, 3151 bp, Homo sapiens
  Payload ID: 15650
  Gene Symbol: SH3YL1
  Gene Name: SH3 and SYLF domain containing 1
  Uniprot ID: Q96HL8
  ENST ID: ENST00000402632
  CDS Start-End: 185-529
agtgcgcctgcggaggcggtcctatgacggaaaactttattctcaagagatttctcattccgcagaaataaggatctggcatgtcaacacaaacataggaagttgaggcagtcaaagggaaataactgctaccctgactctgctgagagcctcacaagtccctgtgcacgccagcttgtttgccatgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgagacacatttacagctacatattccctctgagcattgccctggctgccttccataagtgtgggttaccatctggtgtcatttccttactccaagacaactttgctcccacctgactcttttgtacggttattgtctagtatataatatttctatagttacagacttaaaatatagaaaaaatttatttttaaaccaattaagagaaaagagaagaactatgcatttatactattatttatggttagataattatctttactggtgattttttaaagtgtggatttaaattactctctagagtcacttgctttcagcctgaaggactttgtttagaatttataatatttcttgtaaaatggttctactagcaacaaattctctcaacttaaaaaaaaatttttaatctgggaatgtcttcatatccccttcatttttgaaatatacttttgctgattataagattctaagttgaccagttctttctttcagcattttgtcatcctactgttttctgaagtctactgtttttgaagagaaatctatctattattctaattggggttccttttatgtgatgagtcatttttctcttgctcctttccagattttctcttgcattttaagattttttacaattatctatccagagtgttatctttttacatttattctactcagaatttgttgagcttcttgagtgtagatccatgtttttcatcagattgagaattttcagccattatttctttgagaaaattttctgcttctttctctttttccttgccttctagtacttacatcacacatatgttggtgcacctaatggtgtcccaggtttcttgtgtttctgtcaatttttcttcattctctttctcttagtttttaagactttctattattcaaatttaccagttctttattttgcgtgctcagatctaccgttaaacttctctagtaaattgttcatgttgcttaatgtactttttacctccagaatttccatttggttcttttatataattttatgtttttatcaatattctctattcaataagatattctcattgtacgtttttctacttcttaaccatagttttctttaattctttgaacatatttatgacagctgttttaaagtctttgtctgctaaatctgatagctggaccatctgaacagcagtcattctcgtctgcttcctttttaaattttttttctatgtatgggtcacactctcccacttctttgtcttattatttttggttgagaatcagaaattttagatattatattgtatcaactctgggtgctcaacctctccccctaggagcctcttattgtttgcttgctgtttgtttagagatatggctggactgtttgaatgaattctgtgccccactactgtgaagcctccaatgttgtctatgggcatgcatatagttttcctgagatgacaggtgttctgactgtccctgtccgtgacctgtctgttaagctgtttgtctccattggtattacacactgttgttagcctccactaattgcctgctgattgctccattgtttccaacaatgccctggggacataaattgctccacagtttgatccagttaaaattgtgctcctgtgcacaggtagtctttgaggctcatttctatttcaggagggctcttcttagctatctctgtccctggttctccctgataattttctagaccaccaatggtttagcttgttgctgtcatggagctaaatacctcatcttacctgtttatcaccaaaagcatcatttttgacagcacctttgaacttccccaccctgtgttccaaaagctttcacttcccttggggagagctttggagctctctgctcttgcagcctgtctctctgtctgcccaagatctctgtgccgttgctccagagctggaggctggggcagtggctcccttctcttggagtgacatccctgcagccttgggtggtgtagtagcttggcttgcctctgtcagggtggagcttttgccccacaggtgaactggggcaagagtgagtggggtcctggtgctcctggactgttgtgctaggctggagccttcacttacacatgggttctgggtggaggaaggaagctccagacctctcagctgctcttgcctggaatggagcttctgtacaaggagctgtgggaagagaaatgctggcagaagcctctcctgtggatatactgcagccctgaccaggggctgggggaaggaagtctgtgttcttgcaaacccccttccccaagaggagcttccatcaggctgacctgcagcggggcacaggttatagctcaaatgtcaccaactctctcttccttaccaatatttaatagtgttcattgaatcaatgtgtcttcattttcttcacttgccatatgcccttaggacaatttccagaagtgttaatttttaaaataatttttaccagttacggttattttgctgtggagagggtctgtggcctctttatgccaccactgcagtgtcattctgatttgtagatacattctacagtgggatggagattcaactgtaattgttaagttttagctcttcttttgttagttatagaacagtgaacaaagtacttaatcttcctgaatcaaatctgtaaaataaaaaatttttaagttgaa

SEQ ID NO: 181028 - DNA, 3540 bp, Homo sapiens
  Payload ID: 15650
  Gene Symbol: SH3YL1
  Gene Name: SH3 and SYLF domain containing 1
  Uniprot ID: Q96HL8
  ENST ID: ENST00000403657
  CDS Start-End: 2197-2880
aagaggcttcattagtaatgacctgtgtcttcatcagtatgatagaatgggacatcagcactctgatcaggtcatgctctatatgccttatggtacagcagaggaaaaatgggtgagccatcatttgatgctgaggatgggatttgaggcttatgtctaaatttttatttgcatattctttttgttctgacagagaaattcactgcatgtaactatgaccacgcatgattttatcagaagttgattagaatctgtaacattttctgtagttcagctgacacactgaagatgtcctcactgtgaccagccttgtcaacagctggatcacagtgacataagctgtgtctaggatgagtcttgcggtctgcagccgtgtgaggctgcatctgattcccaagtccaatggctctcttcccgtgtttacagatcaggccatgacctttccctacagcaggatgtttgcaagattaactctcaactgaggaatttgcttatttgctctaatactgcttggttgagagagttcaaagtagaaagtcttctgaggggataagattcatgtattatttacagtgcttcagttgcatgtatcagaaaatctagtctaaattgctttaacagaaaaagatgttgctggtccatttgacgaagaagtccagagcggcttgtgacttcagtctggctttgcagagcccaggtgctctctccaccttctgccaggttcccctatgaaggctttgctctcagactctccccttgtggagacaaaaatcccacagcaagtggaaacagaagtgccttggaaaaagttattctggcagctcctatacaagtcccccatcagatgctggtattggaccagctttggttataaagccctgctgtggcaccaaaaggaatgtcgtcctgatacagcagcctcgggtcacccaatccactccagatactatggctgcagcatcaatgtaagcagacaagttgtgctgcctctgaaataaagtagatgaaatattcagcagcagaaagaacaagtttccactccagtgaactaattcaaatgtatccagcatctagatatatgtataaatgtaattaaaacatattgagcatctagagcatctctcccaagataattaccacctgatagtaatggctataaaagctaaaagtggaatcagtctacatgtttcgcaataggaatcaattgaagcatacatcaaaatgcagacagtagtattgatggagtttcgttcttgctgcccaagctggagtgcaatggcgccatctcggctcactgcaacctccaccttccaggttcaagtgattctcctgcctcaggctcctgagtagctgggattacaggcgcacgtcaccacatctggctaattttttgtatttttagtagaaatggggtttcaccatgttagccaggctggtcttgaactcctgacctcaggtgatccccccacctcggcctcccaaattgctgggattacaggtgtgagccaccgtgtccggccataaaacatttttttacaaaaggcttacaaaggaatatttatagcagttttatttgtaatagccaaaagctggaaacaacccaattgtctatcaacagtgactggaaggacaaattgtgctatgtccacacattagaataccagttggcagtcaaaaaggaagagctgatctgtgcagcaatttgagtctcagtaatttcatgtgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgagagactgacgagacacccatgaatgcttccttttctgtaaaatgggacaatgacaggacctgtaaccacacagggttttcctttcaagcacatagatggcacacacgtaatcgagtgccactccagctttcttaggttgccatctgcatgacacatctttctccatccttttactgtcaatctaatggtatcagacttggtgataattctgaattatgaccgtgctgtagaagcttttgcaaaaggcggaaatctgaccctcggagggaacttgactgtggcggttgggcccttgggaaggaacttggaaggaaacgtggccctgagaagctccgctgccgtcttcacgtactgcaagtcaaggggactctttgcaggcgtgtctttagaagggagctgtttgattgaaaggaaagaaactaatagaaaattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgctaaagaattacctccaaagccattgtcaagaccacagcagtcatctgcaccagtccagctgaactctggctctcaaagcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaaagcgtatactattttcttctttgagaattacaaaaaaattatttctacactgacaggatttactagttaagcaatgtttaatataaattttaaaaaacttctgttctacaaaatttccattccgtatgtaaaagattttgtttttctatataaaaagagctgactgacatatctttaaatactttgtactaactttatcacacttactgtgtcatagaatatcatacagtttatacgctcatagttctcttgtgaacacttcaaacatcgctaagcatttgatctggccatgtatatggtagctgtgttttaatttgagaatcttgagggtagagccacaaatttcaattcttacatttccatttgcaaagtgactagagaaaaagaaatcagcttaaatgaggtattaagtaatgtttagagtcgtaggtattaactagaatataaatccttagaaattgtctttataccttcaaaaattatactatgcatttatcatagaaatgtgattacaaagaagtctgactaccatgtctttaaacatatggcatctctcaacttttcttccttatggggctacatttgttcatttccagcagtagcataaacttacggtgacatggtagacttgtctctaaataaaatttttaaatgtttact

SEQ ID NO: 181029 - DNA, 721 bp, Homo sapiens
  Payload ID: 15650
  Gene Symbol: SH3YL1
  Gene Name: SH3 and SYLF domain containing 1
  ENST ID: ENST00000431160
  CDS Start-End: 1-693
aataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgaggtatcagacttggtgataattctgaattatgaccgtgctgtagaagcttttgcaaaaggcggaaatctgaccctcggagggaacttgactgtggcggttgggcccttgggaagattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgctaaagaattacctccaaagccattgtcaagaccacagcagtcatctgcaccagtccagctgaactctggctctcaaagtaaatatttttgttgcaattcaaatacagttgtaattaagtaattattaaatgttatcattaagaaatcaa

SEQ ID NO: 181030 - DNA, 494 bp, Homo sapiens
  Payload ID: 15650
  Gene Symbol: SH3YL1
  Gene Name: SH3 and SYLF domain containing 1
  ENST ID: ENST00000415368
  CDS Start-End: 343-494
agtgcgcctgcggaggcggtcctatgacgtgtggaactggtctcaatcggttgaccaccttaaggaaataggatttacactgtggacagagatgtgtcctttacacttcatttgaaccaatatgcccatgctcctgtggaggctgagttggaaagtgacacgaagctgcccccccgcaagagagcaggaaaactttattctcaagagatttctcattccgcagaaataaggatctggcatgtcaacacaaacataggaagttgaggcagtcaaagggaaataactgctaccctgactctgctgagagcctcacaagtccctgtgcacgccagcttgtttgccatgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtc

SEQ ID NO: 181031 - DNA, 581 bp, Homo sapiens
  Payload ID: 15650
  Gene Symbol: SH3YL1
  Gene Name: SH3 and SYLF domain containing 1
  ENST ID: ENST00000454318
  CDS Start-End: 405-581
gcgcaatcggctccagtgcgcctgcggaggcggtcctatgacgtgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgagagtgccactccagctttcttaggttgccatctgcatgacacatctttctccatccttttactgtcaatctaatggtatcagacttggtgataattctgaattatgaccgtgctgtagaagcttttgcaaaaggcggaaatctgaccctcggagggaacttgactgtggcggttgggcccttgggaaggaacttggaaggaaacgtggccctgagaagctccgctgccgtcttcacgtactgcaagtca

SEQ ID NO: 181032 - DNA, 782 bp, Homo sapiens
  Payload ID: 15650
  Gene Symbol: SH3YL1
  Gene Name: SH3 and SYLF domain containing 1
  ENST ID: ENST00000451005
  CDS Start-End: 1-768
ataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgaggtatcagacttggtgataattctgaattatgaccgtgctgtagaagcttttgcaaaaggcggaaatctgaccctcggagggaacttgactgtggcggttgggcccttgggaagattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgctaaagaattacctccaaagccattgtcaagaccacagcagtcatctgcaccagtccagctgaactctggctctcaaagcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaaagcgtatactattt

SEQ ID NO: 181033 - DNA, 2236 bp, Homo sapiens
  Payload ID: 15650
  Gene Symbol: SH3YL1
  Gene Name: SH3 and SYLF domain containing 1
  ENST ID: ENST00000479739
  CDS Start-End: 1046-1513
taacagaaaaagatgttgctggtccatttgacgaagaagtccagagcggcttgtgacttcagtctggctttgcagagcccaggtgctctctccaccttctgccaggttcccctatgaaggctttgctctcagactctccccttgtggagacaaaaatcccacagcaagtggaaacagaagtgccttggaaaaagttattctggcagctcctatacaagtcccccatcagatgctggtattggaccagctttggttataaagccctgctgtggcaccaaaaggaatgtcgtcctgatacagcagcctcgggtcacccaatccactccagatactatggctgcagcatcaatgtaagcagacaagttgtgctgcctctgaaataaagtagatgaaatattcagcagcagaaagaacaagtttccactccagtgaactaattcaaatgtatccagcatctagatatatgtataaatgtaattaaaacatattgagcatctagagcatctctcccaagataattaccacctgatagtaatggctataaaagctaaaagtggaatcagtctacatgtttcgcaataggaatcaattgaagcatacatcaaaatgcagacagtagtattgtgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgagacacatttacagctacatattccctctgagcattgccctggctgccttccataagtgtggagtgccactccagctttcttaggttgccatctgcatgacacatctttctccatccttttactgtcaatctaatggtatcagacttggtgataattctgaattatgaccgtgctgtagaagcttttgcaaaaggcggaaatctgaccctcggagggaacttgactgtggcggttgggcccttgggaaggaacttggaaggaaacgtggccctgagaagctccgctgccgtcttcacgtactgcaagtcaaggggactctttgcaggcgtgtctttagaagggagctgtttgattgaaaggaaagaaactaatagaaaattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgtaccgtttggttttatgtttcactcagtattctcagaaaatctctttctgtagaacattctgtccctgatatcaggttcctaagaacctactaagcctccttcgtagtttcactgacttcacattcttgtgaaaaggtcatgctaccttgacatttcctctgtacagatttcagggaaaaacataatttgtcctctgtgattgcatttctccaaggatggaactttgttgtatcaataatacaaataatatgtgggaggctgaggcaggtggagcacttgagatcaggagtttcagaccagcctggccaacatggcaaaaccccctctctaccataaaaatagaaacattagctgggcatggtggcgtgtgcccataatctcagctactcaggaggctgaaacaggaggatcgcttgagcccatgaggttgcactgagccaagatcatgccattgcactcagcctaggcaacagagctaaagaattacctccaaagccattgtcaagaccacagcagtcatctgcaccagtccagctgaactctggctctcaaagcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaaagcgtatactattttcttctttgagaattac

SEQ ID NO: 181034 - DNA, 885 bp, Homo sapiens
  Payload ID: 15650
  Gene Symbol: SH3YL1
  Gene Name: SH3 and SYLF domain containing 1
  ENST ID: ENST00000481932
  CDS Start-End: 1-295
agaagcttttgcaaaaggcggaaatctgaccctcggagggaacttgactgtggcggttgggcccttgggaagattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgtaccgtttggttttatgtttcactcagtattctcagaaaatctctttctgtagaacattctgtccctgatatcaggttcctaagaacctactaagcctccttcgtagtttcactgacttcacattcttgtgaaaaggtcatgctaccttgacatttcctctgtacagatttcagggaaaaacataatttgtcctctgtgattgcatttctccaaggatggaactttgttgtatcaataatacaaataatatgtgggaggctgaggcaggtggagcacttgagatcaggagtttcagaccagcctggccaacatggcaaaaccccctctctaccataaaaatagaaacattagctgggcatggtggcgtgtgcccataatctcagctactcaggaggctgaaacaggaggatcgcttgagcccatgaggttgcactgagccaagatcatgccattgcactcagcctaggcaacagagtaagaccttatctcaataataatatatgaataatagttgcagatactgacgcctttgtatgtcaggccttggggcaccgagggatttgtgtgcattgttcatgatgttccacagcacctttcagagttggtatgatgcctgtttcatggaataaaaactgaagccta

SEQ ID NO: 181035 - DNA, 1973 bp, Homo sapiens
  Payload ID: 15650
  Gene Symbol: SH3YL1
  Gene Name: SH3 and SYLF domain containing 1
  Uniprot ID: Q96HL8
  ENST ID: ENST00000626873
  CDS Start-End: 571-1311
gcgggcgcgtggtttctggaaacaacccaattgtctatcaacagtgactggaaggacaaattgtgctatgtccacacattagaataccagttggcagtcaaaaaggaagagctgatctgtgcagcaatttgagtctcagtaatttcatgtgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgagacacatttacagctacatattccctctgagcattgccctggctgccttccataagtgtggagtgccactccagctttcttaggttgccatctgcatgacacatctttctccatccttttactgtcaatctaatggtatcagacttggtgataattctgaattatgaccgtgctgtagaagcttttgcaaaaggcggaaatctgaccctcggagggaacttgactgtggcggttgggcccttgggaaggaacttggaaggaaacgtggccctgagaagctccgctgccgtcttcacgtactgcaagtcaaggggactctttgcaggcgtgtctttagaagggagctgtttgattgaaaggaaagaaactaatagaaaattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgctaaagaattacctccaaagccattgtcaagaccacagcagtcatctgcaccagtccagctgaactctggctctcaaagtaacagaaatgaatataagctctatcctggactttccagctatcatgagagagttggcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaaagcgtatactattttcttctttgagaattacaaaaaaattatttctacactgacaggatttactagttaagcaatgtttaatataaattttaaaaaacttctgttctacaaaatttccattccgtatgtaaaagattttgtttttctatataaaaagagctgactgacatatctttaaatactttgtactaactttatcacacttactgtgtcatagaatatcatacagtttatacgctcatagttctcttgtgaacacttcaaacatcgctaagcatttgatctggccatgtatatggtagctgtgttttaatttgagaatcttgagggtagagccacaaatttcaattcttacatttccatttgcaaagtgactagagaaaaagaaatcagcttaaatgaggtattaagtaatgtttagagtcgtaggtattaactagaatataaatccttagaaattgtctttataccttcaaaaattatactatgcatttatcatagaaatgtgattacaaagaagtctgactaccatgtctttaaacatatggcatctctcaacttttcttccttatggggctacatttgttcatttccagcagtagcataaacttacggtgacatggtagacttgtctctaaataaaatttttaaatgtttactaa

SEQ ID NO: 181036 - DNA, 4226 bp, Homo sapiens
  Payload ID: 15651
  Gene Symbol: SH3TC1
  Gene Name: SH3 domain and tetratricopeptide repeats 1
  Uniprot ID: Q8TE82
  ENST ID: ENST00000245105
  CDS Start-End: 68-4078
ctgtgggcctgggagctgcctctgaggaacacgccgcagggccaggcatgtgaggtctctgcgggtcatggagaacctccctgccgtgaccactgaggagccgacccccatggggaggggtcctgtgggaccctcaggaggtggcagcacccgggaccaggtccggactgtggtcatgaggccctctgtgagctgggagaaagcggggcccgaggaggccaaggcgccagtgagaggcgacgaggctcctcctgcccgcgtggctgggcctgctgctgggacccctccctgccagatgggggtttatcccacagacctgaccctgcagctgctggctgtgcggaggaagagcagactgcgggaccccggcctacagcagaccctccggggccagctccgcctgctggagaatgatagccgggagatggcccgcgtgcttggggaattatcagccaggctgctgtccatccacagtgaccaggaccggatcgtggtgacgtttaagacttttgaagaaatctggaagttttccacctaccatgctctcggcttcactcatcactgcctggcaaacctgctcatggaccaggccttctggctgctcttgcccagtgaggaggaggagacggccatccaagtccatgtggatgagaacgccttaaggctgacccacgagagcctcctcatccaagaagggcccttctttgtcctgtgtcctgaccaccatgtgagagtgatgacgggtccccgggatgcaggaaatggcccccaggccctcaggcaggcttcgggggcaccccagggagaggcggccccggaaacagactcttcaccgccgagccccagcgtgtcctccgaggaggtggcagtggcggccgccccggagcctttgattccatttcatcagtgggctcttaggatcccccaggaccccatcgacgatgccatgggtggccctgtgatgcccggcaacccgctgatggctgtgggcctggcctcggcattggcagacttccagggctcggggcccgaagagatgaccttccgaggtggcgacctcatcgagatccttggggcgcaggtgcccagcctgccctggtgcgtgggccgacacgcagcctcgggccgggtggggtttgtgcggagcagcctcatcagcatgcagggccccgtgtccgagttggaaagtgcgatttttctcaatgaggaagaaaagtcattcttcagcgagggctgcttttctgaggaggatgccaggcagttgctgaggcggatgtcgggcaccgatgtctgcagcgtgtacagcctggactcagtagaggaagctgagaccgagcagccgcaggaaaaagaaatacctccaccttgcctgagcctggagccacaggagaccttgcagaaggtgaagaatgttctggaacaatgcaagacctgcccaggctgcccccaggagccagcgtcctggggtctctgtgcggcatccagcgacgtgagcttgcaggaccccgaggagccctccttctgcttggaagccgaggacgactgggaggacccagaggccctgagctcactgctgctgttcctgaacgcccctgggtacaaggccagcttccgtggcctgtacgatgtggcgctgccgtggctgagcagcgtgttccgcagcttcagcgacgaggaggagctgactgggcgcctggcacaggcccggggggcggccaagaaagctggcctcctcatggccctggccaggctctgcttcctcctggggcggctgtgcagcaggaggctcaagctgtcccaggcccgggtgtactttgaggaagcgctgggggccctggagggcagcttcggggacctgttcctagtggtggctgtgtacgccaacctggccagcatttaccggaagcagaagaaccgggagaagtgtgcacaggtggtgcccaaagccatggccctgctcctggggacgcctgaccacatctgcagcaccgaggcggagggggagctcctgcagctggcgctgcggcgggcggtgggtggccagagcctgcaggccgaggcccgggcctgcttcctgctggccaggcaccacgtgcacctcaagcagcccgaggaggccctgcccttcctagagcggctgctgcttttgcacagggactcgggagccccagaggccgcgtggctctcagactgctacctactcctggctgacatctacagccgcaagtgcctgccccacctggtgctgagctgtgtcaaggtggcctcattgcggacacggggctcgctggccggctcgctgaggagtgtgaacctggtgctccagaacgccccccagccccacagcctccctgcccaaacttcccactacctcaggcaagcgctggcctccctgaccccgggcacaggccaggcgctgcgcggccccctctacaccagcttggcccagctgtacagccaccatggctgccacggcccggccatcaccttcatgacgcaggcagtggaagccagtgctattgccggagtccgtgccatcgtggaccacctggtggccctggcctggctgcacgtgcttcatgggcagagcccggtggccctggacatcctgcagtctgtccgggatgcagtggtggccagcgaggaccaggagggcgtgattgccaacatggtggccgtggctctgaagaggacgggccggacgaggcaggcagctgagagctactaccgcgccctgcgggtggctcgggacctgggccagcaaaggaaccaggcagtggggctggccaacttcggggccctgtgcctgcatgcgggtgccagcaggctggcccagcactacctcctggaggccgtgcggctgttctcgaggctgccccttggggagtgtggccgggacttcacccacgtgctcctgcagctgggccatctctgcacccgccagggcccggcccagcagggcaagggctactacgagtgggcccttctggtcgccgtggagatgggccacgtggagagccagctgcgggccgtccagcggctgtgccacttctacagcgccgtcatgcccagcgaggcccagtgtgtcatctaccatgagctccagctctccctggcctgcaaggtggccgacaaggtgctggaggggcagctcctggagaccatcagccagctctacctgtccctgggcaccgagcgggcctacaaatccgcactggactacaccaaacgaagtctggggattttcattgacctccagaagaaagagaaggaggcgcatgcctggctgcaagcagggaagatctattacatcttgcggcagagcgagctggtggacctctacatccaggtggcacagaacgtggccctgtacacaggcgaccccaacctggggctggagctgtttgaggcggctggagacatcttcttcgacggggcctgggagcgggagaaagctgtgtccttctaccgggaccgggccctgcccctggcagtgactacgggcaaccgcaaggcggagctgcggctgtgcaacaagctggtggcactgctggccacgctggaggagccccaggagggcttggagtttgcccacatggccctagcactcagcatcaccctgggggaccggctgaacgagcgcgtggcctaccaccggctggccgccctgcaacaccgactgggccatggcgagctggcagagcacttctacctcaaggccctgtcgctctgcaactcgccgctggagtttgacgaggagaccctctactacgtgaaggtgtacctggtgctcggtgacatcatcttctacgacctgaaggacccgtttgatgcagccgggtactaccagctggcgctggcagccgccgtggacctgggcaacaagaaggcacagctgaagatctacacgcggctggccaccatctaccacaacttcctcctggaccgtgagaagtcgctcttcttctaccagaaggccaggaccttcgccacagagctcaacgtccgcagggtcaacctgcctcctctgccactctgcgggtgggccccctggttggcccccagccaccctcgctgaggacagcatccaagggagtgggttttgtgcaagggctgggggtctcctgcctctcctggtgtcgccggtggctcattttctggcaaatggaggcacgaacgcaggggccaaatagcaataaatgggttttgttttttttttgcaataa

SEQ ID NO: 181037 - DNA, 829 bp, Homo sapiens
  Payload ID: 15651
  Gene Symbol: SH3TC1
  Gene Name: SH3 domain and tetratricopeptide repeats 1
  ENST ID: ENST00000382521
  CDS Start-End: 71-412
gccctgtgggcctgggagctgcctctgaggaacacgccgcagggccaggcatgtgaggtctctgcgggtcatggagaacctccctgccgtgaccactgaggagccgacccccatggggaggggtcctgtgggaccctcaggaggtggcagcacccgggaccaggtccggactgtggtcatgaggccctctgtgagctgggagaaagcggggcccgaggaggccaaggcgccagtgagaggcggagccactgtgcccgctgagtcacttgagaggccagggcccagctcgtgtttttccagggacgcgtcagtgataacaaaactggcaaagaacgaggcaggggcctttgaacccccatgttcagagaccgttccagaaacagtccgatgggtttggccttggaacccctgagagtcctcaggatgaggcatcctcgttctccaggaggcacccaaggtgcagagagggaagggccgggccaggccaccctgtggtcaggggccgggccaggacgtgtgcccagtttcctgaattcccgggagacctgaagagtgacctaggtgatctccaggatcccctcttacccccatcctgagaccctgaaggggacgaggggagaggcaggggagaccaaggcctgcacggcccctcccggcaggagacagctgcggttgtgacccgtccctgggcctcgtcctcccagtgtccagcctcagcccagtctcctcttagctgcctatgtccctgtcttgggactccagggcttggcacatggtaggtgcttcgtcactgttcaagggattgatgaatgaaggatgtgtttggaca

SEQ ID NO: 181038 - DNA, 617 bp, Homo sapiens
  Payload ID: 15651
  Gene Symbol: SH3TC1
  Gene Name: SH3 domain and tetratricopeptide repeats 1
  ENST ID: ENST00000457650
  CDS Start-End: 335-617
gggcctgggagctgcctctgaggaacacgccgcaggcgacggagcactgttccgggagcacggtctgttgggtgtgacggcccagcaaagaggcagtgaccggctcctgaggaggggcacaaggcacccaggggttctgcctcgacagggaaggggactccaggcagaaaaccagcgagaggaggccccgtggaggaagggagcacagcaaacccgagatagggaggggaggcgcagcagcggtgcgggatcacgcccaccacaacacggtgcacggtgcggtgaggggctcgctggatctgaaagggccaggcatgtgaggtctctgcgggtcatggagaacctccctgccgtgaccactgaggagccgacccccatggggaggggtcctgtgggaccctcaggaggtggcagcacccgggaccaggtccggactgtggtcatgaggccctctgtgagctgggagaaagcggggcccgaggaggccaaggcgccagtgagaggcgacgaggctcctcctgcccgcgtggctgggcctgctgctgggacccctccctgccagatgggggtttatcccacagacctgaccctgcagctgctggctgtgcggaggaaga

SEQ ID NO: 181039 - DNA, 509 bp, Homo sapiens
  Payload ID: 15651
  Gene Symbol: SH3TC1
  Gene Name: SH3 domain and tetratricopeptide repeats 1
  ENST ID: ENST00000509119
  CDS Start-End: 193-509
aaaaatgtgcaccttcttgcctggacagggtgctgggctgtgtggctgtcctgaggaactgtgatagcaacagctgtggccctgcagcaggtggtgggcccgggatccagcctcccctcttcccttccctggcaggacgaggctcctcctgcccgcgtggctgggcctgctgctgggacccctccctgccagatgggggtttatcccacagacctgaccctgcagctgctggctgtgcggaggaagagcagactgcgggaccccggcctacagcagaccctccggggccagctccgcctgctggagaatgatagccgggagatggcccgcgtgcttggggaattatcagccaggctgctgtccatccacagtgaccaggaccggatcgtggtgacgtttaagacttttgaagaaatctggaagttttccacctaccatgctctcggcttcactcatcactgcctggcaaacctgctcatggaccaggccttctggctgctcttgcccag

SEQ ID NO: 181040 - DNA, 1124 bp, Homo sapiens
  Payload ID: 15651
  Gene Symbol: SH3TC1
  Gene Name: SH3 domain and tetratricopeptide repeats 1
  ENST ID: ENST00000511002
  CDS Start-End: 1-304
ccacgtgctcctgcagctgggccatctctgcacccgccagggcccggcccagcagggcaagggctactacgagtgggcccttctggtcgccgtggagatgggccacgtggagagccagctgcgggccgtccagcggctgtgccacttctacagcgccgtcatgcccagcgaggcccagtgtgtcatctaccatgagctccagctctccctggcctgcaaggtggccgacaaggtgctggaggggcagctcctggagaccatcagccagctctacctgtccctgggcaccgagcgggcccagtgacattgctgcactcacaccccttcgactcaccaagagagcagggaaggagccggattccacagggacccgggagatcggctccagccttggcctcaggttcacagcaggaaaatgggccagtgtgttagagccatgttctcaaagtgtggtccctggaccagcagagcagcatccatgtcacctaggagcttgtggcaagtgggagttctagggcccgccccaggcccgtggagccagaagctctgggggcaggccagcaagctatatggacaggcctctggatgactgtgatgcctgcgcaccttgagaaccatcggcctggatagcatctgaacactgatggctcctgggcctacaaatccgcactggactacaccaaacgaagtctggggattttcattgacctccagaagaaagagaaggaggcgcatgcctggctgcaagcagggaagatctattacatcttgcggcagagcgagctggtggacctctacatccaggtggcacagaacgtggccctgtacacaggcgaccccaacctggggctggagctgtttgaggcggctggagacatcttcttcgacggggcctgggagcgggagaaagctgtgtccttctaccgggaccgggccctgcccctggcagtgactacgggcaaccgcaaggcggagctgcggctgtgcaacaagctggtggcactgctggccacgctggaggagccccaggagggcttggagtttgcccacatggccctagcactcagcatcaccctgggggaccggctgaacgagcgcgtggcctaccaccggctggccgccct

SEQ ID NO: 181041 - DNA, 4293 bp, Homo sapiens
  Payload ID: 15651
  Gene Symbol: SH3TC1
  Gene Name: SH3 domain and tetratricopeptide repeats 1
  ENST ID: ENST00000515682
  CDS Start-End: 64-294
gggcctgggagctgcctctgaggaacacgccgcagggccaggcatgtgaggtctctgcgggtcatggagaacctccctgccgtgaccactgaggagccgacccccatggggaggggtcctgtgggaccctcaggaggtggcagcacccgggaccaggtccggactgtggtcatgaggccctctgtgagctgggagaaagcggggcccgaggaggccaaggcgccagtgagaggcgagagacctggagcgtttggcgccttcagaggagccaggcctttgcttggtctcccctaatcctgggaacctgctgtgttgcagacgaggctcctcctgcccgcgtggctgggcctgctgctgggacccctccctgccagatgggggtttatcccacagacctgaccctgcagctgctggctgtgcggaggaagagcagactgcgggaccccggcctacagcagaccctccggggccagctccgcctgctggagaatgatagccgggagatggcccgcgtgcttggggaattatcagccaggctgctgtccatccacagtgaccaggaccggatcgtggtgacgtttaagacttttgaagaaatctggaagttttccacctaccatgctctcggcttcactcatcactgcctggcaaacctgctcatggaccaggccttctggctgctcttgcccagtgaggaggaggagacggccatccaagtccatgtggatgagaacgccttaaggctgacccacgagagcctcctcatccaagaagggcccttctttgtcctgtgtcctgaccaccatgtgagagtgatgacgggtccccgggatgcaggaaatggcccccaggccctcaggcaggcttcgggggcaccccagggagaggcggccccggaaacagactcttcaccgccgagccccagcgtgtcctccgaggaggtggcagtggcggccgccccggagcctttgattccatttcatcagtgggctcttaggatcccccaggaccccatcgacgatgccatgggtggccctgtgatgcccggcaacccgctgatggctgtgggcctggcctcggcattggcagacttccagggctcggggcccgaagagatgaccttccgaggtggcgacctcatcgagatccttggggcgcaggtgcccagcctgccctggtgcgtgggccgacacgcagcctcgggccgggtggggtttgtgcggagcagcctcatcagcatgcagggccccgtgtccgagttggaaagtgcgatttttctcaatgaggaagaaaagtcattcttcagcgagggctgcttttctgaggaggatgccaggcagttgctgaggcggatgtcgggcaccgatgtctgcagcgtgtacagcctggactcagtagaggaagctgagaccgagcagccgcaggaaaaagaaatacctccaccttgcctgagcctggagccacaggagaccttgcagaaggtgaagaatgttctggaacaatgcaagacctgcccaggctgcccccaggagccagcgtcctggggtctctgtgcggcatccagcgacgtgagcttgcaggaccccgaggagccctccttctgcttggaagccgaggacgactgggaggacccagaggccctgagctcactgctgctgttcctgaacgcccctgggtacaaggccagcttccgtggcctgtacgatgtggcgctgccgtggctgagcagcgtgttccgcagcttcagcgacgaggaggagctgactgggcgcctggcacaggcccggggggcggccaagaaagctggcctcctcatggccctggccaggctctgcttcctcctggggcggctgtgcagcaggaggctcaagctgtcccaggcccgggtgtactttgaggaagcgctgggggccctggagggcagcttcggggacctgttcctagtggtggctgtgtacgccaacctggccagcatttaccggaagcagaagaaccgggagaagtgtgcacaggtggtgcccaaagccatggccctgctcctggggacgcctgaccacatctgcagcaccgaggcggagggggagctcctgcagctggcgctgcggcgggcggtgggtggccagagcctgcaggccgaggcccgggcctgcttcctgctggccaggcaccacgtgcacctcaagcagcccgaggaggccctgcccttcctagagcggctgctgcttttgcacagggactcgggagccccagaggccgcgtggctctcagactgctacctactcctggctgacatctacagccgcaagtgcctgccccacctggtgctgagctgtgtcaaggtggcctcattgcggacacggggctcgctggccggctcgctgaggagtgtgaacctggtgctccagaacgccccccagccccacagcctccctgcccaaacttcccactacctcaggcaagcgctggcctccctgaccccgggcacaggccaggcgctgcgcggccccctctacaccagcttggcccagctgtacagccaccatggctgccacggcccggccatcaccttcatgacgcaggcagtggaagccagtgctattgccggagtccgtgccatcgtggaccacctggtggccctggcctggctgcacgtgcttcatgggcagagcccggtggccctggacatcctgcagtctgtccgggatgcagtggtggccagcgaggaccaggagggcgtgattgccaacatggtggccgtggctctgaagaggacgggccggacgaggcaggcagctgagagctactaccgcgccctgcgggtggctcgggacctgggccagcaaaggaaccaggcagtggggctggccaacttcggggccctgtgcctgcatgcgggtgccagcaggctggcccagcactacctcctggaggccgtgcggctgttctcgaggctgccccttggggagtgtggccgggacttcacccacgtgctcctgcagctgggccatctctgcacccgccagggcccggcccagcagggcaagggctactacgagtgggcccttctggtcgccgtggagatgggccacgtggagagccagctgcgggccgtccagcggctgtgccacttctacagcgccgtcatgcccagcgaggcccagtgtgtcatctaccatgagctccagctctccctggcctgcaaggtggccgacaaggtgctggaggggcagctcctggagaccatcagccagctctacctgtccctgggcaccgagcgggcctacaaatccgcactggactacaccaaacgaagtctggggattttcattgacctccagaagaaagagaaggaggcgcatgcctggctgcaagcagggaagatctattacatcttgcggcagagcgagctggtggacctctacatccaggtggcacagaacgtggccctgtacacaggcgaccccaacctggggctggagctgtttgaggcggctggagacatcttcttcgacggggcctgggagcgggagaaagctgtgtccttctaccgggaccgggccctgcccctggcagtgactacgggcaaccgcaaggcggagctgcggctgtgcaacaagctggtggcactgctggccacgctggaggagccccaggagggcttggagtttgcccacatggccctagcactcagcatcaccctgggggaccggctgaacgagcgcgtggcctaccaccggctggccgccctgcaacaccgactgggccatggcgagctggcagagcacttctacctcaaggccctgtcgctctgcaactcgccgctggagtttgacgaggagaccctctactacgtgaaggtgtacctggtgctcggtgacatcatcttctacgacctgaaggacccgtttgatgcagccgggtactaccagctggcgctggcagccgccgtggacctgggcaacaagaaggcacagctgaagatctacacgcggctggccaccatctaccacaacttcctcctggaccgtgagaagtcgctcttcttctaccagaaggccaggaccttcgccacagagctcaacgtccgcagggtcaacctgcctcctctgccactctgcgggtgggccccctggttggcccccagccaccctcgctgaggacagcatccaagggagtgggttttgtgcaagggctgggggtctcctgcctctcctggtgtcgccggtggctcattttctggcaaatggaggcacgaacgcaggggccaaatagcaataaatgggttttgttttt

SEQ ID NO: 181042 - DNA, 3484 bp, Homo sapiens
  Payload ID: 15651
  Gene Symbol: SH3TC1
  Gene Name: SH3 domain and tetratricopeptide repeats 1
  ENST ID: ENST00000502669
  CDS Start-End: 131-739
agccccgtggggccagccagcgctgggccaggagcggccacctggttcctgcgtgctacggccctgtgggcctgggagctgcctctgaggaacacgccgcagggccaggcatgtgaggtctctgcgggtcatggagaacctccctgccgtgaccactgaggagccgacccccatggggaggggtcctgtgggaccctcaggaggtggcagcacccgggaccaggtccggactgtggtcatgaggccctctgtgagctgggagaaagcggggcccgaggaggccaaggcgccagtgagaggcgacctgaccctgcagctgctggctgtgcggaggaagagcagactgcgggaccccggcctacagcagaccctccggggccagctccgcctgctggagaatgatagccgggagatggcccgcgtgcttggggaattatcagccaggctgctgtccatccacagtgaccaggaccggatcgtggtgacgtttaagacttttgaagaaatctggaagttttccacctaccatgctctcggcttcactcatcactgcctggcaaacctgctcatggaccaggccttctggctgctcttgcccagtgaggaggaggagacggccatccaagtccatgtggatgagaacgccttaaggctgacccacgagagcctcctcatccaagaaggtgggctcttaggatcccccaggaccccatcgacgatgccatgggtggccctgtgatgcccggcaacccgctgatggctgtgggcctggcctcggcattggcagacttccagggctcggggcccgaagagatgaccttccgaggtggcgacctcatcgagatccttggggcgcaggtgcccagcctgccctggtgcgtgggccgacacgcagcctcgggccgggtggggtttgtgcggagcagcctcatcagcatgcagggccccgtgtccgagttggaaagtgcgatttttctcaatgaggaagaaaagtcattcttcagcgagggctgcttttctgaggaggatgccaggcagttgctgaggcggatgtcgggcaccgatgtctgcagcgtgtacagcctggactcagtagaggaagctgagaccgagcagccgcaggaaaaagaaatacctccaccttgcctgagcctggagccacaggagaccttgcagaaggtgaagaatgttctggaacaatgcaagacctgcccaggctgcccccaggagccagcgtcctggggtctctgtgcggcatccagcgacgtgagcttgcaggaccccgaggagccctccttctgcttggaagccgaggacgactgggaggacccagaggccctgagctcactgctgctgttcctgaacgcccctgggtacaaggccagcttccgtggcctgtacgatgtggcgctgccgtggctgagcagcgtgttccgcagcttcagcgacgaggaggagctgactgggcgcctggcacaggcccggggggcggccaagaaagctggcctcctcatggccctggccaggctctgcttcctcctggggcggctgtgcagcaggaggctcaagctgtcccaggcccgggtgtactttgaggaagcgctgggggccctggagggcagcttcggggacctgttcctagtggtggctgtgtacgccaacctggccagcatttaccggaagcagaagaaccgggagaagtgtgcacaggtggtgcccaaagccatggccctgctcctggggacgcctgaccacatctgcagcaccgaggcggagggggagctcctgcagctggcgctgcggcgggcggtgggtggccagagcctgcaggccgaggcccgggcctgcttcctgctggccaggcaccacgtgcacctcaagcagcccgaggaggccctgcccttcctagagcggctgctgcttttgcacagggactcgggagccccagaggccgcgtggctctcagactgctacctactcctggctgacatctacagccgcaagtgcctgccccacctggtgctgagctgtgtcaaggtggcctcattgcggacacggggctcgctggccggctcgctgaggagtgtgaacctggtgctccagaacgccccccagccccacagcctccctgcccaaacttcccactacctcaggcaagcgctggcctccctgaccccgggcacaggccaggcgctgcgcggccccctctacaccagcttggcccagctgtacagccaccatggctgccacggcccggccatcaccttcatgacgcaggcagtggaagccagtgctattgccggagtccgtgccatcgtggaccacctggtggccctggcctggctgcacgtgcttcatgggcagagcccggtggccctggacatcctgcagtctgtccgggatgcagtggtggccagcgaggaccaggagggcgtgattgccaacatggtggccgtggctctgaagaggacgggccggacgaggcaggcagctgagagctactaccgcgccctgcgggtggctcgggacctgggccagcaaaggaaccaggcagtggggctggccaacttcggggccctgtgcctgcatgcgggtgccagcaggctggcccagcactacctcctggaggccgtgcggctgttctcgaggctgccccttggggagtgtggccgggacttcacccacgtgctcctgcagctgggccatctctgcacccgccagggcccggcccagcagggcaagggctactacgagtgggcccttctggtcgccgtggagatgggccacgtggagagccagctgcgggccgtccagcggctgtgccacttctacagcgccgtcatgcccagcgaggcccagtgtgtcatctaccatgagctccagctctccctggcctgcaaggtggccgacaaggtgctggaggggcagctcctggagaccatcagccagctctacctgtccctgggcaccgagcgggcctacaaatccgcactggactacaccaaacgaagtctggggattttcattgacctccagaagaaagagaaggaggcgcatgcctggctgcaagcagggaagatctattacatcttgcggcagagcgagctggtggacctctacatccaggtggcacagaacgtggccctgtacacaggcgaccccaacctggggctggagctgtttgaggcggctggagacatcttcttcgacggggcctgggagcgggagaaagctgtgtccttctaccgggggaccggctgaacgagcgcgtggcctaccaccggctggccgccctgcaacaccgactgggccatggcgagctggcagagcacttctacctcaaggccctgtcgctctgcaactcgccgctggagtttgacgaggagaccctctactacgtgaaggtgtacctggtgctcggtgacatcatcttctacgacctgaaggacccgtttgatgcagccgggtactaccagctggcgct

SEQ ID NO: 181043 - DNA, 551 bp, Homo sapiens
  Payload ID: 15651
  Gene Symbol: SH3TC1
  Gene Name: SH3 domain and tetratricopeptide repeats 1
  ENST ID: ENST00000508641
  CDS Start-End: 1-551
catgtggatgagaacgccttaaggctgacccacgagagcctcctcatccaagaagggcccttctttgtcctgtgtcctgaccaccatgtgagagtgatgacgggtccccgggatgcaggaaatggcccccaggccctcaggcaggcttcgggggcaccccagggagaggcggccccggaaacagactcttcaccgccgagccccagcgtgtcctccgaggaggtggcagtggcggccgccccggagcctttgattccatttcatcagtgggctcttaggatcccccaggaccccatcgacgatgccatgggtggccctgtgatgcccggcaacccgctgatggctgtgggcctggcctcggcattggcagacttccagggctcggggcccgaagagatgaccttccgaggtggcgacctcatcgagatccttggggcgcaggtgcccagcctgccctggttggaaagtgcgatttttctcaatgaggaagaaaagtcattcttcagcgagggctgcttttctgaggaggatgccaggcagttgctgaggcg

SEQ ID NO: 181044 - DNA, 558 bp, Homo sapiens
  Payload ID: 15651
  Gene Symbol: SH3TC1
  Gene Name: SH3 domain and tetratricopeptide repeats 1
  ENST ID: ENST00000507891
  CDS Start-End: 1-77
ccacctaccatgctctcgaacttgagggaagctgccgtccagtggcctcagtgctgaccgggaaagctgttatttgaaagctgacccacgcttcactcatcactgcctggcaaacctgctcatggaccaggccttctggctgctcttgcccagtgaggaggaggagacggccatccaagtccatgtggatgagaacgccttaaggctgacccacgagagcctcctcatccaagaagggcccttctttgtcctgtgtcctgaccaccatgtgagagtgatgacgggtccccgggatgcaggaaatggcccccaggccctcaggcaggcttcgggggcaccccagggagaggcggccccggaaacagactcttcaccgccgagccccagcgtgtcctccgaggaggtggcagtggcggccgccccggagcctttgattccatttcatcagtgggctcttaggatcccccaggaccccatcgacgatgccatgggtggccctgtgatgcccggcaacccgctgatggctgtgggcctggcctcggcattggcagacttcca

SEQ ID NO: 181045 - DNA, 514 bp, Homo sapiens
  Payload ID: 15651
  Gene Symbol: SH3TC1
  Gene Name: SH3 domain and tetratricopeptide repeats 1
  ENST ID: ENST00000512966
  CDS Start-End: 1-124
ctaccagaaggccaggaccttcgccacagagctcaacgtccgcagggtcaacctgcctcctctgccactctgcgggccactgtgcgcggaggtgggggctgctagtgcccccattcgccagtgaagaaatagagacacagagaggttaactgtctggcccaccatcacacagacgcagagcccagtgcgctgaccacaccaccctgccggcctgctgccaggaaggtgcccccattaggacccaaggtcagttcctgcacctctcttgtggtgtcaggagagccacagggcggtgagggtggcccaggggatcccccactaagtgtcctctggtcccagacttggctgggctgagcctgaccagtcccacctccagccactggtcagtcctgtgggaagtgagatgcagggatctctgcctgtgtagacgctgctgcccagtgttgaaagccttttctgggctgcccctcagccctccccatgtacccctccccttccggcccccggccctcat

SEQ ID NO: 181046 - DNA, 7324 bp, Homo sapiens
  Payload ID: 15652
  Gene Symbol: SH3TC2
  Gene Name: SH3 domain and tetratricopeptide repeats 2
  ENST ID: ENST00000323829
  CDS Start-End: 23-706
gccagggtaggatggtacacacatgggtggctgcttctgcatccccagggagcggagtctgacccggggcccaggtaaagaaactccttccaaggatccaactgtatcgagtgagtgtatagcctcatctgaatacaaggaaaaatgttttctgccacagaacattaatccagacctgacactctccttctgtgtaaagagccgctccaggaggtgtgtaaatggacccctacaggaagctgctcggaggcggctctgggcactggagaatgaggaccaggaggtgcgcatgctgtttaaggacctctcagcaaggttggtcagtatccagtctcagagggcccagtttctcatcaccttcaagaccatggaggaaatctggaagttctccacctaccttaatttaggctacgtatccatgtgtctagaacatctcctctttgaccacaagtactggctcaactgcatattggtggaggatacagagatccaagtgtctgtagatgataaacacctggaaacaatatacctgggactcctgatacaggaaggccacttcttctgcagagccctgtgctccgtgactccaccagccgagaaggaaggggaatgcttgacactttgcaagaatgagttaatctcagtgaagatggcagaagctggctccgagttggaaggcgtgtctttggtgacaggtggttcctaaagaattatccaggaagctgtggcctttccaggaagagggattggacaggctcctatcagattggcagaggacgctgtaaggccttgacgggttatgagccaggagaaaaggatgaactgaatttctaccagggagaaagcattgagatcatcggctttgtcatacctgggcttcagtggttcattggaaagtcgacaagttcaggacaagtgggctttgtccccaccaggaacatagatcctgattcttattccccaatgacttggtgtgtttcttcaatatgaagattcatgtctttcttcaattctggaaaattttcagtccttcttcctttgaatattgcctctctctcgttctttttagtctctcttctggaattcctattagaggagcaggaactctgcctttctcagtgatgaggagagatgctccctgttggccctgggaagtgataagcagactgagtgttccagcttcctccacactcttgctcgcactgacatcacatctgtctaccggctcagtgggtttgaatccatccagaatcctccaaatgatctgagtgcatcccagcctgaaggtttcaaggaggtcaggcctggcagagcctgggaggagcatcaggccgtggggtccagacagtccagcagctctgaggactccagcctggaggaggagctcctctcggccacctcagacagctatcgcctgccggagcctgatgaccttgatgacccggaactgctcatggacctaagcactggtcaggaggaggaggctgagaacttcgcccccatattggcttttctggatcatgagggttatgctgaccactttaagagtctctatgacttctccttctctttcctcacttcttccttttatagcttctctgaggaggatgagtttgtggcctacctggaggcatcaagaaagtgggccaagaagagccacatgacctgggcccatgcccgtctctgcttcctcctgggccggctgagcatcaggaaggtcaaactctctcaggccagggtgtacttcgaggaggccatccacattctcaatggagcatttgaggacctatccttggtggccactctgtacatcaatttggctgccatctacctgaaacagaggctgagacataaaggctccgccctgttggaaaaggcaggtgccctgctggcctgcctgcctgaccgtgagtctagtgccaagcatgaactcgacgtggtggcctacgtgctgcgccaggggattgtggtgggcagcagcccgctggaggccagggcctgctttctggccatccgcttgctcctgagcctaggccggcacgaggaggtcctgccctttgccgagcgcctgcagctcctctctggacaccctcctgcctctgaggctgtggccagtgttttgagttttctgtatgacaagaaatatcttccacaccttgcagtggcctctgtccagcaacatggtatccagagtgcccaagggatgtctcttcctatttggcaggtccaccttgtcctccagaacacaaccaagctccttggctttccttccccaggctggggtgaagtttctgccttggcctgcccaatgctcagacaggccctggctgcctgtgaggaactagcagaccggagcacccagagggccctgtgtctcatcctttccaaagtgtacctcgagcacaggtctcctgacggtgccatccactacctgagccaggccttggtgctagggcagctgctgggtgagcaggaatcctttgagtcttctctctgcctggcatgggcctatctcttagccagccaggccaagaaggctttggatgtgcttgagccactgctatgctccctgaaggagacagagagtctcactcaaaggggagtcatctataacctcctgggacttgcactccaaggtgaaggccgggtgaacagggcagccaagagctatcttcgggccttgaacagagcccaggaggtgggagatgtgcataaccaggcagtggctatggccaatcttggccacctgagccttaagtcctgggctcagcatccagccagaaactatctcctgcaggctgtacgactctattgtgaacttcaggccagtaaggagacagacatggaattagtacaggtgtttctctggttggcccaagttctggtgtctggacaccagctgacccatggccttctttgttatgaaatggcattgctgtttggcttaaggcatcgacatctaaagagtcagcttcaggccaccaaatccctctgccatttctacagctctgtgtccccaaaccctgaggcatgcatcacctaccatgagcactggctggccctggctcagcaactcagggaccgggagatggaagggaggctgctggagtccctggggcagctttatcggaacctaaataccgccaggtccctcaggaggtcactcacatgcatcaaggagagcctgcgtatcttcattgacctgggggagacagacaaggctgctgaggcctggcttggggcggggcgactccactacctcatgcaggaagacgagctggtggagctgtgcctgcaggcagccatccagacagccctgaagtcagaggagcctttgctggctctcaaactttatgaagaagcaggtgatgtgttcttcaatgggacccgccacaggcatcatgcagtggagtactaccgagctggagctgttcctttagcaaggaggttgaaggcggtgagaactgagctccggattttcaataagctgacagagctgcagattagcctcgaaggctatgagaaggctttggaatttgccaccctggccgccaggctcagcacagtcacaggagatcagaggcaagagctggtggcctttcaccgcctggctacagtgtactactccctgcacatgtatgagatggctgaggactgctacctgaagaccctgtccctctgtccaccatggctgcagagtcccaaggaggccctgtactatgccaaggtgtattatcgcctgggcagactcaccttctgccagctgaaggatgcccatgatgccactgagtacttccttctggccctggcagcagcggtcctgctgggtgatgaggagcttcaggacaccattaggagcaggctggacaacatctgccagagccccctgtggcacagcaggccctccgggtgctcctcagagagggcgcggtggctgagtggtggtggcctggccctctgaggaaagctgtcctgtctctggacatttggcatggccagactctgaccccactgccctaggctcttaaatactcattgggagggtccgagtccttacctggcctagccccctcatttcacaagaagaagaatgaagtccaggaggagaagggctcattgcaggccacagaaagatttgatggtgcagcgatgagaattcctggttccaggctttgcatctggagcctttaccggttgactgttgccttccacacaaacagcctctgaaaagcactttctccatacataattctggagaagatgagggatcttgccctccaggagccttccttcctcccccaatgaggaaatcagtcactgcactggtgcaaaggcaagcagattggaatttgtgctcttcaccgattttctcagggaaagaccccttccccttgccagcagaggaacctgtagttttttccatttctttcttcagaaccaaagtatgtatcactcctcatgctcacagggattgacaggagagaattcaccaggatcttagctcaaaagacacagcctcagaatggccagatggattgcacgaaacctgacttggattcaccatcttcctcctgccataaggctgtgctcccacataacctcccagaagctccagggaagctttccaagagcaaaggcttggaaattgaatgttaagaaaattatgacataaattacatgtaaatagtgtatatgattaaatattgtccagttacatttacacacacattttgtctcatccacaatgggggcagatgagatggaggacttgatggatgggagagaataccaatacatgtcttttttttttttttttttttttgagacagtttctcctctgttgcccaggctggagttcagtggtacagtcagggcttcctgcgacctcagactccggggctcaagtgatcctccagtgtcaacctcctgagtagctggaactacaggcatgtgccatacccaactacaaggcatcttattgatttcagggcagctgctttacaaagcatctctattaataacatcactgcatagcacactgagtggcctaaaacacttataatctcatggtttctgaagggcaggaatccaagcatgacttagctgagcccaccagcttagggtggttcacaggctgcaatcagctggggctgcagttatctcaacttcaactagagaaggatgggcttccaagctcacccacacagctgttgttaggagtcagttttttgctagctgttggccagaggcttcctgcagccacttgccacgtgggcctctccacagggcagtcacaacatggcaccatgcttcactagagggagcaaacaagaggagcaagaaccagagtgagcaggagaaaagggagtgactctttctataacctgatcacagaagtgacatctccttagtcttgcctattcaattcataataaatgagtcactaggtctagctcccacaagaggggagtgtttaccaacagcttgaataccagatggtgaggaatcattggggatcatttcagaagtgacctaccacagtatctgagttctttgataatgaaattgggaattctctaatttcagcaaactgaaaatatggtccactaaccagcagcatcagcatcacctgtgagattgtttgaaatgaaaatctgtggccccacctatgatctctgaatcagaatctctggatcccagaacgctgactcgtccaagctttcctggtgattttaatgcaccctaaagtatgggaagcaccactgcagggcaagagccctcagatagtgtgcataactattacctggtgaggttgtggaacatgaacttcttggtttctatctctaataattctgattcagtagatctgggatgtatcccaggaacatgcatttttagaaagcaactcaagcaagcctgatgcaggtggttcacccttgctccttttctgtgaaccacaaggataccagccataattccctgcatctgatgcccatcagcttagcttttattatcagaccatctgcccttaatttctagcttcttgggctgaccagatgattggttgtatgaaagggtgagatgggagtggtgagttgagccgccattgcatcttctagtcatcaaggttgtctactaattggcacacattttctcttagagatgtggttggttgtcaaaaggctgtctactctagagagtattctccaggaaggagaagcttccagttgtctaattagtaaagttatctaatctactaccatggagaatagatgtggttttgcccccaccacaagctgtaaaagccccaagctgggagggacgttgcggttgaggctattcagtctaatctcccgtgcatagtcctttcaacaacattcctgggagacagtcaggggcacacacattccagaacagttacatatcgtgtatttgaagaaggctcacacagccctggaaaccatgccactggccattccccatctgactcaggttacagatcccctcccttttcccactgaccactcactctcctctggccagatttgtttctgtttctctgaaagagcagttcccacaactgcatgaggcttttgatattggccggtgggtgaagagtacagagggatgttactatacttaatttgattcttcctctccccagcagccacatctgtccttggcttccattgagctttataatcagttgaaacttctgtgtcttctgacttgaacttctgtttggacagatctttctcaattgctgcaaatatgcacatgcatttgcatatgcatacacatacacacacatacgtgaagagcgttgtttctatccatgttacatctccttggaaattttagctaaaatttcccaattctgtgcactttgatttacctataaatctgatgaatttacccataaccaggtcagttataaaaatgtttagcatgtttccaaagacaagggtaagactatttttttaaaataagaaaaacattgtgctatataattgcaattactacattctatatgtaaaccgcttgctaaaactcttttaaaaagtgtttaaaattttcatttttgaaatgtgggccagctattccctttggaaacatgttgatgctgtctttttttcatgatccacagagagtaaagtggtgattggatttggtctctacttaaacatttaaaaaaataagtgtatcatagccaaacatgatctagttaccctctttattctaattgttccctcaaatcttatatgggctgtgtgactgctggctccttacatctaatctaaataaagaacaagaagggcattgc

SEQ ID NO: 181047 - DNA, 2681 bp, Homo sapiens
  Payload ID: 15652
  Gene Symbol: SH3TC2
  Gene Name: SH3 domain and tetratricopeptide repeats 2
  Uniprot ID: Q8TF17
  ENST ID: ENST00000502274
  CDS Start-End: 1471-1923
attatccatgtaacagccatagcacaatcctgggtacatggtaagtccttggtaagtgttgcctgtgccacactattattatattacaggtgctgttgttccccaagtgtaaagtaaatgatattttattctcttcataagctatgttcccattgcaaaaggactgtgccctgaattttaaattagttaatttttagttaaaagtgcattttcccatgaagctaaaatgtaaatgaaggtcaggttcccattaccctaactcagaacatagctgaatatcttgtgtttatgtcaaaagctagtgggaaacaataatagtcatcagaacagataaatggcagaataaaaaagatttaaaaacccctcatcttgaatgttggtgtttgaagaaaagcaggtttgatagagaagccttgattagatgtaagggtaaatgtaatattctgtgatgattccaggagggtcttctgggcattttcaagggcatcgggtgtggatgataccggactttattttgtctaattgcattcttgagagagccttccctcttttccctacctttttccttattgcataggatctcatctgagtgactgtgtgctaatctcaggaaaggccttggaggccccaggcagttcctctgagcactctttatccctcactggatgggagctgaagggaggttgtatgcatcctttatataagtacttcccctgtggctgatttttccatatcagagaattttctctctcttagattttcttttttaattttggcttttggctctttgaagcttaaaagtgatgtttttagatggtatcccacagccaccttgcaaatattccaaagacatgattgtaagcctttgttccctgtaaaagattgctctgtattaaaacaaatccaccaaacaacaagtcatagacccgttagaaaccagcattctaaagcatggtttaagtgtgaacaggtgtttgtagcttatctgagactgacagtaggtaaaggggccaaggagagactgctacatggtggtacccaagataattctctgaagagagagacttttgtgtgaggaagacatttattatacagagtgatttattgcaattcttagctactccatcaagctagacttgtcaccatgtcccattaaaagggtttaagaagaattctttctcagaatcctgcattacagtagcatctgcaataaggagaaaattttcttctgggaatcactccaggaaaccttgacccatcctctacttagtcactcttatagagccctgcattttcttttgtagcatttatgacatgtgtaatgttacatttgtttgtgggattatttaaggaatgtctgtcatgtgagacaataagctttatgagtacaggcacctcttctgtcttatttcctatgccccagcacagtccctgacatctagtagaccttcaaaaagttttatggaatgaatgagtgaacaaatgatgcaaagtgttggttgcaggatatctctctcagtcttccaattcttaggagatcagaggcaagagctggtggcctttcaccgcctggctacagtgtactactccctgcacatgtatgagatggctgaggactgctacctgaagaccctgtccctctgtccaccatggctgcagagtcccaaggaggccctgtactatgccaaggtgtattatcgcctgggcagactcaccttctgccagctgaaggatgcccatgatgccactgagtacttccttctggccctggcagcagcggtcctgctgggtgatgaggagcttcaggacaccattaggagcaggctggacaacatctgccagagccccctgtggcacagcaggccctccgggtgctcctcagagagggcgcggtggctgagtggtggtggcctggccctctgaggaaagctgtcctgtctctggacatttggcatggccagactctgaccccactgccctaggctcttaaatactcattgggagggtccgagtccttacctggcctagccccctcatttcacaagaagaagaatgaagtccaggaggagaagggctcattgcaggccacagaaagatttgatggtgcagcgatgagaattcctggttccaggctttgcatctggagcctttaccggttgactgttgccttccacacaaacagcctctgaaaagcactttctccatacataattctggagaagatgagggatcttgccctccaggagccttccttcctcccccaatgaggaaatcagtcactgcactggtgcaaaggcaagcagattggaatttgtgctcttcaccgattttctcagggaaagaccccttccccttgccagcagaggaacctgtagttttttccatttctttcttcagaaccaaagtatgtatcactcctcatgctcacagggattgacaggagagaattcaccaggatcttagctcaaaagacacagcctcagaatggccagatggattgcacgaaacctgacttggattcaccatcttcctcctgccataaggctgtgctcccacataacctcccagaagctccagggaagctttccaagagcaaaggcttggaaattgaatgttaagaaaattatgacataaattacatgtaaatagtgtatatgattaaatattgtccagttacattt

SEQ ID NO: 181048 - DNA, 3276 bp, Homo sapiens
  Payload ID: 15652
  Gene Symbol: SH3TC2
  Gene Name: SH3 domain and tetratricopeptide repeats 2
  ENST ID: ENST00000511307
  CDS Start-End: 41-328
gtgttcccaagggcctcggccagggtaggatggtacacacatgggtggctgcttctgcatccccagggagcggagtctgacccggggcccaggtaaagaaactccttccaaggatccaactgtatcgagtgagtgtatagcctcatctgaatacaaggaaaaatgttttctgccacagaacattaatccagacctgacactctccttctgtgtaaagagccgctccaggaggtgtgtaaatggacccctacaggaagctgctcggaggcggctctgggcactggagaatgaggaccaggaggtgcgcatgctgtttaaggtattataaaaaaaccaggccgggtgcggtggctcacgcctgtaatcccagcactttgggaggccaaggacctctcagcaaggttggtcagtatccagtctcagagggcccagtttctcatcaccttcaagaccatggaggaaatctggaagttctccacctaccttaatttaggctacgtatccatgtgtctagaacatctcctctttgaccacaagtactggctcaactgcatattggtggaggatacagagatccaagtgtctgtagatgataaacacctggaaacaatatacctgggactcctgatacaggaaggccacttcttctgcagagccctgtgctccgtgactccaccagccgagaaggaaggggaatgcttgacactttgcaagaatgagttaatctcagtgaagatggcagaagctggctccgagttggaaggcgtgtctttggtgacaggtcagcggggcctggtactggtgtcagccttggagcctctgcctctccctttccaccagtggttcctaaagaattatccaggaagctgtggcctttccaggaagagggattggacaggctcctatcagattggcagaggacgctgtaaggccttgacgggttatgagccaggagaaaaggatgaactgaatttctaccagggagaaagcattgagatcatcggctttgtcatacctgggcttcagtggttcattggaaagtcgacaagttcaggacaagtgggctttgtccccaccaggaacatagatcctgattcttattccccaatgagcaggaactctgcctttctcagtgatgaggagagatgctccctgttggccctgggaagtgataagcagactgagtgttccagcttcctccacactcttgctcgcactgacatcacatctgtctaccggctcagtgggtttgaatccatccagaatcctccaaatgatctgagtgcatcccagcctgaaggtttcaaggaggtcaggcctggcagagcctgggaggagcatcaggccgtggggtccagacagtccagcagctctgaggactccagcctggaggaggagctcctctcggccacctcagacagctatcgcctgccggagcctgatgaccttgatgacccggaactgctcatggacctaagcactggtcaggaggaggaggctgagaacttcgcccccatattggcttttctggatcatgagggttatgctgaccactttaagagtctctatgacttctccttctctttcctcacttcttccttttatagcttctctgaggaggatgagtttgtggcctacctggaggcatcaagaaagtgggccaagaagagccacatgacctgggcccatgcccgtctctgcttcctcctgggccggctgagcatcaggaaggtcaaactctctcaggccagggtgtacttcgaggaggccatccacattctcaatggagcatttgaggacctatccttggtggccactctgtacatcaatttggctgccatctacctgaaacagaggctgagacataaaggctccgccctgttggaaaaggcaggtgccctgctggcctgcctgcctgaccgtgagtctagtgccaagcatgaactcgacgtggtggcctacgtgctgcgccaggggattgtggtgggcagcagcccgctggaggccagggcctgctttctggccatccgcttgctcctgagcctaggccggcacgaggaggtcctgccctttgccgagcgcctgcagctcctctctggacaccctcctgcctctgaggctgtggccagtgttttgagttttctgtatgacaagaaatatcttccacaccttgcagtggcctctgtccagcaacatggtatccagagtgcccaagggatgtctcttcctatttggcaggtccaccttgtcctccagaacacaaccaagctccttggctttccttccccaggctggggtgaagtttctgccttggcctgcccaatgctcagacaggccctggctgcctgtgaggaactagcagaccggagcacccagagggccctgtgtctcatcctttccaaagtgtacctcgagcacaggtctcctgacggtgccatccactacctgagccaggccttggtgctagggcagctgctgggtgagcaggaatcctttgagtcttctctctgcctggcatgggcctatctcttagccagccaggccaagaaggctttggatgtgcttgagccactgctatgctccctgaaggagacagagagtctcactcaaaggggagtcatctataacctcctgggacttgcactccaaggtgaaggccgggtgaacagggcagccaagagctatcttcgggccttgaacagagcccaggaggtgggagatgtgcataaccaggcagtggctatggccaatcttggccacctgagccttaagtcctgggctcagcatccagccagaaactatctcctgcaggctgtacgactctattgtgaacttcaggccagtaaggagacagacatggaattagtacaggtgtttctctggttggcccaagttctggtgtctggacaccagctgacccatggccttctttgttatgaaatggcattgctgtttggcttaaggcatcgacatctaaagagtaagtatgtcccatgctgctgggaagctatagagaaaagtgttggatcaagttttatccatttcctatctcaagtcatctcattcatgtccctgctttgtgttcaggtcagcttcaggccaccaaatccctctgccatttctacagctctgtgtccccaaaccctgaggcatgcatcacctaccatgagcactggctggccctggctcagcaactcagggaccgggagatggaagggaggctgctggagtccctggggcagctttatcggaacctaaataccgccaggtgagtca

SEQ ID NO: 181049 - DNA, 4153 bp, Homo sapiens
  Payload ID: 15652
  Gene Symbol: SH3TC2
  Gene Name: SH3 domain and tetratricopeptide repeats 2
  ENST ID: ENST00000504517
  CDS Start-End: 1-426
tgcaagaatgagttaatctcagtgaagatggcagaagctggctccgagttggaaggcgtgtctttggtgacaggtcagcggggcctggtactggtgtcagccttggagcctctgcctctccctttccaccagtggttcctaaagaattatccaggaagctgtggcctttccaggaagagggattggacaggctcctatcagattggcagaggacgctgtaaggccttgacgggttatgagccaggagaaaaggatgaactgaatttctaccagggagaaagcattgagatcatcggctttgtcatacctgggcttcagtggttcattggaaagtcgacaagttcaggacaagtgggctttgtccccaccaggaacatagatcctgattcttattccccaatgacttggtgtgtttcttcaatatgaagattcatgtctttcttcaattctggaaaattttcagtccttcttcctttgaatattgcctctctctcgttctttttagtctctcttctggaattcctattagaggagcaggaactctgcctttctcagtgatgaggagagatgctccctgttggccctgggaagtgataagcagactgagtgttccagcttcctccacactcttgctcgcactgacatcacatctgtctaccggctcagtgggtttgaatccatccagaatcctccaaatgatctgagtgcatcccagcctgaaggtttcaaggaggtcaggcctggcagagcctgggaggagcatcaggccgtggggtccagacagtccagcagctctgaggactccagcctggaggaggagctcctctcggccacctcagacagctatcgcctgccggagcctgatgaccttgatgacccggaactgctcatggacctaagcactggtcaggaggaggaggctgagaacttcgcccccatattggcttttctggatcatgagggttatgctgaccactttaagagtctctatgacttctccttctctttcctcacttcttccttttatagcttctctgaggaggatgagtttgtggcctacctggaggcatcaagaaagtgggccaagaagagccacatgacctgggcccatgcccgtctctgcttcctcctgggccggctgagcatcaggaaggtcaaactctctcaggccagggtgtacttcgaggaggccatccacattctcaatggagcatttgaggacctatccttggtggccactctgtacatcaatttggctgccatctacctgaaacagaggctgagacataaaggctccgccctgttggaaaaggcaggtgccctgctggcctgcctgcctgaccgtgagtctagtgccaagcatgaactcgacgtggtggcctacgtgctgcgccaggggattgtggtgggcagcagcccgctggaggccagggcctgctttctggccatccgcttgctcctgagcctaggccggcacgaggaggtcctgccctttgccgagcgcctgcagctcctctctggacaccctcctgcctctgaggctgtggccagtgttttgagttttctgtatgacaagaaatatcttccacaccttgcagtggcctctgtccagcaacatggtatccagagtgcccaagggatgtctcttcctatttggcaggtccaccttgtcctccagaacacaaccaagctccttggctttccttccccaggctggggtgaagtttctgccttggcctgcccaatgctcagacaggccctggctgcctgtgaggaactagcagaccggagcacccagagggccctgtgtctcatcctttccaaagtgtacctcgagcacaggtctcctgacggtgccatccactacctgagccaggccttggtgctagggcagctgctgggtgagcaggaatcctttgagtcttctctctgcctggcatgggcctatctcttagccagccaggccaagaaggctttggatgtgcttgagccactgctatgctccctgaaggagacagagagtctcactcaaaggggagtcatctataacctcctgggacttgcactccaaggtgaaggccgggtgaacagggcagccaagagctatcttcgggccttgaacagagcccaggaggtgggagatgtgcataaccaggcagtggctatggccaatcttggccacctgagccttaagtcctgggctcagcatccagccagaaactatctcctgcaggctgtacgactctattgtgaacttcaggccagtaaggagacagacatggaattagtacaggtgtttctctggttggcccaagttctggtgtctggacaccagctgacccatggccttctttgttatgaaatggcattgctgtttggcttaaggcatcgacatctaaagagtcagcttcaggccaccaaatccctctgccatttctacagctctgtgtccccaaaccctgaggcatgcatcacctaccatgagcactggctggccctggctcagcaactcagggaccgggagatggaagggaggctgctggagtccctggggcagctttatcggaacctaaataccgccaggtccctcaggaggtcactcacatgcatcaaggagagcctgcgtatcttcattgacctgggggagacagacaaggctgctgaggcctggcttggggcggggcgactccactacctcatgcaggaagacgagctggtggagctgtgcctgcaggcagccatccagacagccctgaagtcagaggagcctttgctggctctcaaactttatgaagaagcaggtgatgtgttcttcaatgggacccgccacaggcatcatgcagtggagtactaccgagctggagctgttcctttagcaaggaggttgaaggcggtgagaactgagctccggattttcaataagctgacagagctgcagattagcctcgaaggctatgagaaggctttggaatttgccaccctggccgccaggctcagcacagtcacagaggcaagagctggtggcctttcaccgcctggctacagtgtactactccctgcacatgtatgagatggctgaggactgctacctgaagaccctgtccctctgtccaccatggctgcagagtcccaaggaggccctgtactatgccaaggtgtattatcgcctgggcagactcaccttctgccagctgaaggatgcccatgatgccactgagtacttccttctggccctggcagcagcggtcctgctgggtgatgaggagcttcaggacaccattaggagcaggctggacaacatctgccagagccccctgtggcacagcaggccctccgggtgctcctcagagagggcgcggtggctgagtggtggtggcctggccctctgaggaaagctgtcctgtctctggacatttggcatggccagactctgaccccactgccctaggctcttaaatactcattgggagggtccgagtccttacctggcctagccccctcatttcacaagaagaagaatgaagtccaggaggagaagggctcattgcaggccacagaaagatttgatggtgcagcgatgagaattcctggttccaggctttgcatctggagcctttaccggttgactgttgccttccacacaaacagcctctgaaaagcactttctccatacataattctggagaagatgagggatcttgccctccaggagccttccttcctcccccaatgaggaaatcagtcactgcactggtgcaaaggcaagcagattggaatttgtgctcttcaccgattttctcagggaaagaccccttccccttgccagcagaggaacctgtagttttttccatttctttcttcagaaccaaagtatgtatcactcctcatgctcacagggattgacaggagagaattcaccaggatcttagctcaaaagacacagcctcagaatggccagatggattgcacgaaacctgacttggattcaccatcttcctcctgccataaggctgtgctcccacataacctcccagaagctccagggaagctttccaagagcaaaggcttggaaattgaatgttaagaaaattatgacataaattacatgtaaatagtgtatatgattaaatattgtccagttacatttacacac

SEQ ID NO: 181050 - DNA, 4002 bp, Homo sapiens
  Payload ID: 15652
  Gene Symbol: SH3TC2
  Gene Name: SH3 domain and tetratricopeptide repeats 2
  Uniprot ID: Q8TF17
  ENST ID: ENST00000512049
  CDS Start-End: 68-3913
ctgtcccttgcagcactcttctggcctgtgttcccaagggcctcggccagggtaggatggtacacacatgggtggctgcttctgcatccccagggagcggagtctgacccggggcccaggtaaagaaactccttccaaggatccaactgtatcgagtgagtgtatagcctcatctgaatacaaggaaaaatgttttctgccacagaacattaatccagacctgacactctccttctgtgtaaagagccgctccaggaggtgtgtaaatggacccctacaggaagctgctcggaggcggctctgggcactggagaatgaggaccaggaggtgcgcatgctgtttaaggacctctcagcaaggttggtcagtatccagtctcagagggcccagtttctcatcaccttcaagaccatggaggaaatctggaagttctccacctaccttaatttagaacatctcctctttgaccacaagtactggctcaactgcatattggtggaggatacagagatccaagtgtctgtagatgataaacacctggaaacaatatacctgggactcctgatacaggaaggccacttcttctgcagagccctgtgctccgtgactccaccagccgagaaggaaggggaatgcttgacactttgcaagaatgagttaatctcagtgaagatggcagaagctggctccgagttggaaggcgtgtctttggtgacaggtcagcggggcctggtactggtgtcagccttggagcctctgcctctccctttccaccagtggttcctaaagaattatccaggaagctgtggcctttccaggaagagggattggacaggctcctatcagattggcagaggacgctgtaaggccttgacgggttatgagccaggagaaaaggatgaactgaatttctaccagggagaaagcattgagatcatcggctttgtcatacctgggcttcagtggttcattggaaagtcgacaagttcaggacaagtgggctttgtccccaccaggaacatagatcctgattcttattccccaatgagcaggaactctgcctttctcagtgatgaggagagatgctccctgttggccctgggaagtgataagcagactgagtgttccagcttcctccacactcttgctcgcactgacatcacatctgtctaccggctcagtgggtttgaatccatccagaatcctccaaatgatctgagtgcatcccagcctgaaggtttcaaggaggtcaggcctggcagagcctgggaggagcatcaggccgtggggtccagacagtccagcagctctgaggactccagcctggaggaggagctcctctcggccacctcagacagctatcgcctgccggagcctgatgaccttgatgacccggaactgctcatggacctaagcactggtcaggaggaggaggctgagaacttcgcccccatattggcttttctggatcatgagggttatgctgaccactttaagagtctctatgacttctccttctctttcctcacttcttccttttatagcttctctgaggaggatgagtttgtggcctacctggaggcatcaagaaagtgggccaagaagagccacatgacctgggcccatgcccgtctctgcttcctcctgggccggctgagcatcaggaaggtcaaactctctcaggccagggtgtacttcgaggaggccatccacattctcaatggagcatttgaggacctatccttggtggccactctgtacatcaatttggctgccatctacctgaaacagaggctgagacataaaggctccgccctgttggaaaaggcaggtgccctgctggcctgcctgcctgaccgtgagtctagtgccaagcatgaactcgacgtggtggcctacgtgctgcgccaggggattgtggtgggcagcagcccgctggaggccagggcctgctttctggccatccgcttgctcctgagcctaggccggcacgaggaggtcctgccctttgccgagcgcctgcagctcctctctggacaccctcctgcctctgaggctgtggccagtgttttgagttttctgtatgacaagaaatatcttccacaccttgcagtggcctctgtccagcaacatggtatccagagtgcccaagggatgtctcttcctatttggcaggtccaccttgtcctccagaacacaaccaagctccttggctttccttccccaggctggggtgaagtttctgccttggcctgcccaatgctcagacaggccctggctgcctgtgaggaactagcagaccggagcacccagagggccctgtgtctcatcctttccaaagtgtacctcgagcacaggtctcctgacggtgccatccactacctgagccaggccttggtgctagggcagctgctgggtgagcaggaatcctttgagtcttctctctgcctggcatgggcctatctcttagccagccaggccaagaaggctttggatgtgcttgagccactgctatgctccctgaaggagacagagagtctcactcaaaggggagtcatctataacctcctgggacttgcactccaaggtgaaggccgggtgaacagggcagccaagagctatcttcgggccttgaacagagcccaggaggtgggagatgtgcataaccaggcagtggctatggccaatcttggccacctgagccttaagtcctgggctcagcatccagccagaaactatctcctgcaggctgtacgactctattgtgaacttcaggccagtaaggagacagacatggaattagtacaggtgtttctctggttggcccaagttctggtgtctggacaccagctgacccatggccttctttgttatgaaatggcattgctgtttggcttaaggcatcgacatctaaagagtcagcttcaggccaccaaatccctctgccatttctacagctctgtgtccccaaaccctgaggcatgcatcacctaccatgagcactggctggccctggctcagcaactcagggaccgggagatggaagggaggctgctggagtccctggggcagctttatcggaacctaaataccgccaggtccctcaggaggtcactcacatgcatcaaggagagcctgcgtatcttcattgacctgggggagacagacaaggctgctgaggcctggcttggggcggggcgactccactacctcatgcaggaagacgagctggtggagctgtgcctgcaggcagccatccagacagccctgaagtcagaggagcctttgctggctctcaaactttatgaagaagcaggtgatgtgttcttcaatgggacccgccacaggcatcatgcagtggagtactaccgagctggagctgttcctttagcaaggaggttgaaggcggtgagaactgagctccggattttcaataagctgacagagctgcagattagcctcgaaggctatgagaaggctttggaatttgccaccctggccgccaggctcagcacagtcacaggagatcagaggcaagagctggtggcctttcaccgcctggctacagtgtactactccctgcacatgtatgagatggctgaggactgctacctgaagaccctgtccctctgtccaccatggctgcagagtcccaaggaggccctgtactatgccaaggtgtattatcgcctgggcagactcaccttctgccagctgaaggatgcccatgatgccactgagtacttccttctggccctggcagcagcggtcctgctgggtgatgaggagcttcaggacaccattaggagcaggctggacaacatctgccagagccccctgtggcacagcaggccctccgggtgctcctcagagagggcgcggtggctgagtggtggtggcctggccctctgaggaaagctgtcctgtctctggacatttggcatggccagactctgaccccactgccctaggctcttaaatactcattgggagggtccgag

SEQ ID NO: 181051 - DNA, 4051 bp, Homo sapiens
  Payload ID: 15652
  Gene Symbol: SH3TC2
  Gene Name: SH3 domain and tetratricopeptide repeats 2
  ENST ID: ENST00000513604
  CDS Start-End: 26-709
tcggccagggtaggatggtacacacatgggtggctgcttctgcatccccagggagcggagtctgacccggggcccaggtaaagaaactccttccaaggatccaactgtatcgagtgagtgtatagcctcatctgaatacaaggaaaaatgttttctgccacagaacattaatccagacctgacactctccttctgtgtaaagagccgctccaggaggtgtgtaaatggacccctacaggaagctgctcggaggcggctctgggcactggagaatgaggaccaggaggtgcgcatgctgtttaaggacctctcagcaaggttggtcagtatccagtctcagagggcccagtttctcatcaccttcaagaccatggaggaaatctggaagttctccacctaccttaatttaggctacgtatccatgtgtctagaacatctcctctttgaccacaagtactggctcaactgcatattggtggaggatacagagatccaagtgtctgtagatgataaacacctggaaacaatatacctgggactcctgatacaggaaggccacttcttctgcagagccctgtgctccgtgactccaccagccgagaaggaaggggaatgcttgacactttgcaagaatgagttaatctcagtgaagatggcagaagctggctccgagttggaaggcgtgtctttggtgacaggtggttcctaaagaattatccaggaagctgtggcctttccaggaagagggattggacaggctcctatcagattggcagaggacgctgtaaggccttgacgggttatgagccaggagaaaaggatgaactgaatttctaccagggagaaagcattgagatcatcggctttgtcatacctgggcttcagtggttcattggaaagtcgacaagttcaggacaagtgggctttgtccccaccaggaacatagatcctgattcttattccccaatgacttggtgtgtttcttcaatatgaagattcatgtctttcttcaattctggaaaattttcagtccttcttcctttgaatattgcctctctctcgttctttttagtctctcttctggaattcctattagaggagcaggaactctgcctttctcagtgatgaggagagatgctccctgttggccctgggaagtgataagcagactgagtgttccagcttcctccacactcttgctcgcactgacatcacatctgtctaccggctcagtgggtttgaatccatccagaatcctccaaatgatctgagtgcatcccagcctgaaggtttcaaggaggtcaggcctggcagagcctgggaggagcatcaggccgtggggtccagacagtccagcagctctgaggactccagcctggaggaggagctcctctcggccacctcagacagctatcgcctgccggagcctgatgaccttgatgacccggaactgctcatggacctaagcactggtcaggaggaggaggctgagaacttcgcccccatattggcttttctggatcatgagggttatgctgaccactttaagagtctctatgacttctccttctctttcctcacttcttccttttatagcttctctgaggaggatgagtttgtggcctacctggaggcatcaagaaagtgggccaagaagagccacatgacctgggcccatgcccgtctctgcttcctcctgggccggctgagcatcaggaaggtcaaactctctcaggccagggtgtacttcgaggaggccatccacattctcaatggagcatttgaggacctatccttggtggccactctgtacatcaatttggctgccatctacctgaaacagaggctgagacataaaggctccgccctgttggaaaaggcaggtgccctgctggcctgcctgcctgaccgtgagtctagtgccaagcatgaactcgacgtggtggcctacgtgctgcgccaggggattgtggtgggcagcagcccgctggaggccagggcctgctttctggccatccgcttgctcctgagcctaggccggcacgaggaggtcctgccctttgccgagcgcctgcagctcctctctggacaccctcctgcctctgaggctgtggccagtgttttgagttttctgtatgacaagaaatatcttccacaccttgcagtggcctctgtccagcaacatggtatccagagtgcccaagggatgtctcttcctatttggcaggtccaccttgtcctccagaacacaaccaagctccttggctttccttccccaggctggggtgaagtttctgccttggcctgcccaatgctcagacaggccctggctgcctgtgaggaactagcagaccggagcacccagagggccctgtgtctcatcctttccaaagtgtacctcgagcacaggtctcctgacggtgccatccactacctgagccaggccttggtgctagggcagctgctgggtgagcaggaatcctttgagtcttctctctgcctggcatgggcctatctcttagccagccaggccaagaaggctttggatgtgcttgagccactgctatgctccctgaaggagacagagagtctcactcaaaggggagtcatctataacctcctgggacttgcactccaaggtgaaggccgggtgaacagggcagccaagagctatcttcgggccttgaacagagcccaggaggtgggagatgtgcataaccaggcagtggctatggccaatcttggccacctgagccttaagtcctgggctcagcatccagccagaaactatctcctgcaggctgtacgactctattgtgaacttcaggccagtaaggagacagacatggaattagtacaggtgtttctctggttggcccaagttctggtgtctggacaccagctgacccatggccttctttgttatgaaatggcattgctgtttggcttaaggcatcgacatctaaagagtaagtatgtcccatgctgctgggaagctatagagaaaagtgttggatcaagttttatccatttcctatctcaagtcatctcattcatgtccctgctttgtgttcaggtcagcttcaggccaccaaatccctctgccatttctacagctctgtgtccccaaaccctgaggcatgcatcacctaccatgagcactggctggccctggctcagcaactcagggaccgggagatggaagggaggctgctggagtccctggggcagctttatcggaacctaaataccgccaggtgagtcagggtcaggaactgtcctagaagcagctttccttccttaaggagaaacagtgttctttcccacaggaagcaagtccaaatgtacatggtataggcggggctttgtgcaaaagagcaagggctctgcagccaccacaatgcatccatcacttattagtggtgtagccttgggcaagctatttaatttctccatgtctcagtttcctcatcagccaaaggaagataataatggcatctatcttatagtgttattgtgaaggataaatgagttaatgctcataaaacactcataactgtgcctgatacatagataggtctcagtaatgccactgttacttgtgtgtttctataaccacctgtcacaggatcatgactgaggctgcataattcagagaagtggcagttataccaaggacagaagaaccttcaggaggtcttcattgccaagggcaactggttttaaagaaaggtcacccccactgaaagcaggggtgtaaaatgtcatggtaaaaaaaagttttatcgggaacttacctttaaaatgaaattgtagattatgaaatgaagtgtgttttcaccttttagttaagaatatttagattacaatttcaactttgcattaagtcttagaataaacatggaataaaaggagtgttgactttttggcttaattgtgctgacaaaatgatgtaacagcacaatggagcattctttgttttgtgattgattttttaggactaccttaaaaatcctcatttttgtaaaaataaatcaaaacttaacagttt

SEQ ID NO: 181052 - DNA, 4059 bp, Homo sapiens
  Payload ID: 15652
  Gene Symbol: SH3TC2
  Gene Name: SH3 domain and tetratricopeptide repeats 2
  Uniprot ID: Q8TF17
  ENST ID: ENST00000515425
  CDS Start-End: 103-3969
agggaggaggcgggaggagggacaccgttgggaggctgtcccttgcagcactcttctggcctgtgttcccaagggcctcggccagggtaggatggtacacacatgggtggctgcttctgcatccccagggagcggagtctgacccggggcccaggtaaagaaactccttccaaggatccaactgtatcgagtgagtgtatagcctcatctgaatacaaggaaaaatgttttctgccacagaacattaatccagacctgacactctccttctgtgtaaagagccgctccaggaggtgtgtaaatggacccctacaggaagctgctcggaggcggctctgggcactggagaatgaggaccaggaggtgcgcatgctgtttaaggacctctcagcaaggttggtcagtatccagtctcagagggcccagtttctcatcaccttcaagaccatggaggaaatctggaagttctccacctaccttaatttaggctacgtatccatgtgtctagaacatctcctctttgaccacaagtactggctcaactgcatattggtggaggatacagagatccaagtgtctgtagatgataaacacctggaaacaatatacctgggactcctgatacaggaaggccacttcttctgcagagccctgtgctccgtgactccaccagccgagaaggaaggggaatgcttgacactttgcaagaatgagttaatctcagtgaagatggcagaagctggctccgagttggaaggcgtgtctttggtgacaggtcagcggggcctggtactggtgtcagccttggagcctctgcctctccctttccaccagtggttcctaaagaattatccaggaagctgtggcctttccaggaagagggattggacaggctcctatcagattggcagaggacgctgtaaggccttgacgggttatgagccaggagaaaaggatgaactgaatttctaccagggagaaagcattgagatcatcggctttgtcatacctgggcttcagtggttcattggaaagtcgacaagttcaggacaagtgggctttgtccccaccaggaacatagatcctgattcttattccccaatgagcaggaactctgcctttctcagtgatgaggagagatgctccctgttggccctgggaagtgataagcagactgagtgttccagcttcctccacactcttgctcgcactgacatcacatctgtctaccggctcagtgggtttgaatccatccagaatcctccaaatgatctgagtgcatcccagcctgaaggtttcaaggaggtcaggcctggcagagcctgggaggagcatcaggccgtggggtccagacagtccagcagctctgaggactccagcctggaggaggagctcctctcggccacctcagacagctatcgcctgccggagcctgatgaccttgatgacccggaactgctcatggacctaagcactggtcaggaggaggaggctgagaacttcgcccccatattggcttttctggatcatgagggttatgctgaccactttaagagtctctatgacttctccttctctttcctcacttcttccttttatagcttctctgaggaggatgagtttgtggcctacctggaggcatcaagaaagtgggccaagaagagccacatgacctgggcccatgcccgtctctgcttcctcctgggccggctgagcatcaggaaggtcaaactctctcaggccagggtgtacttcgaggaggccatccacattctcaatggagcatttgaggacctatccttggtggccactctgtacatcaatttggctgccatctacctgaaacagaggctgagacataaaggctccgccctgttggaaaaggcaggtgccctgctggcctgcctgcctgaccgtgagtctagtgccaagcatgaactcgacgtggtggcctacgtgctgcgccaggggattgtggtgggcagcagcccgctggaggccagggcctgctttctggccatccgcttgctcctgagcctaggccggcacgaggaggtcctgccctttgccgagcgcctgcagctcctctctggacaccctcctgcctctgaggctgtggccagtgttttgagttttctgtatgacaagaaatatcttccacaccttgcagtggcctctgtccagcaacatggtatccagagtgcccaagggatgtctcttcctatttggcaggtccaccttgtcctccagaacacaaccaagctccttggctttccttccccaggctggggtgaagtttctgccttggcctgcccaatgctcagacaggccctggctgcctgtgaggaactagcagaccggagcacccagagggccctgtgtctcatcctttccaaagtgtacctcgagcacaggtctcctgacggtgccatccactacctgagccaggccttggtgctagggcagctgctgggtgagcaggaatcctttgagtcttctctctgcctggcatgggcctatctcttagccagccaggccaagaaggctttggatgtgcttgagccactgctatgctccctgaaggagacagagagtctcactcaaaggggagtcatctataacctcctgggacttgcactccaaggtgaaggccgggtgaacagggcagccaagagctatcttcgggccttgaacagagcccaggaggtgggagatgtgcataaccaggcagtggctatggccaatcttggccacctgagccttaagtcctgggctcagcatccagccagaaactatctcctgcaggctgtacgactctattgtgaacttcaggccagtaaggagacagacatggaattagtacaggtgtttctctggttggcccaagttctggtgtctggacaccagctgacccatggccttctttgttatgaaatggcattgctgtttggcttaaggcatcgacatctaaagagtcagcttcaggccaccaaatccctctgccatttctacagctctgtgtccccaaaccctgaggcatgcatcacctaccatgagcactggctggccctggctcagcaactcagggaccgggagatggaagggaggctgctggagtccctggggcagctttatcggaacctaaataccgccaggtccctcaggaggtcactcacatgcatcaaggagagcctgcgtatcttcattgacctgggggagacagacaaggctgctgaggcctggcttggggcggggcgactccactacctcatgcaggaagacgagctggtggagctgtgcctgcaggcagccatccagacagccctgaagtcagaggagcctttgctggctctcaaactttatgaagaagcaggtgatgtgttcttcaatgggacccgccacaggcatcatgcagtggagtactaccgagctggagctgttcctttagcaaggaggttgaaggcggtgagaactgagctccggattttcaataagctgacagagctgcagattagcctcgaaggctatgagaaggctttggaatttgccaccctggccgccaggctcagcacagtcacaggagatcagaggcaagagctggtggcctttcaccgcctggctacagtgtactactccctgcacatgtatgagatggctgaggactgctacctgaagaccctgtccctctgtccaccatggctgcagagtcccaaggaggccctgtactatgccaaggtgtattatcgcctgggcagactcaccttctgccagctgaaggatgcccatgatgccactgagtacttccttctggccctggcagcagcggtcctgctgggtgatgaggagcttcaggacaccattaggagcaggctggacaacatctgccagagccccctgtggcacagcaggccctccgggtgctcctcagagagggcgcggtggctgagtggtggtggcctggccctctgaggaaagctgtcctgtctctggacatttggcatggccagactctgaccccactgccctaggctcttaaatactcattgggagggtccgagt

SEQ ID NO: 181053 - DNA, 3077 bp, Homo sapiens
  Payload ID: 15652
  Gene Symbol: SH3TC2
  Gene Name: SH3 domain and tetratricopeptide repeats 2
  ENST ID: ENST00000510779
  CDS Start-End: 1-113
ctgagtgttccagcttcctccacactcttgctcgcactgacatcacatctgtctaccggctcagtgggtttgaatccatccagaatcctccaaatgatctgagtggtgagtagcgatcatgctgaacctgacattcatccttgaggacagcacttctgtcctcttgccaagagcggccaccttaggtgcaggtgcccaaggttgctcaactttgcctgtccttacagcatcccagcctgaaggtttcaaggaggtcaggcctggcagagcctgggaggagcatcaggccgtggggtccagacagtccagcagctctgaggactccagcctggaggaggagctcctctcggccacctcagacagctatcgcctgccggagcctgatgaccttgatgacccggaactgctcatggacctaagcactggtcaggaggaggaggctgagaacttcgcccccatattggcttttctggatcatgagggttatgctgaccactttaagagtctctatgacttctccttctctttcctcacttcttccttttatagcttctctgaggaggatgagtttgtggcctacctggaggcatcaagaaagtgggccaagaagagccacatgacctgggcccatgcccgtctctgcttcctcctgggccggctgagcatcaggaaggtcaaactctctcaggccagggtgtacttcgaggaggccatccacattctcaatggagcatttgaggacctatccttggtggccactctgtacatcaatttggctgccatctacctgaaacagaggctgagacataaaggctccgccctgttggaaaaggcaggtgccctgctggcctgcctgcctgaccgtgagtctagtgccaagcatgaactcgacgtggtggcctacgtgctgcgccaggggattgtggtgggcagcagcccgctggaggccagggcctgctttctggccatccgcttgctcctgagcctaggccggcacgaggaggtcctgccctttgccgagcgcctgcagctcctctctggacaccctcctgcctctgaggctgtggccagtgttttgagttttctgtatgacaagaaatatcttccacaccttgcagtggcctctgtccagcaacatggtatccagagtgcccaagggatgtctcttcctatttggcaggtccaccttgtcctccagaacacaaccaagctccttggctttccttccccaggctggggtgaagtttctgccttggcctgcccaatgctcagacaggccctggctgcctgtgaggaactagcagaccggagcacccagagggccctgtgtctcatcctttccaaagtgtacctcgagcacaggtctcctgacggtgccatccactacctgagccaggccttggtgctagggcagctgctgggtgagcaggaatcctttgagtcttctctctgcctggcatgggcctatctcttagccagccaggccaagaaggctttggatgtgcttgagccactgctatgctccctgaaggagacagagagtctcactcaaaggggagtcatctataacctcctgggacttgcactccaaggtgaaggccgggtgaacagggcagccaagagctatcttcgggccttgaacagagcccaggaggtgggagatgtgcataaccaggcagtggctatggccaatcttggccacctgagccttaagtcctgggctcagcatccagccagaaactatctcctgcaggctgtacgactctattgtgaacttcaggccagtaaggagacagacatggaattagtacaggtgtttctctggttggcccaagttctggtgtctggacaccagctgacccatggccttctttgttatgaaatggcattgctgtttggcttaaggcatcgacatctaaagagtcagcttcaggccaccaaatccctctgccatttctacagctctgtgtccccaaaccctgaggcatgcatcacctaccatgagcactggctggccctggctcagcaactcagggaccgggagatggaagggaggctgctggagtccctggggcagctttatcggaacctaaataccgccaggtccctcaggaggtcactcacatgcatcaaggagagcctgcgtatcttcattgacctgggggagacagacaaggctgctgaggcctggcttggggcggggcgactccactacctcatgcaggaagacgagctggtggagctgtgcctgcaggcagccatccagacagccctgaagtcagaggagcctttgctggctctcaaactttatgaagaagcaggtgatgtgttcttcaatgggacccgccacaggcatcatgcagtggagtactaccgagctggagctgttcctttagcaaggaggttgaaggcggtgagaactgagctccggattttcaataagctgacagagctgcagattagcctcgaaggctatgagaaggctttggaatttgccaccctggccgccaggctcagcacagtcacaggagatcagaggcaagagctggtggcctttcaccgcctggctacagtgtactactccctgcacatgtatgagatggctgaggactgctacctgaagaccctgtccctctgtccaccatggctgcagagtcccaaggaggccctgtactatgccaaggtgtattatcgcctgggcagactcaccttctgccagctgaaggatgcccatgatgccactgagtacttccttctggccctggcagcagcggtcctgctgggtgatgaggagcttcaggacaccattaggagcaggctggacaacatctgccagagccccctgtggcacagcaggccctccgggtgctcctcagagagggcgcggtggctgagtggtggtggcctggccctctgaggaaagctgtcctgtctctggacatttggcatggccagactctgaccccactgccctaggctcttaaatactcattgggagggtccgagtccttacctggcctagccccctcatttcacaagaagaagaatgaagtccaggaggagaagggctcattgca

SEQ ID NO: 181054 - DNA, 4416 bp, Homo sapiens
  Payload ID: 15652
  Gene Symbol: SH3TC2
  Gene Name: SH3 domain and tetratricopeptide repeats 2
  ENST ID: ENST00000504690
  CDS Start-End: 142-3921
tgcattgtgcattgagcaggcctcggtccctcgtgtgccagggaggaggcgggaggagggacaccgttgggaggctgtcccttgcagcactcttctggcctgtgttcccaagggcctcggccagggtaggatggtacacacatgggtggctgcttctgcatccccagggagcggagtctgacccggggcccaggtaaagaaactccttccaaggatccaactgtatcgagtgagtgtatagcctcatctgaatacaaggaaaaatgttttctgccacagaacattaatccagacctgacactctccttctgtgtaaagagccgctccaggaggtgtgtaaatggacccctacaggaagctgctcggaggcggctctgggcactggagaatgaggaccaggaggtgcgcatgctgtttaaggacctctcagcaaggttggtcagtatccagtctcagagggcccagtttctcatcaccttcaagaccatggaggaaatctggaagttctccacctaccttaatttaggctacgtatccatgtgtctagaacatctcctctttgaccacaagtactggctcaactgcatattggtggaggatacagagatccaagtgtctgtagatgataaacacctggaaacaatatacctgggactcctgatacaggaaggccacttcttctgcagagccctgtgctccgtgactccaccagccgagaaggaaggggaatgcttgacactttgcaagaatgagttaatctcagtgaagatggcagaagctggctccgagttggaaggcgtgtctttggtgacaggtcagcggggcctggtactggtgtcagccttggagcctctgcctctccctttccaccagtggttcctaaagaattatccaggaagctgtggcctttccaggaagagggattggacaggctcctatcagattggcagaggacgctgtaaggccttgacgggttatgagccaggagaaaaggatgaactgaatttctaccagggagaaagcattgagatcatcggctttgtcatacctgggcttcagtggttcattggaaagtcgacaagttcaggacaagtgggctttgtccccaccaggaacatagatcctgattcttattccccaatgagcaggaactctgcctttctcagtgatgaggagagatgctccctgttggccctgggaagtgataagcagactgagtgttccagcttcctccacactcttgctcgcactgacatcacatctgtctaccggctcagtgggtttgaatccatccagaatcctccaaatgatctgagtgcatcccagcctgaaggtttcaaggaggtcaggcctggcagagcctgggaggagcatcaggccgtggggtccagacagtccagcagctctgaggactccagcctggaggaggagctcctctcggccacctcagacagctatcgcctgccggagcctgatgaccttgatgacccggaactgctcatggacctaagcactggtcaggaggaggaggctgagaacttcgcccccatattggcttttctggatcatgagggttatgctgaccactttaagagtctctatgacttctccttctctttcctcacttcttccttttatagcttctctgaggaggatgagtttgtggcctacctggaggcatcaagaaagtgggccaagaagagccacatgacctgggcccatgcccgtctctgcttcctcctgggccggctgagcatcaggaaggtcaaactctctcaggccagggtgtacttcgaggaggccatccacattctcaatggagcatttgaggacctatccttggtggccactctgtacatcaatttggctgccatctacctgaaacagaggctgagacataaaggctccgccctgttggaaaaggcaggtgccctgctggcctgcctgcctgaccgtgagtctagtgccaagcatgaactcgacgtggtggcctacgtgctgcgccaggggattgtggtgggcagcagcccgctggaggccagggcctgctttctggccatccgcttgctcctgagcctaggccggcacgaggaggtcctgccctttgccgagcgcctgcagctcctctctggacaccctcctgcctctgaggctgtggccagtgttttgagttttctgtatgacaagaaatatcttccacaccttgcagtggcctctgtccagcaacatggtatccagagtgcccaagggatgtctcttcctatttggcaggtccaccttgtcctccagaacacaaccaagctccttggctttccttccccaggctggggtgaagtttctgccttggcctgcccaatgctcagacaggccctggctgcctgtgaggaactagcagaccggagcacccagagggccctgtgtctcatcctttccaaagtgtacctcgagcacaggtctcctgacggtgccatccactacctgagccaggccttggtgctagggcagctgctgggtgagcaggaatcctttgagtcttctctctgcctggcatgggcctatctcttagccagccaggccaagaaggctttggatgtgcttgagccactgctatgctccctgaaggagacagagagtctcactcaaaggggagtcatctataacctcctgggacttgcactccaaggtgaaggccgggtgaacagggcagccaagagctatcttcgggccttgaacagagcccaggaggtgggagatgtgcataaccaggcagtggctatggccaatcttggccacctgagccttaagtcctgggctcagcatccagccagaaactatctcctgcaggctgtacgactctattgtgaacttcaggccagtaaggagacagacatggaattagtacaggtgtttctctggttggcccaagttctggtgtctggacaccagctgacccatggccttctttgttatgaaatggcattgctgtttggcttaaggcatcgacatctaaagagtcagcttcaggccaccaaatccctctgccatttctacagctctgtgtccccaaaccctgaggcatgcatcacctaccatgagcactggctggccctggctcagcaactcagggaccgggagatggaagggaggctgctggagtccctggggcagctttatcggaacctaaataccgccaggtccctcaggaggtcactcacatgcatcaaggagagcctgcgtatcttcattgacctgggggagacagacaaggctgctgaggcctggcttggggcggggcgactccactacctcatgcaggaagacgagctggtggagctgtgcctgcaggcagccatccagacagccctgaagtcagaggagcctttgctggctctcaaactttatgaagaagcaggtgatgtgttcttcaatgggacccgccacaggcatcatgcagtggagtactaccgagctggagctgttcctttagcaaggaggttgaaggcggtgagaactgagctccggattttcaataagctgacagagctgcagattagcctcgaaggctatgagaaggctttggaatttgccaccctggccgccaggctcagcacagtcacaggagatcagaggcaagagctggtggcctttcaccgcctggctacagtgtactactccctgcacatgtatgagatggctgaggactgctacctgaagaccctgtccctctgtccaccatggctgcagagtcccaaggaggccctgtactatgccaaggtgtattatcgcctgggcagactcaccttctgccagctgaagtttctcctctgttgcccaggctggagttcagtggtacagtcagggcttcctgcgacctcagactccggggctcaagtgatcctccagtgtcaacctcctgagtagctggaactacagggcagttgcaggctggcccagggcagacccaactgagggcaatggtccttagagctatggccaccctgacgtggatgcctggtgagaggcttgtgaacagagaagactaactgtggagatgctgacccatttagcttttacctgtcccaggatggttggagatctctgggagagagagagaggtaatgaggactcagttttgaccaaggcaagatggcttcaaaaaaataacaaatgccttggcaatgatttcttggacatgataccagaagcacaggcaacaaaagcaaaaacagatgagtaacactacatcaaactaaaaacttctgcacagcaaaggaaacaaccaacaaaatgagaaggcaacttacagaatggaagaaaatatttgagaaccatatatctggtaaaggcaaaagactcccaccggaagccaaccagatgtggctgcctaatcttggacttcccagtctccagaactgt

SEQ ID NO: 181055 - DNA, 1251 bp, Homo sapiens
  Payload ID: 15653
  Gene Symbol: SH3BGR
  Gene Name: SH3 domain binding glutamate-rich protein
  Uniprot ID: P55822
  ENST ID: ENST00000333634
  CDS Start-End: 79-798
gctgcttttatcgaccaatcaaatattttcctgacagatcccaaaatattcctgggccaatggagggaggagcccaagatgcctctgctgctccttggagagacagagcctcttaagttggagcgggactgccggagcccagtggacccctgggctgctgccagccccgacctggcacttgcttgcctgtgtcactgtcaggatttgtctagcggcgcattccctgacaggggtgtgttggggggagtcctctttccaactgtcgaaatggttatcaaagtgtttgttgctacatcttctgggtccatagcgattaggaagaaacagcaagaagtagtgggttttttggaagcgaataaaatcgactttaaggaattagatattgctggagatgaagacaacaggaggtggatgagagagaatgttcctggagagaaaaaacctcaaaatgggattcctttgcctccccagatcttcaatgaggagcagtactgtggggattttgactctttcttctctgcaaaagaagagaatattatttattccttccttggtttggctcctcctccagactcaaagggatcagagaaggctgaagaaggtggagaaactgaggcacaaaaagagggcagtgaagatgtgggcaacctccctgaagcccaggagaagaatgaagaagaaggagagacagccacagaagagacggaagaaatagccatggagggtgcggaaggggaagccgaggaggaggaagaaactgcagaaggagaagagcctggagaagacgaagattcctaggccttttcatgcttcatttcttccacttctccagaaaatggaagctatgaagcaacatttcaaatgtctctccacaaaccaaactcaacagaatactttggcttgaagccggcacacccagggttactgaggacttatgctgcctgacctggttagatgtacatggaggtatctcccgaatcatacaaaattaaatgtgaagaccgtttatgcataccttcatgtgcctgacagtcttggcttttgaagatttttttttcttttttgctctgcatagctagaccatcttattaataatactctgaaaaaaatgatttcaaggcatggaagttctctgtgatacaacaatagtatttcttcaaatgcgccttatgctacttatctcagaaacaggttttaaaatgaagtgctttccagagaaccatcatataaataaagattaatagaaaaata

SEQ ID NO: 181056 - DNA, 780 bp, Homo sapiens
  Payload ID: 15653
  Gene Symbol: SH3BGR
  Gene Name: SH3 domain binding glutamate-rich protein
  Uniprot ID: P55822
  ENST ID: ENST00000380631
  CDS Start-End: 240-626
tgtagacgtctgtaaacgatcctcctgccgtccctgttcggcgcccgggaccctgccttcccgcgtggccgcaccgagacgagggagcctgtcacgcgctctggcgctctcctgacctcttaaggctctgtcagtcttagattaggaagaaacagcaagaagtagtgggttttttggaagcgaataaaatcgactttaaggaattagatattgctggagatgaagacaacaggaggtggatgagagagaatgttcctggagagaaaaaacctcaaaatgggattcctttgcctccccagatcttcaatgaggagcagtactgtggggattttgactctttcttctctgcaaaagaagagaatattatttattccttccttggtttggctcctcctccagactcaaagggatcagagaaggctgaagaaggtggagaaactgaggcacaaaaagagggcagtgaagatgtgggcaacctccctgaagcccaggagaagaatgaagaagaaggagagacagccacagaagagacggaagaaatagccatggagggtgcggaaggggaagccgaggaggaggaagaaactgcagaaggagaagagcctggagaagacgaagattcctaggccttttcatgcttcatttcttccacttctccagaaaatggaagctatgaagcaacatttcaaatgtctctccacaaaccaaactcaacagaatactttggcttgaagccggcacacccagggttactgaggacttatgctgcctgacctggtt

SEQ ID NO: 181057 - DNA, 816 bp, Homo sapiens
  Payload ID: 15653
  Gene Symbol: SH3BGR
  Gene Name: SH3 domain binding glutamate-rich protein
  Uniprot ID: P55822
  ENST ID: ENST00000380634
  CDS Start-End: 128-514
ggcggggaggggcgtcttgggcctggagattaggaagaaacagcaagaagtagtgggttttttggaagcgaataaaatcgactttaaggaattagatattgctggagatgaagacaacaggaggtggatgagagagaatgttcctggagagaaaaaacctcaaaatgggattcctttgcctccccagatcttcaatgaggagcagtactgtggggattttgactctttcttctctgcaaaagaagagaatattatttattccttccttggtttggctcctcctccagactcaaagggatcagagaaggctgaagaaggtggagaaactgaggcacaaaaagagggcagtgaagatgtgggcaacctccctgaagcccaggagaagaatgaagaagaaggagagacagccacagaagagacggaagaaatagccatggagggtgcggaaggggaagccgaggaggaggaagaaactgcagaaggagaagagcctggagaagacgaagattcctaggccttttcatgcttcatttcttccacttctccagaaaatggaagctatgaagcaacatttcaaatgtctctccacaaaccaaactcaacagaatactttggcttgaagccggcacacccagggttactgaggacttatgctgcctgacctggttagatgtacatggaggtatctcccgaatcatacaaaattaaatgtgaagaccgtttatgcataccttcatgtgcctgacagtcttggcttttgaagatttttttttcttttttgctctgcatagctagaccatcttattaataatactc

SEQ ID NO: 181058 - DNA, 1014 bp, Homo sapiens
  Payload ID: 15653
  Gene Symbol: SH3BGR
  Gene Name: SH3 domain binding glutamate-rich protein
  Uniprot ID: P55822
  ENST ID: ENST00000380637
  CDS Start-End: 175-561
caggagccgcggcggggaggggcgtcttgggcctggaggtcagtgtggcctcgcgtttgtcttcggtgacgggaaattaggaagaaacagcaagaagtagtgggttttttggaagcgaataaaatcgactttaaggaattagatattgctggagatgaagacaacaggaggtggatgagagagaatgttcctggagagaaaaaacctcaaaatgggattcctttgcctccccagatcttcaatgaggagcagtactgtggggattttgactctttcttctctgcaaaagaagagaatattatttattccttccttggtttggctcctcctccagactcaaagggatcagagaaggctgaagaaggtggagaaactgaggcacaaaaagagggcagtgaagatgtgggcaacctccctgaagcccaggagaagaatgaagaagaaggagagacagccacagaagagacggaagaaatagccatggagggtgcggaaggggaagccgaggaggaggaagaaactgcagaaggagaagagcctggagaagacgaagattcctaggccttttcatgcttcatttcttccacttctccagaaaatggaagctatgaagcaacatttcaaatgtctctccacaaaccaaactcaacagaatactttggcttgaagccggcacacccagggttactgaggacttatgctgcctgacctggttagatgtacatggaggtatctcccgaatcatacaaaattaaatgtgaagaccgtttatgcataccttcatgtgcctgacagtcttggcttttgaagatttttttttcttttttgctctgcatagctagaccatcttattaataatactctgaaaaaaatgatttcaaggcatggaagttctctgtgatacaacaatagtatttcttcaaatgcgccttatgctacttatctcagaaacaggttttaaaatgaagtgctttccagagaaccatcatataaataaagattaatagaaaaata

SEQ ID NO: 181059 - DNA, 585 bp, Homo sapiens
  Payload ID: 15653
  Gene Symbol: SH3BGR
  Gene Name: SH3 domain binding glutamate-rich protein
  ENST ID: ENST00000440288
  CDS Start-End: 268-585
tgagtttcttgtgtagacgtctgtaaacgatcctcctgccgtccctgttcggcgcccgggaccctgccttcccgcgtggccgcaccgagacgagggagcctgtcacgcgctctggcgctctcctgacctcttaaggctctgtcagtcttaggtaacttgagtcagtagattaggaagaaacagcaagaagtagtgggttttttggaagcgaataaaatcgactttaaggaattagatattgctggagatgaagacaacaggaggtggatgagagagaatgttcctggagagaaaaaacctcaaaatgggattcctttgcctccccagatcttcaatgaggagcagtactgtggggattttgactctttcttctctgcaaaagaagagaatattatttattccttccttggtttggctcctcctccagactcaaagggatcagagaaggctgaagaaggtggagaaactgaggcacaaaaagagggcagtgaagatgtgggcaacctccctgaagcccaggagaagaatgaagaagaaggagagacagccacagaagagacggaagaaatagccatggagggtgcg

SEQ ID NO: 181060 - DNA, 512 bp, Homo sapiens
  Payload ID: 15653
  Gene Symbol: SH3BGR
  Gene Name: SH3 domain binding glutamate-rich protein
  ENST ID: ENST00000447939
  CDS Start-End: 1-165
ggatcagagaaggctgaagaaggtggagaaactgaggcacaaaaagagggcagtgaagatgtgggcaacctccctgaagcccaggagaagaataaaatggaagctatgaagcaacatttcaaatgtctctccacaaaccaaactcaacagaatactttggcttgaagccggcacacccagggttactgaggacttatgctgcctgacctggttagatgtacatggaggtatctcccgaatcatacaaaattaaatgtgaagaccgtttatgcataccttcatgtgcctgacagtcttggcttttgaagatttttttttcttttttgctctgcatagctagaccatcttattaataatactctgaaaaaaatgatttcaaggcatggaagttctctgtgatacaacaatagtatttcttcaaatgcgccttatgctacttatctcagaaacaggttttaaaatgaagtgctttccagagaaccatcatataaataaagattaatagaaaaata

SEQ ID NO: 181061 - DNA, 812 bp, Homo sapiens
  Payload ID: 15653
  Gene Symbol: SH3BGR
  Gene Name: SH3 domain binding glutamate-rich protein
  ENST ID: ENST00000458295
  CDS Start-End: 302-595
ggcgtcttgggcctggaggtcagtgtggcctcgcgtttgtcttcggtgacgggaagtgagtttcttgtgtagacgtctgtaaacgatcctcctgccgtccctgttcggcgcccgggaccctgccttcccgcgtggccgcaccgagacgagggagcctgtcacgcgctctggcgctctcctgacctcttaaggctctgtcagtcttaggaagaaacagcaagaagtagtgggttttttggaagcgaataaaatcgactttaaggaattagatattgctggagatgaagacaacaggaggtggatgagagagaatgttcctggagagaaaaaacctcaaaatgggattcctttgcctccccagatcttcaatgaggagcagtactgtggggattttgactctttcttctctgcaaaagaagagaatattatttattccttccttggtttggctcctcctccagactcaaaggaagaagaaggagagacagccacagaagagacggaagaaatagccatggagggtgcggaaggggaagccgaggaggaggaagaaactgcagaaggagaagagcctggagaagacgaagattcctaggccttttcatgcttcatttcttccacttctccagaaaatggaagctatgaagcaacatttcaaatgtctctccacaaaccaaactcaacagaatactttggcttgaagccggcacacccagggttactgaggacttatgctgcctgacctggttagatgtacatggaggtatctcccgaatcatacaaaattaaatgtgaagaccgtttatgcatac

SEQ ID NO: 181062 - DNA, 865 bp, Homo sapiens
  Payload ID: 15653
  Gene Symbol: SH3BGR
  Gene Name: SH3 domain binding glutamate-rich protein
  ENST ID: ENST00000452550
  CDS Start-End: 1-412
atcttctgggtccatagcgattaggaagaaacagcaagaagtagtgggttttttggaagcgaataaaatcgactttaaggaattagatattgctggagatgaagacaacaggaggtggatgagagagaatgttcctggagagaaaaaacctcaaaatgggattcctttgcctccccagatcttcaatgaggagcagtactgtggggattttgactctttcttctctgcaaaagaagagaatattatttattccttccttggtttggctcctcctccagactcaaaggaagaagaaggagagacagccacagaagagacggaagaaatagccatggagggtgcggaaggggaagccgaggaggaggaagaaactgcagaaggagaagagcctggagaagacgaagattcctaggccttttcatgcttcatttcttccacttctccagaaaatggaagctatgaagcaacatttcaaatgtctctccacaaaccaaactcaacagaatactttggcttgaagccggcacacccagggttactgaggacttatgctgcctgacctggttagatgtacatggaggtatctcccgaatcatacaaaattaaatgtgaagaccgtttatgcataccttcatgtgcctgacagtcttggcttttgaagatttttttttcttttttgctctgcatagctagaccatcttattaataatactctgaaaaaaatgatttcaaggcatggaagttctctgtgatacaacaatagtatttcttcaaatgcgccttatgctacttatctcagaaacaggttttaaaatgaagtgctttccagagaaccatcatataaataaagattaatagaaaaata

SEQ ID NO: 181063 - DNA, 246 bp, Homo sapiens
  Payload ID: 15653
  Gene Symbol: SH3BGR
  Gene Name: SH3 domain binding glutamate-rich protein
  ENST ID: ENST00000423596
  CDS Start-End: 1-246
atcttcaatgaggagcagtactgtgggggatcagagaaggctgaagaaggtggagaaactgaggcacaaaaagagggcagtgaagatgtgggcaacctccctgaagcccaggagaagaatgaagaagaaggagagacagccacagaagagacggaagaaatagccatggagggtgcggaaggggaagccgaggaggaggaagaaactgcagaaggagaagagcctggagaagacgaagattcctag

SEQ ID NO: 181064 - DNA, 1923 bp, Homo sapiens
  Payload ID: 15654
  Gene Symbol: SH3BGRL
  Gene Name: SH3 domain binding glutamate-rich protein like
  Uniprot ID: O75368
  ENST ID: ENST00000373212
  CDS Start-End: 259-603
cgagattccctattaaaaaaaaatagaattgatgcaaacagcctgttccttccggggttttgggctggaactgcagcgcttagagagctcggtggaagctgctaaaggcggaggcggggctctggcgagttctccttccaccttcccccacccttctctgccaaccgctgtttcagcccctagctggattccagccattgctgcagctgctccacagcccttttcaggacccaaacaaccgcagccgctgttcccaggatggtgatccgtgtatatattgcatcttcctctggctctacagcgattaagaagaaacaacaagatgtgcttggtttcctagaagccaacaaaataggatttgaagaaaaagatattgcagccaatgaagagaatcggaagtggatgagagaaaatgtacctgaaaatagtcgaccagccacaggttaccccctgccacctcagattttcaatgaaagccagtatcgcggggactatgatgccttctttgaagccagagaaaataatgcagtgtatgccttcttaggcttgacagccccacctggttcaaaggaagcagaagtgcaagcaaagcagcaagcatgaaccttaagcactgtgctttaagcatcctgaaaaatgagtctccattgcttttataaaatagcagaattagctttgcttcaaaagaaataggcttaatgttgaaataatagattagttgggttttcacatgcaaacattcaaaatgaatacaaaattaaaatttgaacattatggtgattatggtgaggagaatgggatattaacataaaattatattaataagtagatatcgtagaaatagtgttgttacctgccaagccatcctgtatacaccaatgattttacaaagaaaacacccttccctccttctgccattactatggcaacttaagtgtatctgcagctctacattaaaaaggagaaagagaaataacctgtctctcattcctaagttgcctcattaattttcatgaacaagaatatgtacctttttgatgctatattactgcgattaaaaagttcttgcaggtaatgtttatgatatgttaaacgttgtaatttcctatcgtaattataacattcccattcttttgtagatgaaacttctacatattgaaccacagattttctgagcttctaaatgtagcctttcattgcacatttcagtgatcagaatagatatccttttacacgcacaaaagcaatagattcattcagtggacaagttccttgtttaactacacagctatgatggaatgatatatccaagttccttgcctcagtgaaatatgcatatgtatatcatgaaagtgggatgccaagtaagcttaaaatggcattctctagcaaagagattagacttttaaataactcttataaaacaggttggcgatcatttcccaagattggtttcccttgagtttttgctaaaacaaatcttagtagttttgcccgtttaaaacaactcacaatcgtaaatgctactattcctaagatatcttacctttttatttcagtttagccatgtattgtatgagtgtattagtctaagcagtgagaatcttttctatgcctctattccagcaaaaagtagaagtatcaaataaaaagggcaacttttaaaatattaagcctgaagacttctaaaaagacaagaaacatggcctaaataaccaacatagatttacatagtaagtttcacactaccttattaccaaaagcaaacacctcttactttaaactacattatcatgtatatctattgtatgctggtctttactttttgccaaaatcaacatataatgaagagatgcctttgtttcatgagattcaaacttgatgctatgctttaaaataaactcagtacttttagaaacataa

SEQ ID NO: 181065 - DNA, 4653 bp, Homo sapiens
  Payload ID: 15655
  Gene Symbol: SH3BGRL2
  Gene Name: SH3 domain binding glutamate-rich protein like 2
  Uniprot ID: Q9UJC5
  ENST ID: ENST00000369838
  CDS Start-End: 180-503
ccgggcggcgctgggcttttatctgcggacccgccgggagggagccagatcccagcgatcttccccgacggcagcgctttacccagaggctgccggcggctcgtagctgggttcagctctgcgtccacgccagcccggagcccggggggcaaggggtctgtcccgggcgcagcgagaggatggtcatccgcgtgttcatcgcctcttcctcgggcttcgtggcgataaagaagaagcagcaagatgtggttagatttctggaagccaacaagatagagtttgaggaggtggatatcacaatgtcagaagaacagaggcaatggatgtacaaaaacgtccccccggaaaagaaacccactcagggcaaccccctgccacctcagatatttaatggcgaccgatactgtggagattatgacagtttttttgaatccaaggaaagcaacacagtcttttcatttttaggcctgaaaccacggttggcatcaaaggcagaaccttagagaagaagagtggaagatgacggagatgcattttgaagcacccctggtactcagcacacacatgcttacctaatgcatcactgtgacaaaagccacacgcattatcagtaactttgcttgccacggaaaaggtgtttttgaaagatgtggctataatgagaattgcatgattgctttaaaccaaatcaggtggtggattttttttttcttattctatttgcctgcagttgcctcactcacctggaaataccgtcacctgttacaggtgtactttcttaatgactgaaagataagtgggtagcaccgtcagagagaaaatgttggatctgccctaggttatagtagatgccggaattgcgtaaacccacttctctttaagctgcctggattgcacctttgaaatatgtctgccaagttgttagaatctttgaatcagaaggaaaaaaagcagcgctggttgacaaagggtgttgaagatttttgctgcagaatcagttacaaacatcacagttcccatgctttgtaataacacctggtgaaaaagttagatattctagacttgttttagtaatggaaactcttacctccacatattatcctacagatgtttccagaaatccctgttgtaacatcaagtgatcagaactaagttactgggatgacaataattgctatttgaaatatatgcttctttatttcttgcaaggggcaagtttcacccaaatgcctgagactgcttgaaagatatattttaagtggtgcactaattagtgaatatataggaaaattatctgacgagtatctgaaggcattttcagctctagcaatttatttataatatataagttcatatattttttaatccagctcccctaacagacagctgctgcttctattttgtgaagggactatattttttgagaaaggaaaatctcagttagatatattttgtgaacccttgattagacatattaaaatataccaatgttgtagtaaaatttaatttttccttttgttacttttcatttgcctctaattttgcttgctcatatttctggccaatgtacagcctcatatttttcagagtaatacagatacttgttctcattccgtatatgagcacaagtaaggtttcagagcaacacacatgagaaagagagtaacccggaattgtacttgtcaagcaaaatctatactcctattggagtggatgctgatgaacatcgaacatatctacttcattagagcagaggctatttttctgcattcttgtccctataacagggatgcttaattttttttttaacttagagttttaaattgccaaacatgggaacagccttgaataggataaattttcagagggctgcctaaaatattttatttctagcatcctgattctggacttttcattataattctgagcaggaaatttataagaaattgaaagagcagaagaattacagccctgtcacatgtgcccagcactccgccccatgccttgctaaatgtagactaaagaacttgttgaatgctaaggctgaaatcccaacctgagatttgtagtccaggattacaaccagaaggaaagtatgacagatttctacttaactagaatggacacatgatccacaattttctcttcaagggaagctgttgtcaaattatggatattactggttagttgtcattaagtaagatccaggtcaaattccatttgacaaatcccagggactatccaggaatttttttttaactggatattgtgtttgagtatgtgagtcttctgataaaactcagaatttctttttaagcagttgtaaaaattgtcatgttgtaattcattactcagctaacatttagtctactcttgctagtgagtgccaagaaccaacttggtaaggttgaggctttgcaagttaactgctggggttataggatcaataccatacttgctagacaaagctacccagatttgtcttatattataatttttgagttaaccgtagtatacctattatgattatagtaaacagactagtgggtagtaatgctaaattaccatcacagttatgtgccatctccccaccccatttttttttttttttttttgatcagcaaagaaatacaggagaccagtctcgagtggtgctgtacttgttatgagtgaggcagcagcacagtgtgtggcatttacatggtacccaggctccacagagtaccaagatgttgccctctgggaccacacttagctcagagaatatggggtccttacttgtattcttttatcagctgattttgaaacatataataatgattttcttgttcccttctttaactagctgcctttagattttgataatcacagtcttaaaatactaggaaagaagtggatgggaattgtaggcatagatttcatatcaagggcatttcaagacagaatttttatttcctgtagtaggcttgctggagcaaaggaaatgtgctgctaaaaatcaacttatgccattttaaaattagataaaatatggagtgccatcctgctaggtgagtacagaccagaagaaaatttagttgggaaaatacttgtttttccaaattccggtgttttattacaatcaaagaagaggaaagcaaggtattttttcacctcagattctaatatattctagatttgtttctgttttatagatttaattcaatacctccacatagatgtttttatattacatgaatttaataataaactaaacttttttttgtctcccgttattgaaaagtaccaaagcttctttctgttgtgtttgattttactataggggttttgctttttctagagatacttttcatttaacagcttttgttaagtgtcaggctgcactttgctccatataattattgttttcagatttcaacttgtatgtgtttgtctcttaaagcattggtgaaatcacatattttatattcagcataaaggagaataaattccagaaaacacatattctgaaaatggagtgtttgttccctgccatttttcacacctctcttaattttagttctgtttagttgagaggctgtgattttactcttgcctgtgaacctcatgcatgaaagcagcacattaaattgtaaaaatacaaacagatcgtgtgatcattcaaggagccagacatgaggtcctgcacgagggtgttgggaggacaccacagattcatctcagacagtgatcaggactgaggatggagttaaatcactcagcccctgggtggggtggggtggttcaaatggatgactgatctcctgagtacactgaagccacaggctggtggccatgttctctgaattgggtgcagaagacaagggcagagtggctgcggcccctattacctttgtagcagccacatcagaaagcagaagaaaacagtatttctgaaggcattgtttgaggttgatctcagcactgaacgatttcaagccctacgcaccagaacagaaggagggtggaggaagtgatcagagggaacgagctgtaggtttgcagaaatgtgtgaaaccaaaatgatcactgcctacttgtgattcaaatcttcagagttttcctagttcttctagaaatacatgtcaggtttgtttgttcatcctttctgtcagcatggatcaagcccctaaaatgtggtaagtgttgtcagagcagggcaatatctctactctcaagtatgaggggaatagaaacaaagcagcagttttagccagggttcaatgatagagtggaggtaaattaagagcctccaggctgtgattcaccatttgagacattatacataatttgtttttgttataagccatttgaatttttaaaaaatttcatacatgcaatggaatatagatatgtatatacacatataatatatatgctaaagtataaagagtaataataatgacaataaacaaacccctgtgtgcctaccacccaccttattgcctttcctttgaggtaccgtgtgcggtttcctgaacctatctctatccctgtctgatagagggaacccctgtactgaactttgtgttgaccatagccttcttgtctttcatcactttatctccatgtatgtatccttaaagaataataaatggaattaaactgaatgta

SEQ ID NO: 181066 - DNA, 1661 bp, Homo sapiens
  Payload ID: 15656
  Gene Symbol: SH3BGRL3
  Gene Name: SH3 domain binding glutamate-rich protein like 3
  Uniprot ID: Q9H299
  ENST ID: ENST00000270792
  CDS Start-End: 981-1262
cctggaccagggggacatctgagaagcatgatgttgagtgccagacagctaggtctccaaagttgggctcgttgctggagtctgccccctcaaccgctgaattcttgctgggagtagtagcagtttgggaatgccatctgcagcatggagctggggttgagcttggaccaccccaagacctggggtggatcttaagggtcagcttgagcctaggctctcgagtcctgacatcatcctctaccgccacgctttccagctgtcagccttggtctccatctggttccttgagggtgtggcctctgcgtcctgctatcacccttccttgtctaaaccttcccacctgagtggagaggaacttgggggaaaatctctaagcatgggctcttcctgctgtcctatgcttcctatcccctagggttagtggtgcgtgttgggtggtggagcgagggatcccttggagcaaggttcttagagaactttgggtctgaaagcagctcaaaccttccaaagccccaagcttccctgtgctattagagcacctcctcctggagagagcggctctcgtggctggggagttggatgcaccaaacctgtgtgcggctggagagggaggcttctgccagaccctctcccgggcctgtcctgccacccaggcccctccccagtctcacactgagctccagatcagggaagggccgaaaaggacgatcagggcagccgcagaaggggcgccctgcgtgggacgggtccgttgcgcgcctggtaaccgagggggaagggaaggggcctctggcgtgcggggcggtgtcgcgcaggtcccaccccgcctgcccgcgccgcccattggtcccgagcgcgatgacttggcgggcggagcaggaaggaaaccgctcccgagcacggcggcggcgtcgtctcccggcagtgcagctgccgctaccgccgccctctgcccgccggcccgtctgtctacccccagcatgagcggcctgcgcgtctacagcacgtcggtcaccggctcccgcgaaatcaagtcccagcagagcgaggtgacccgaatcctggatgggaagcgcatccaataccagctagtggacatctcccaggacaacgccctgagggatgagatgcgagccttggcaggcaaccccaaggccaccccaccccagattgtcaacggggaccagtactgtggggactatgagctcttcgtggaggctgtggaacaaaacacgctgcaggagttcctgaagctggcttgagtcaagcctgtccagagttcccctgctggactccatcaccacactccccccagccttcacctggccatgaaggaccttttgaccaactccctgtcattcctaacctaaccttagagtccctcccccaatgcaggccacttctcctccctcctctctaaatgtagtcccctctcctccatctaaaggcaacattccttacccattagtctcagaaattgtcttaagcaacagccccaaatgctggctgcccccagccaagcattggggccgccatcctgcctggcactggctgatgggcacctctgttggttccatcagccagagctctgccaaaggccccgcagtccctctcccaggaggaccctagaggcaattaaatgatgtcctgttccattggca

SEQ ID NO: 181067 - DNA, 768 bp, Homo sapiens
  Payload ID: 15656
  Gene Symbol: SH3BGRL3
  Gene Name: SH3 domain binding glutamate-rich protein like 3
  ENST ID: ENST00000319041
  CDS Start-End: 35-301
cctctgcccgccggcccgtctgtctacccccagcatgagcggcctgcgcgtctacagcacgtcggtcaccggctcccgcgaaatcaagtcccagcagagcgaggtgacccgaatcctggatgggaagcgcatccaataccagctagtggacatctcccaggacaacgccctgagggatgagatgcgagccttggcaggcaaccccaaggccaccccaccccagattgtcaacggggaccagtactgtggggtatgggctgggggacgggggggtggggggagtgttggaagaggactctagccagggtcatatctgccacaaagcacttgggccccctgcattcaggtgaccacccctcgcctccccttctccaggactatgagctcttcgtggaggctgtggaacaaaacacgctgcaggagttcctgaagctggcttgagtcaagcctgtccagagttcccctgctggactccatcaccacactccccccagccttcacctggccatgaaggaccttttgaccaactccctgtcattcctaacctaaccttagagtccctcccccaatgcaggccacttctcctccctcctctctaaatgtagtcccctctcctccatctaaaggcaacattccttacccattagtctcagaaattgtcttaagcaacagccccaaatgctggctgcccccagccaagcattggggccgccatcctgcctggcactggctgatgggcacctctgttggttccatcagccagagctc

SEQ ID NO: 181068 - DNA, 1653 bp, Homo sapiens
  Payload ID: 15656
  Gene Symbol: SH3BGRL3
  Gene Name: SH3 domain binding glutamate-rich protein like 3
  ENST ID: ENST00000614679
  CDS Start-End: 580-1260
cctggaccagggggacatctgagaagcatgatgttgagtgccagacagctaggtctccaaagttgggctcgttgctggagtctgccccctcaaccgctgaattcttgctgggagtagtagcagtttgggaatgccatctgcagcatggagctggggttgagcttggaccaccccaagacctggggtggatcttaagggtcagcttgagcctaggctctcgagtcctgacatcatcctctaccgccacgctttccagctgtcagccttggtctccatctggttccttgagggtgtggcctctgcgtcctgctatcacccttccttgtctaaaccttcccacctgagtggagaggaacttgggggaaaatctctaagcatgggctcttcctgctgtcctatgcttcctatcccctagggttagtggtgcgtgttgggtggtggagcgagggatcccttggagcaaggttcttagagaactttgggtctgaaagcagctcaaaccttccaaagccccaagcttccctgtgctattagagcacctcctcctggagagagcggctctcgtggctggggagttggatgcaccaaacctgtgtgcggctggagagggaggcttctgccagaccctctcccgggcctgtcctgccacccaggcccctccccagtcacactgagctccagatcagggaagggccgaaaaggacgatcagggcagccgcagaaggggcgccctgcgtgggacgggtccgttgcgcgcctggtaaccgagggggaagggaaggggcctctggcgtgcggggcggtgtcgcgcaggtcccaccccgcctgcccgcgccgcccattggtcccgagcgcgatgacttggcgggcggagcaggaaggaaaccgctcccgagcacggcggcggcgtcgtctcccggcagtgcagctgccgctaccgccgccctctgcccgccggcccgtctgtctacccccagcatgagcggcctgcgcgtctacagcacgtcggtcaccggctcccgcgaaatcaagtcccagcagagcgaggtgacccgaatcctggatgggaagcgcatccaataccagctagtggacatctcccaggacaacgccctgagggatgagatgcgagccttggcaggcaaccccaaggccaccccaccccagattgtcaacggggaccagtactgtggggactatgagctcttcgtggaggctgtggaacaaaacacgctgcaggagttcctgaagctggcttgagtcaagcctgtccagagttcccctgctggactccatcaccacactccccccagccttcacctggccatgaaggaccttttgaccaactccctgtcattcctaacctaaccttagagtccctcccccaatgcaggccacttctcctccctcctctctaaatgtagtcccctctcctccatctaaaggcaacattccttacccattagtctcagaaattgtcttaagcaacagccccaaatgctggctgcccccagccaagcattggggccgccatcctgcctggcactggctgatgggcacctctgttggttccatcagccagagctctgccaaaggccccgcagtccctctcccaggaggaccctagaggcaattaaatgatgtcctgttcca

SEQ ID NO: 181069 - DNA, 4992 bp, Homo sapiens
  Payload ID: 15657
  Gene Symbol: SBK1
  Gene Name: SH3 domain binding kinase 1
  Uniprot ID: Q52WX2
  ENST ID: ENST00000341901
  CDS Start-End: 790-2064
agccgcgatgccgcgatggagcgcagcccgggcgggcgccggggccggggcccgagcgccaggcggagcgcgagctggagccgcagccggagcccgggccaggccgggggccgggagcgcagggccgggctgctcgtagcggcggcgaccgagccccccagcggctgaggggcttccagcgcccgccggtggccgggacccactaaagcccccgcagccgaggagtgcggggagcccccttccacatccaggatccggcgagcctcggggaagagggggggccctcccggatccgacaccgagcgactcccctgcggggaaagcggagacttcctcggtatttagaagacagcaagccccctacggcaccgcaaggactccccctcctcagtctgggcccccgccccaagacctagaacgcagtgcccccaggccgggattgcgagaaccccctcccaagatccggtcattacaactccacacctcaagacaagaagacccagctcagaacgcccctagatcaggggatcccaattccccccaactccggtacatagaaatcccaaatctaggcagccggggacagcaagagacactctcaccagcaagaagcctcggggatcccccccctaaagctccaggacttgggcgactgagcccctggcggcaccgcttgcaccccggtccatggtcgtggcgccctgagcccccggggccgggcagacgaagaccgcgacggcgcccaggccccctgccgcggcgtccccgcggccccagcccagggagaagatgagcgtgggctgcccagagcctgagccgccccgctccctgacctgctgtgggccggggactgcccctgggcctggtgccggtgtgccccttctcactgaagacatgcaggccctgactctccgcacactggccgccagcgacgtcaccaagcactacgaactagtccgggagctgggcaaaggcacctatgggaaggttgacctggtggtctacaagggcacaggcacaaaaatggcactgaagtttgtgaacaagagcaaaaccaagctgaagaacttcctacgggaggtgagcatcaccaacagcctctcctccagccccttcatcatcaaggtctttgacgtggtctttgagacagaggactgctacgtctttgcccaggagtacgcacctgctggggacctgtttgacatcatccctccccaggtggggctccctgaggacacggtgaagcgctgtgtgcagcagctgggcctggcgctggacttcatgcacgggcggcagctggtgcaccgcgacatcaagcccgagaacgtgctgctgttcgaccgcgagtgccgccgcgtaaagctggccgacttcggcatgacgcgccgcgtgggctgccgcgtcaagcgcgtgagcggcaccatcccttacacggcgcctgaggtgtgccaggcgggccgcgccgacgggctggcggtggacacgggcgtggacgtgtgggccttcggcgtgctcatcttctgcgtgctcaccggcaacttcccgtgggaggcggcgtcgggcgccgacgccttcttcgaggagttcgtgcgctggcagcggggccgcctgccggggctgccttcgcagtggcgccgcttcaccgagcccgcgctgcgcatgttccagcgcttactggccctggagcccgagcgccgcggcccagccaaggaggtgttccgcttcctcaagcacgagctcacgtccgagctgcgccgccggccctcgcaccgcgcgcgcaagccccccggggaccgcccgcccgccgccgggccactgcgcctcgaggcgcctgggccgctcaagcggacggtgctgaccgagagcggcagcggctcccggcccgcgccccccgccgtcgggtcggtgcccttgcccgtgccggtgccggtgccagtgcccgtgccggtgcctgtgcccgagcccggcctagctccccaggggccccccggccggaccgacggccgcgcggacaagagcaaagggcaggtggtgctggccacggccatcgagatctgcgtctgagtcgcctccgccgccctcggacccgggagcagcccgggcccgccccgagccggtgcccggtgcggcggtagggaatggagccacctcgccgcggggcagggggcgcagcggtagactaggcaggacgcggcccggcacctggtccgtccccggcgggctggtgagggggccaccaaagacccctagcgcggcctggtgagcgggggcttggcccagaggagccaagccgcacagacccgagaattcggaggccaccacacaacacacacacacacacacacacacacacacacacacacacacacacacacacacacgccaggagcaagggagctttcgggccacactcccagacgcctccctgagccctggaacccggactcgttgctcctggccttccataccccctggcagatcatcctgcggtcccaccccagatcccctcctcctcgccatcccattctgccccctccccaccctgggtacagaaagggactgaagtgttgggcagagagggggcttaaggcccctgggcacaggctgggatcagggcagtgagcgaagggcagctgtgtcctgccctcccttctggaggctggaggggagaggccaagcccttggaaaatgtagcaaatgtctggatgtcgcataagtgcgtgtatgtgcgggacaggccccgagaagctagtgactcctgcacacccccattgcacaaatgaaatcacagcccaggagggagggtagcttggcactggctgagaaatagagctctctccccgcccctccccctaaccacaagggattgtcctgacaacttgtggggatagaagggctcacagggcaggggtctcagctgcccccatccttagggcaggggagttagtgtggagccgagagcaggtcccagctccccctgccagccgcactgtcccaggcccagggacctctgccgggtcctcccagcccttgccacacagcctagacgtagtagcctgggcttccagcaggtggcgagctggttcgtgctggaaatttctcctgggtttcttggggtcaaacatgccaacctccaagaccccatcctcacgtctcccacttttctggcgctggagtgtgcagggcgtaggacctgcatgtgtgggtgtgagaatgggggcggtggacaccagggggcgagtgtgtgactaggtgtgtgtgcacatgtgtagggtgcagacgcatgggtgccatcctttgcgttcagtgactgtgcgtccagacccctcaccagcggcccccccaccacaccctggtcctcccaggcagctgtcccagggcgcccaggcctgccttgcaccacagccctcaggaaatccggcaaggaggcccctgcaggttggttcaggcccccaggtagcaaaacagagacaacagcagccccgcctgaccccctgcccctctctgtggaggcccgggacccccgcaataagcaccacatgggtgaggctgtccctgtcagggtcccctgccagggtccctcctggggttctgggccatttgaggggctctttgatgggccaggccggccagagtgaactccgagcactttctggctggtgccccaacctctccactccccactcattcccaccttgaaaaagggctataggtcccctgccctgcccgggtccagtttacaaacagtgtggggtggccccagggcctggccccactctccctgctgtgcccactcctctccagactccacctccccagtgggtatgggccctccacatgccaggtaagtagcaaacccccactccctccaaggaccaggtctcagagaaggccctggtcactgcccccggcccacctggagcccatcggggctgcctctcccagccgcgacttctccttttgccttaggcctcgcgacatcctgatctctcctgcaataactaggaatcgagattccacagtagacgtcccttgccgtgctcgctctctctctcgcgcgcgctctctctctccctctctctctctctctctctctctctctctctctctctctctctctctcctctctttctctctctccctctctctgttaagatcctgttcgggagtttccccagccgttgtagtatctagtatgttagagttgggaggggaccatagttatgtagcccagccccctcattcccagaggcacccagagggccagcctccagcctgaccccagagcagaaccggaacaccaggttggggccctggtgctgccacctcctctgctggtcgggctgggaccctttgccccttaggagaggtgttggtcacagatgtttacctcagtttatgtcactgtcgaagaaacaaaaaataatagcaaaaaataacactgtagacatgaagacttagaagacaaaaaaaaaaaaatcacacaaaaaatctcccttgttgcgattcttctgtgaaggtacagtgtgtatgtgtgtatgtgtgtatgtgtgtgcgtgtctctgtcccagaccctgtgtcccccacactgccccctgtccttcggtgcttcccagagacccctctgagctggcctgtggggcacgggaagccccctggatgggaggcggggccacaggtcggctagagggtctccaccaggcccactgaacagaaccccacggctgccagaatgttccctgagcccacactgtggccagtgggacagtcctggtggctgacatcagcgtccatgcttggctcagggcctggggcggggtcctgggtagagtcctagccccagagccccagcccctcatgtcttgccgcccttcctccatgtgtttgtaaatactctggcatcctttggccctgagaaggtttttaaatgtgttatttacttctctaaacatgacgattgctataaaaataaacaaaagtttagaaaaatga

SEQ ID NO: 181070 - DNA, 1056 bp, Homo sapiens
  Payload ID: 15658
  Gene Symbol: SBK2
  Gene Name: SH3 domain binding kinase family, member 2
  Uniprot ID: P0C263
  ENST ID: ENST00000344158
  CDS Start-End: 10-1056
ctcgcagagatgcccggcaaacagtctgaggaagggccggcggaggcaggggcttcggaggacagcgaggaggagggtctgggcggcctgacattagaggagctccagcagggccaggaggctgcccgcgcgctggaggacatgatgacgctgagtgctcagaccctggtccgagccgaggtggacgagctctacgaggaagtgcgtcccctgggccagggttgctatggccgcgtccttctggtcacccatcgtcagaaaggcacacccctggcactgaagcagctcccgaaaccccgcacgtccctccgtggcttcctgtacgagttctgtgtggggctctcgctgggcgcgcactcagccatcgtgacggcctacggcattggcatcgagtcggcacactcctacagcttcctgacggagcccgtcctgcacggggacctcatggccttcatccagcccaaggtgggcctcccgcagcccgcggtgcaccgctgcgccgcccagctggcctccgccctggagtacatccacgcccgcggcctggtgtaccgggacctgaagccggagaacgtcctggtgtgcgacccggcctgccggcgcttcaagctgaccgacttcggccacacgaggcctcgcgggacgctgctgcgcctggccgggccgcccatcccctacacggcccccgagctctgcgcgcccccgccgctccccgagggcctgcccattcagcccgccctggacgcctgggcgctgggcgtcctgctcttctgcctcctcacgggctacttcccctgggaccggcccctggccgaggccgaccccttctacgaggacttcctcatctggcaggcgtcgggccagccccgggaccgccctcagccctggttcggcctggccgccgcggccgacgcgcttctgcgggggctgctggaccctcacccccgaaggaggagcgctgtgatcgccatcagggagcacctggggcgcccctggaggcagcgggagggcgaggcggaggcagtgggagcggtggaagaggaggctgggcagtga

SEQ ID NO: 181071 - DNA, 1085 bp, Homo sapiens
  Payload ID: 15658
  Gene Symbol: SBK2
  Gene Name: SH3 domain binding kinase family, member 2
  Uniprot ID: P0C263
  ENST ID: ENST00000413299
  CDS Start-End: 39-1085
gccggcggccggagggtcaggagggccttggaggagagatgcccggcaaacagtctgaggaagggccggcggaggcaggggcttcggaggacagcgaggaggagggtctgggcggcctgacattagaggagctccagcagggccaggaggctgcccgcgcgctggaggacatgatgacgctgagtgctcagaccctggtccgagccgaggtggacgagctctacgaggaagtgcgtcccctgggccagggttgctatggccgcgtccttctggtcacccatcgtcagaaaggcacacccctggcactgaagcagctcccgaaaccccgcacgtccctccgtggcttcctgtacgagttctgtgtggggctctcgctgggcgcgcactcagccatcgtgacggcctacggcattggcatcgagtcggcacactcctacagcttcctgacggagcccgtcctgcacggggacctcatggccttcatccagcccaaggtgggcctcccgcagcccgcggtgcaccgctgcgccgcccagctggcctccgccctggagtacatccacgcccgcggcctggtgtaccgggacctgaagccggagaacgtcctggtgtgcgacccggcctgccggcgcttcaagctgaccgacttcggccacacgaggcctcgcgggacgctgctgcgcctggccgggccgcccatcccctacacggcccccgagctctgcgcgcccccgccgctccccgagggcctgcccattcagcccgccctggacgcctgggcgctgggcgtcctgctcttctgcctcctcacgggctacttcccctgggaccggcccctggccgaggccgaccccttctacgaggacttcctcatctggcaggcgtcgggccagccccgggaccgccctcagccctggttcggcctggccgccgcggccgacgcgcttctgcgggggctgctggaccctcacccccgaaggaggagcgctgtgatcgccatcagggagcacctggggcgcccctggaggcagcgggagggcgaggcggaggcagtgggagcggtggaagaggaggctgggcagtga

SEQ ID NO: 181072 - DNA, 480 bp, Homo sapiens
  Payload ID: 15659
  Gene Symbol: SBK3
  Gene Name: SH3 domain binding kinase family, member 3
  ENST ID: ENST00000592464
  CDS Start-End: 1-480
acccctgaggatggggacccagaggtgagagacgggagccaggggaggaagacagagagagaaaagaaggagagagaggcaggaggcaacacggggagagagaggaagagaaacagaaaacagggaaacgcaaagacctcagagacccagacccagggagagaggatgacagagatccaaggacacacagcgagaccaaggcccccagagaattggactcagaaacacacagcgggatgcacaggggaagaggacggtggagagagagaccagggaggacacagccacagccctccaacggctggtggagctgacgaccagcagggtgaccccggtgaggagccttcgggaccagtaccacctcatccggaagctgggctccggctcctacggccgcgtgctccttgcccagcctcaccaggggggtccagctgtggctctgaagctcctgcgtcgggatttggtcctgagaagcacctt

SEQ ID NO: 181073 - DNA, 1270 bp, Homo sapiens
  Payload ID: 15659
  Gene Symbol: SBK3
  Gene Name: SH3 domain binding kinase family, member 3
  Uniprot ID: P0C264
  ENST ID: ENST00000612221
  CDS Start-End: 1-1080
atggagcgcagggcctccgagacccctgaggatggggacccagaggaggacacagccacagccctccaacggctggtggagctgacgaccagcagggtgaccccggtgaggagccttcgggaccagtaccacctcatccggaagctgggctccggctcctacggccgcgtgctccttgcccagcctcaccaggggggtccagctgtggctctgaagctcctgcgtcgggatttggtcctgagaagcaccttcctgagggagttctgtgtgggccgctgcgtctctgcacacccaggcctgctgcagaccctggcaggacccctacagaccccccgctattttgccttcgcccaggagtacgcgccctgtggggacctcagcgggatgctgcaggaaaggggcctcccagaactgctggtgaagcgggtggtggcccagttggcaggagctctggacttcctccacagccgggggctggtccacgcagatgtcaaacctgacaacgtgctggtcttcgacccggtctgcagccgtgtggccctgggagacctgggtctgacccggccagagggcagcccgacccccgccccaccagtgcctctgcccacggcaccgcctgagctctgtctcctgctaccgcccgacaccctgcctctgcggccagccgtggactcctggggcctgggggtgcttctcttctgtgctgccactgcctgtttcccttgggacgtggcactggcccccaaccctgagttcgaggccttcgctggctgggtgaccaccaagcctcagccacctcagccaccaccaccctgggaccagtttgcgcccccagccctggccttgctccaggggcttctggacctggatcccgagactaggagccccccactggctgtcctggacttcctgggggacgactgggggttgcaagggaacagagagggacctggggttttggggagcgccgtgtcctatgaggacagggaggagggaggctcaagcctggaggagtggacagatgagggtgatgacagcaaaagtggtgggaggacggggacagatgggggagctccctgaccaggtgacagagacaggtggccagagcctgggccagaggcccttcccccagcccccagggccacctggatggagagacagctgcacccgggaggacagagagggaacacattgcactctccctacggaacgctgggcttggacgcgcattcctcttccaactgaggacccaagagcccagctcctgccc

SEQ ID NO: 181074 - DNA, 5273 bp, Homo sapiens
  Payload ID: 15660
  Gene Symbol: SH3D19
  Gene Name: SH3 domain containing 19
  Uniprot ID: Q5HYK7
  ENST ID: ENST00000304527
  CDS Start-End: 1091-3463
tcatttttccccctccccattctgttagaagcttctgccaaccatgattcatggaatgatttttttgagctgagtaatctgtggctttgcagtttccttgctttctttccttagctaaatctcttctagtgttagcaaagtatttagcacaggaaagatcttataaaatgaaataatgcatgtaatgatgcattttccaagtagatgattttaacaaaccgtaagcttttatgcctgtccttcattgtgtcttttctgcctctgtcaggcgaactgtgatgaagagccttatacttaggaagacacaactacctttgaacagtcctttgtgaaatctaatgatcgcaacgaacgaaataaaccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaagttttgttttggtctcgtcagcactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctagatccctttcagctccctgcaaaaacagaaccaataaaagaacgagcagttcaaccagcacccaccaggaagcccactgtaattcgaattccagccaaaccaggaaaatgtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgctgtctgtgcctcatggaattgccaatgaagatattgtctctcaaaaccccggagaactctcttgtaagcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttacttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcagcagaatgataagtgcaatagttgtaaatctacttgacactgtaataaactgaactgaactttcaaagtc

SEQ ID NO: 181075 - DNA, 4888 bp, Homo sapiens
  Payload ID: 15660
  Gene Symbol: SH3D19
  Gene Name: SH3 domain containing 19
  Uniprot ID: Q5HYK7
  ENST ID: ENST00000409252
  CDS Start-End: 709-3081
ccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaacactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctagatccctttcagctccctgcaaaaacagaaccaataaaagaacgagcagttcaaccagcacccaccaggaagcccactgtaattcgaattccagccaaaccaggaaaatgtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgctgtctgtgcctcatggaattgccaatgaagatattgtctctcaaaaccccggagaactctcttgtaagcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttacttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcagcagaatgataagtgcaatagttgtaaatctacttgacactgtaataaactgaactgaactttcaaa

SEQ ID NO: 181076 - DNA, 5284 bp, Homo sapiens
  Payload ID: 15660
  Gene Symbol: SH3D19
  Gene Name: SH3 domain containing 19
  Uniprot ID: Q5HYK7
  ENST ID: ENST00000409598
  CDS Start-End: 1169-3472
gaaatccaacttctgaaatgttctgggtggtagatagttaagggtgaagctgtattggtcttagtatttgcagatgttgtagctgactgctcatttttccccctccccattctgttagaagcttctgccaaccatgattcatggaatgatttttttgagctgagtaatctgtggctttgcagtttccttgctttctttccttagctaaatctcttctagtgttagcaaagtatttagcacaggaaagatcttataaaatgaaataatgcatgtaatgatgcattttccaagtagatgattttaacaaaccgtaagcttttatgcctgtccttcattgtgtcttttctgcctctgtcaggcgaactgtgatgaagagccttatacttaggaagacacaactacctttgaacagtcctttgtgaaatctaatgatcgcaacgaacgaaataaaccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaagtaatgcaacactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctagatccctttcagctccctgcaaaaacagaaccaataaaagaacgagcagttcaaccagcacccaccaggaagcccactgtaattcgaattccagccaaaccaggaaaatgtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttacttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcagcagaatgataagtgcaatagttgtaaatctacttgacactgtaataaactgaactgaactttcaaagtccc

SEQ ID NO: 181077 - DNA, 2656 bp, Homo sapiens
  Payload ID: 15660
  Gene Symbol: SH3D19
  Gene Name: SH3 domain containing 19
  Uniprot ID: Q5HYK7
  ENST ID: ENST00000427414
  CDS Start-End: 190-2385
cccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctaggtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggc

SEQ ID NO: 181078 - DNA, 5107 bp, Homo sapiens
  Payload ID: 15660
  Gene Symbol: SH3D19
  Gene Name: SH3 domain containing 19
  Uniprot ID: Q5HYK7
  ENST ID: ENST00000514152
  CDS Start-End: 1000-3303
agccatttgcttcctgagtggccacattccagctgtgcagactggtcatagcacatctgccaatcagaacaggccctggagggaagcccttggatactgagtcttgtttacatgcatcgtgactctgtttctcccttcctcttgtgtgttgtaccactaggaagattagtggggaaatttgctattacatgcctaagtaaactatgtaactaggatcacagccacaggaaatgatgttctggacagagttttagctcggctttagccacagatcgcaacgaacgaaataaaccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaacactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctagatccctttcagctccctgcaaaaacagaaccaataaaagaacgagcagttcaaccagcacccaccaggaagcccactgtaattcgaattccagccaaaccaggaaaatgtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttacttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcagcagaatgataagtgcaatagttgtaaatctacttgacactgtaataaactgaactgaactttc

SEQ ID NO: 181079 - DNA, 5228 bp, Homo sapiens
  Payload ID: 15660
  Gene Symbol: SH3D19
  Gene Name: SH3 domain containing 19
  ENST ID: ENST00000604030
  CDS Start-End: 281-3424
agagcgggagtgggagtgggaaaggccagggattaagaggccgccgggacgccgcaaggaggcggggaatcggctcggcccgcgccctgccgctgcccggccggctgcaggtggagttcgcggaggtggccatttccacagccgccgccgacgcctcctctccgggagccgccttccccccggcccgagggcggtggcgtggggcgccgggtgcaggcgttctggggcgccggggccgcagctcgctggccatcccgcggctgcgccccgcgcctcgcccatggctgagggccggcggcgggaggacgaggaggaagagctacgcgagcgccgcgaacttggtggccagcgccgcgcccggggccgtgcgctctcgggccactcggccgcagatcgcaacgaacgaaataaaccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaacactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctagatccctttcagctccctgcaaaaacagaaccaataaaagaacgagcagttcaaccagcacccaccaggaagcccactgtaattcgaattccagccaaaccaggaaaatgtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttacttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcagcagaatgataagtgcaatagttgtaaatctacttgacactgtaataaactgaactgaactttc

SEQ ID NO: 181080 - DNA, 882 bp, Homo sapiens
  Payload ID: 15660
  Gene Symbol: SH3D19
  Gene Name: SH3 domain containing 19
  ENST ID: ENST00000462257
  CDS Start-End: 1-700
aaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctagaccatgtggaggcattacctttaacaagagagttaatcaataatctttttaaaagagctgaacataagcataattaggctgaaagaaactgggagaattatctcttgtcgtctttgccacttctgaagaactgcttcccccaatgaccctcagattctgataagtaaaaatttttaaaataataaaatagtgatttatctaaatggttatattattcaaggttacaaatagaagctacttgttatgaactaaatatgcc

SEQ ID NO: 181081 - DNA, 1168 bp, Homo sapiens
  Payload ID: 15661
  Gene Symbol: SH3D21
  Gene Name: SH3 domain containing 21
  ENST ID: ENST00000373139
  CDS Start-End: 35-1168
gagctgccaggctctggagggcgccccggaaaccatggaagtcctcgtcctggccggataccgcgcgcagaaggaggacgagctgagtctggcgcccggggacgtggtccggcaggtgcgctgggtgcccgcgcggggctggcttcgcggagagtttgggggccgctatggcctcttccccgagcgcctggtgcaggagatcccagagaccctgcggggctccggagaggcgcggaggccgcgctgtgcgcgccgccgaggtcatcctgccaaacacccgaggccccaaagatggtgcaaagtgaacttcagctacagcccagagcaggcggacgagctgaagctgcaagctggggagatcgtggaaatgataaaggagattgaggacggctggtggctggggaagaagaacgggcagctgggagccttcccatccaactttgtggaattgctggacagtgggcccccaagccttggtaacccagacatgccttcagtcagccctggtccccagcggcctcccaagctgagcagcctggcctatgacagccctccagactacctgcagacagtctcccaccctgaggtctacagggtcctgtttgactaccagcctgaggccccagacgagttggcgctgcggaggggggacgtggtaaaagtactcagcaagaccacagaggataagggctggtgggaaggagagtgtcaaggacgaagaggagtttttccagacaactttgtactcccaccacccccaatcaagaagctggtcccacggaaagtggtatctcgggaatcagctcctattaaggaaccaaaaaagttgatgcccaaaacatccctccccacagtcaagaagctagcaacagccaccactgggcccagcaaagccaagacatctcggacacccagcagggacagtcagaagctcacctcccgagactcaggccccaatggtggcttccaaagtgggggttcgtatcaccctggccgaaagcgatccaaaacccagactccccagcaacgctctgtgtccagtcaggaggaagagcacagcagcccggtaaaggccccctctgtgaagagaacccccatgccggacaagactgccaccccagagaggcccccagctccagagaacgcccccagctccaagaagatcccg

SEQ ID NO: 181082 - DNA, 2519 bp, Homo sapiens
  Payload ID: 15661
  Gene Symbol: SH3D21
  Gene Name: SH3 domain containing 21
  Uniprot ID: A4FU49
  ENST ID: ENST00000453908
  CDS Start-End: 29-2299
ccaggctctggagggcgccccggaaaccatggaagtcctcgtcctggccggataccgcgcgcagaaggaggacgagctgagtctggcgcccggggacgtggtccggcaggtgcgctgggtgcccgcgcggggctggcttcgcggagagtttgggggccgctatggcctcttccccgagcgcctggtgcaggagatcccagagaccctgcggggctccggagaggcgcggaggccgcgctgtgcgcgccgccgaggtcatcctgccaaacacccgaggccccaaagatggtgcaaagtgaacttcagctacagcccagagcaggcggacgagctgaagctgcaagctggggagatcgtggaaatgataaaggagattgaggacggctggtggctggggaagaagaacgggcagctgggagccttcccatccaactttgtggaattgctggacagtgggcccccaagccttggtaacccagacatgccttcagtcagccctggtccccagcggcctcccaagctgagcagcctggcctatgacagccctccagactacctgcagacagtctcccaccctgaggtctacagggtcctgtttgactaccagcctgaggccccagacgagttggcgctgcggaggggggacgtggtaaaagtactcagcaagaccacagaggataagggctggtgggaaggagagtgtcaaggacgaagaggagtttttccagacaactttgtactcccaccacccccaatcaagaagctggtcccacggaaagtggtatctcgggaatcagctcctattaaggaaccaaaaaagttgatgcccaaaacatccctccccacagtcaagaagctagcaacagccaccactgggcccagcaaagccaagacatctcggacacccagcagggacagtcagaagctcacctcccgagactcaggccccaatggtggcttccaaagtgggggttcgtatcaccctggccgaaagcgatccaaaacccagactccccagcaacgctctgtgtccagtcaggaggaagagcacagcagcccggtaaaggccccctctgtgaagagaacccccatgccggacaagactgccaccccagagaggcccccagctccagagaacgcccccagctccaagaagatcccggctcctgacaaagtcccctccccagagaagaccctcactctaggggacaaggcctctatcccagggaactccacctcggggaagatcccagctcctgacaaagtccccaccccagagaagatggtgactccggaggacaaggcttctatcccagagaactccatcatcccagaggagaccctgactgtggacaaaccctccactccagagagggtcttttcagtggaagagtcccctgccctagaagccccacctatggataaagtccctaatccaaagatggcccctctgggggatgaggcccccactctagaaaaggtcttgaccccagagctttctgaagaagaggtgtccaccagagatgacattcaattccatcacttctcttcggaggaagccctgcagaaggtcaagtactttgtagccaaagaggatccatcatcccaggaggaggcccacacgccagaggcacccccaccccagcctccttcctcagagaggtgcctgggagagatgaaatgtaccctagttagaggggacagctccccacgccaggctgagttgaagtctgggccagcatccaggcctgcccttgagaagccccacccccacgaagaggctacaacccttccagaggaggcaccttccaatgacgagaggacccctgaagaggaggcgccccccaacgagcagaggcctctgagagaggaggtgctccccaaagagggagtggcttccaaagaggaggtgaccctgaaagaggaattgccccctaaagaggaagtggctccaaaagaggaggtgccccccatagaaagagcctttgcccaaaaaacacgtcctatcaagccgcctccagactcccaagagacgctcgcgctcccctcgctggtcccgcaaaactacacggaaaacaagaatgaaggagttgatgtaacgtcgctgaggggcgaggtggagtctctaaggagggcgctggagctgatggaggtgcagctggagaggaagctgaccgacatctgggaggagctgaagagcgagaaggagcagcgccggcggctggaggtccaggtgatgcaggggacccagaagtcccagaccccgcgcgtcatccacacgcagacgcagacctactgagggtgggcctgggaagggaccgcggcctgacctggctggggccacccacgtccttgcacacgactttgggaaacgcgagaaagtaaactctgcctagcacggcgccacgccggtctggtcgctgggggcggggcctgcgcgggggcagggcctgggcctccgcattcctgacggtccctcccaggcacatctggccaacatgtggctcccattaccgttc

SEQ ID NO: 181083 - DNA, 2206 bp, Homo sapiens
  Payload ID: 15661
  Gene Symbol: SH3D21
  Gene Name: SH3 domain containing 21
  Uniprot ID: A4FU49
  ENST ID: ENST00000505871
  CDS Start-End: 165-2102
ccagctcctctgactggggcgtccgactggagctcagccgcgcttgtccggtgctaggtcatcctgccaaacacccgaggccccaaagatggtgcaaagtgaacttcagctacagcccagagcaggcggacgagctgaagctgcaagctggggagatcgtggaaatgataaaggagattgaggacggctggtggctggggaagaagaacgggcagctgggagccttcccatccaactttgtggaattgctggacagtgggcccccaagccttggtaacccagacatgccttcagtcagccctggtccccagcggcctcccaagctgagcagcctggcctatgacagccctccagactacctgcagacagtctcccaccctgaggtctacagggtcctgtttgactaccagcctgaggccccagacgagttggcgctgcggaggggggacgtggtaaaagtactcagcaagaccacagaggataagggctggtgggaaggagagtgtcaaggacgaagaggagtttttccagacaactttgtactcccaccacccccaatcaagaagctggtcccacggaaagtggtatctcgggaatcagctcctattaaggaaccaaaaaagttgatgcccaaaacatccctccccacagtcaagaagctagcaacagccaccactgggcccagcaaagccaagacatctcggacacccagcagggacagtcagaagctcacctcccgagactcaggccccaatggtggcttccaaagtgggggttcgtatcaccctggccgaaagcgatccaaaacccagactccccagcaacgctctgtgtccagtcaggaggaagagcacagcagcccggtaaaggccccctctgtgaagagaacccccatgccggacaagactgccaccccagagaggcccccagctccagagaacgcccccagctccaagaagatcccggctcctgacaaagtcccctccccagagaagaccctcactctaggggacaaggcctctatcccagggaactccacctcggggaagatcccagctcctgacaaagtccccaccccagagaagatggtgactccggaggacaaggcttctatcccagagaactccatcatcccagaggagaccctgactgtggacaaaccctccactccagagagggtcttttcagtggaagagtcccctgccctagaagccccacctatggataaagtccctaatccaaagatggcccctctgggggatgaggcccccactctagaaaaggtcttgaccccagagctttctgaagaagaggtgtccaccagagatgacattcaattccatcacttctcttcggaggaagccctgcagaaggtcaagtactttgtagccaaagaggatccatcatcccaggaggaggcccacacgccagaggcacccccaccccagcctccttcctcagagaggtgcctgggagagatgaaatgtaccctagttagaggggacagctccccacgccaggctgagttgaagtctgggccagcatccaggcctgcccttgagaagccccacccccacgaagaggctacaacccttccagaggaggcaccttccaatgacgagaggacccctgaagaggaggcgccccccaacgagcagaggcctctgagagaggaggtgctccccaaagagggagtggcttccaaagaggaggtgaccctgaaagaggaattgccccctaaagaggaagtggctccaaaagaggaggtgccccccatagaaagagcctttgcccaaaaaacacgtcctatcaagccgcctccagactcccaagagacgctcgcgctcccctcgctggtcccgcaaaactacacggaaaacaagaatgaaggagttgatgtaacgtcgctgaggggcgaggtggagtctctaaggagggcgctggagctgatggaggtgcagctggagaggaagctgaccgacatctgggaggagctgaagagcgagaaggagcagcgccggcggctggaggtccaggtgatgcaggggacccagaagtcccagaccccgcgcgtcatccacacgcagacgcagacctactgagggtgggcctgggaagggaccgcggcctgacctggctggggccacccacgtccttgcacacgactttgggaaacgcgagaaagtaaactctgcctagcacggcg

SEQ ID NO: 181084 - DNA, 3182 bp, Homo sapiens
  Payload ID: 15661
  Gene Symbol: SH3D21
  Gene Name: SH3 domain containing 21
  ENST ID: ENST00000480549
  CDS Start-End: 158-565
ctctgactggggcgtccgactggagctcagccgcgcttgtccggtgctaggtcatcctgccaaacacccgaggccccaaagatggtgcaaagtgaacttcagctacagcccagagcaggcggacgagctgaagctgcaagctggggagatcgtggaaatgataaaggagattgaggacggctggtggctggggaagaagaacgggcagctgggagccttcccatccaactttgtggaattgctggacagtgggcccccaagccttggtaacccagacatgccttcagtcagccctggtccccagcggcctcccaagaccacagaggataagggctggtgggaaggagagtgtcaaggacgaagaggagtttttccagacaactttgtactcccaccacccccaatcaagaagctggtcccacggaaagtggtatctcgggaatcagctcctattaaggaaccaaaaaagttgatgcccaaaacatccctccccacagtcaagaagctagcaacagccaccactgggcccagcaaagccaagaggaagagcacagcagcccggtaaaggccccctctgtgaagagaacccccatgccggacaagactgccaccccagagaggcccccagctccagagaacgcccccagctccaagaagatcccggctcctgacaaagtcccctccccagagaagaccctcactctaggggacaaggcctctatcccagggaactccacctcggggaagatcccagctcctgacaaagtccccaccccagagaagatggtgactccggaggacaaggcttctatcccagagaactccatcatcccagaggagaccctgactgtggacaaaccctccactccagagagggtcttttcagtggaagagtcccctgccctagaagccccacctatggataaagtccctaatccaaagatggcccctctgggggatgaggcccccactctagaaaaggtcttgaccccagagctttctgaagaagaggtgtccaccagagatgacattcaattccatcacttctcttcggaggaagccctgcagaaggtcaagtactttgtagccaaagaggatccatcatcccaggaggaggcccacacgccagaggcacccccaccccagcctccttcctcagagaggtgcctgggagagatgaaatgtaccctagttagaggggacagctccccacgccaggctgagttgaagtctgggccagcatccaggcctgcccttgagaagccccacccccacgaagaggctacaacccttccagaggaggcaccttccaatgacgagaggacccctgaagaggaggcgccccccaacgagcagaggcctctgagagaggaggtgctccccaaagagggagtggcttccaaagaggaggtgaccctgaaagaggaattgccccctaaagaggaagtggctccaaaagaggaggtgccccccatagaaagagcctttgcccaaaaaacacgtcctatcaagccgcctccagactcccaagagacgctcgcgctcccctcgctggtcccgcaaaactacacggaaaacaagaatgaaggagttgatgtaacgtcgctgaggggcgaggtggagtctctaaggagggcgctggagctgatggaggtgcagctggagaggaagctgaccgacatctgggaggagctgaagagcgagaaggagcagcgccggcggctggaggtccaggtgatgcaggggacccagaagtcccagaccccgcgcgtcatccacacgcagacgcagacctactgagggtgggcctgggaagggaccgcggcctgacctggctggggccacccacgtccttgcacacgactttgggaaacgcgagaaatgtatgaacccagggcactgtggggacagggcgacgtgtgtccaggcgtttgccggtccggctgcccggtgcgccagatctcccgcaggatccgttcgcgctcctccagccgctgcgcccgctccagctcctccgccgacgtgaagacgttgacgttgaggggcccgtccggctctgcggacagctcggggcccggcagcgtgtcgtcggggcccagccgagtcaccgtgtcctcctcgtcctcgtcgtcgtcctcgggctccagggtgctgctgcgggggtcccggcgctgagccgggccccggggccgcgggcggggcgcccacgagatgctgatgacgagcaggcagaggatcaaataaacggagtcttggagagattgaattgactttaccaaaaccgtcaggatttgaatctgctgctctctgatcctaaagcctgagctagaaaccaccgctccccctcctaggaggccccttccaggcaaagctgcttctcttccccagacccatgctggactggaagggaggggactgtccacccctccttccagggcccaggcttgaatgtgtcccctggccgagctctggtctagtcacgcagggttaatgattgttggactccagctttgagccagggcccggccagcagtctcgcagaccccagcgtggggcctctgtgcctgcgagctcctgcgctcttgtgcaccaagcagcttgtggcggcttgtggcagatcccaccccatcccgtcccccaccccaaggctaaacctgcctgtgctcacacacgcatttcccacctgggcttgtgcatgcaatgtggtgtgtgatcagtgtgtgtggcggggggcttccttctgccctgtctccacggggcccccccatcatggacctcccctcccttgctggagctagaatgagggggaggccgccttggcgggagccttagagaggaggaggaaagggggagaggaaattgcagacatagctgaaggcgctgcctgaggcctgtgggccagcgaccctctccctgtccgggctgcagacccctactcccccagtcccgagactgggttcaagtagagggcagatctagatgggggaggactaggactgactcctatggggatggaaaagggactcctgggtgtctttgtgactgtttagtgtgttctgtgaatgtgcgggcaggtatttttgcccacatctgtatatttgtctattaatgtgatgtatttgagtattgttgtgggggcgggtatgtctgtatataaatctgtgcagccactagtcaacaaa

SEQ ID NO: 181085 - DNA, 5272 bp, Homo sapiens
  Payload ID: 15662
  Gene Symbol: SH3RF1
  Gene Name: SH3 domain containing ring finger 1
  Uniprot ID: Q7Z6J0
  ENST ID: ENST00000284637
  CDS Start-End: 343-3009
cgccccgggcgccggctgcgtcccggcctcctcctcctcttcctccgccctccttggctgggaaagtgggaggcggcggcggcggcgtggtgtgtgtgcgcgcgtgaggggggcagcagagaggagtctcccggtgccgccgcggcgtcagagacactgcgagcggcgagcgcggtggggccgcatctgcatcagccgccgcagccgctgcggggccgcgaacaaagaggaggagccgaggcgcgagagcaaagtctgaaatggatgttacatgagtcattttaagggatgcacacaactatgaacatttctgaagattttttctcagtaaagtagataaagatggatgaatcagccttgttggatcttttggagtgtccggtgtgtctagagcgccttgatgcttctgcgaaggtcttgccttgccagcatacgttttgcaagcgatgtttgctggggatcgtaggttctcgaaatgaactcagatgtcccgagtgcaggactcttgttggctcgggtgtcgaggagcttcccagtaacatcttgctggtcagacttctggatggcatcaaacagaggccttggaaacctggtcctggtgggggaagtgggaccaactgcacaaatgcattaaggtctcagagcagcactgtggctaattgtagctcaaaagatctgcagagctcccagggcggacagcagcctcgggtgcaatcctggagccccccagtgaggggtatacctcagttaccatgtgccaaagcattatacaactatgaaggaaaagagcctggagaccttaaattcagcaaaggtgacatcatcattttgcgaagacaagtggatgaaaattggtaccatggggaagtcaatggaatccatggctttttccccaccaactttgtgcagattattaaaccgttacctcagcccccacctcagtgcaaagcactttatgactttgaagtgaaagacaaggaagcagacaaagattgccttccatttgcaaaggatgatgttctgactgtgatccgaagagtggatgaaaactgggctgaaggaatgctggcagacaaaataggaatatttccaatttcatatgttgagtttaactcggctgctaagcagctgatagaatgggataagcctcctgtgccaggagttgatgctggagaatgttcctcggcagcagcccagagcagcactgccccaaagcactccgacaccaagaagaacaccaaaaagcggcactccttcacttccctcactatggccaacaagtcctcccaggcatcccagaaccgccactccatggagatcagcccccctgtcctcatcagctccagcaaccccactgctgctgcacggatcagcgagctgtctgggctctcctgcagtgccccttctcaggttcatataagtaccaccgggttaattgtgaccccgcccccaagcagcccagtgacaactggcccctcgtttactttcccatcagatgttccctaccaagctgcccttggaactttgaatcctcctcttccaccaccccctctcctggctgccactgtccttgcctccacaccaccaggcgccaccgccgctgctgctgctgctggaatgggaccgaggcccatggcaggatccactgaccagattgcacatttacggccgcagactcgccccagtgtgtatgttgctatatatccatacactcctcggaaagaggatgaactagagctgagaaaaggggagatgtttttagtgtttgagcgctgccaggatggctggttcaaagggacatccatgcataccagcaagataggggttttccctggcaattatgtggcaccagtcacaagggcggtgacaaatgcttcccaagctaaagtccctatgtctacagctggccagacaagtcggggagtgaccatggtcagtccttccacggcaggagggcctgcccagaagctccagggaaatggcgtggctgggagtcccagtgttgtccccgcagctgtggtatcagcagctcacatccagacaagtcctcaggctaaggtcttgttgcacatgacggggcaaatgacagtcaaccaggcccgcaatgctgtgaggacagttgcagcgcacaaccaggaacgccccacggcagcagtgacacccatccaggtacagaatgccgccggcctcagccctgcatctgtgggcctgtcccatcactcgctggcctccccacaacctgcgcctctgatgccaggctcagccacgcacactgctgccatcagtatcagtcgagccagtgcccctctggcctgtgcagcagctgctccactgacttccccaagcatcaccagtgcttctctggaggctgagcccagtggccggatagtgaccgttctccctggactccccacatctcctgacagtgcttcatcagcttgtgggaacagttcagcaaccaaaccagacaaggatagcaaaaaagaaaaaaagggtttgttgaagttgctttctggcgcctccactaaacggaagccccgcgtgtctcctccagcatcgcccaccctagaagtggagctgggcagtgcagagcttcctctccagggagcggtggggcccgaactgccaccaggaggtggccatggcagggcaggctcctgccctgtggacggggacggaccggtcacgactgcagtggcaggagcagccctggcccaggatgcttttcataggaaggcaagttccctggactccgcagttcccatcgctccacctcctcgccaggcctgttcctccctgggtcctgtcttgaatgagtctagacctgtcgtttgtgaaaggcacagggtggtggtttcctatcctcctcagagtgaggcagaacttgaacttaaagaaggagatattgtgtttgttcataaaaaacgagaggatggctggttcaaaggcacattacaacgtaatgggaaaactggccttttcccaggaagctttgtggaaaacatatgaggagactgacactgaagaagcttaaaatcacttcacacaacaaagtagcacaaagcagtttaacagaaagagcacatttgtggacttccagatggtcaggagatgagcaaaggattggtatgtgactctgatgccccagcacagttaccccagcgagcagaatgaagaagatgtttgtgtgggttttgttagtctggattcggatgtataaggtgtgccttgtactgtctgatttactacacagagaaacttttttttttttttaagatatatgactaaaatggacaattgtttacaaggcttaactaatttatttgcttttttaaacttgaacttttcgtataatagatacgttctttggattatgattttaagaaattattaatttatgaaatgataggtaaggagaagctggattatctcctgttgagagcaagagattcgttttgacatagagtgaatgcattttcccctctcctcctccctgctaccattatattttggggttatgttttgcttctttaagatagaaatcccagttctctaatttggttttcttctttgggaaaccaaacatacaaatgaatcagtatcaattagggcctggggtagagagacagaaacttgagagaagagaagttagtgattccctctctttctagtttggtaggaatcaccctgaagacctagtcctcaatttaattgtgtgggtttttaattttcctagaatgaagtgactgaaacaatgagaaagaatacagcacaacccttgaacaaaatgtatttagaaatatatttagttttatagcagaagcagctcaattgtttggttggaaagtaggggaaattgaagttgtagtcactgtctgagaatggctatgaagcgtcatttcacattttaccccaactgacctgcatgcccaggacacaagtaaaacatttgtgagatagtggtggtaagtgatgcactcgtgttaagtcaaaggctataagaaacactgtgaaaagttcatattcatccattgtgattctttccccacgtcttgcatgtattactggattcccacagtaatatagactgtgcatggtgtgtatatttcattgcgatttcctgttaagatgagtttgtactcagaattgaccaattcaggaggtgtaaaaataaacagtgttctcttctctaccccaaagccactactgaccaaggtctcttcagtgcactcgctccctctctggctaaggcatgcattagccactacacaagtcattagtgaaagtggtcttttatgtcctcccagcagacagacatcaaggatgagttaaccaggagactactcctgtgactgtggagctctggaaggcttggtgggagtgaatttgcccacaccttacaattgtggcaggatccagaagagcctgtctttttatatccattccttgatgtcattggcctctcccaccgatttcattacggtgccacgcagtcatggatctgggtagtccggaaaacaaaaggagggaagacagcctggtaatgaataagatccttaccacagttttctcatgggaaatacataataaaccctttcatctttttttttttcctttaagaattaaaactgggaaatagaaacatgaactgaaaagtcttgcaatgacaagaggtttcatggtcttaaaaagatactttatgtggttgaagatgaaatcattcctaaattaaccttttttttaaaaaaaaacaatgtatattatgttcctgtgtgttgaatttaaaaaaaaaatactttacttggatattcatgtaatatataaaggtttggtgaaatgaactttagttaggaaaaagctggcatcagctttcatctgtgtaagttgacaccaatgtgtcataatattctttattttgggaaattagtgtattttataaaaattttaaaaagaaaaaagactactacaggttaagataatttttttacctgtcttttctccatattttaagctatgtgattgaagtacctctgttcatagtttcctggtataaagttggttaaaatttcatctgttaatagatcattaggtaatataatgtatgggttttctattggttttttgcagacagtagagggagattttgtaacaagggcttgttacacagtgatatggtaatgataaaattgcgatttatcactccttttcatgttaataatttgaggactggataaaaggtttcaagattaaaatttgatgttcaaacctttgt

SEQ ID NO: 181086 - DNA, 591 bp, Homo sapiens
  Payload ID: 15662
  Gene Symbol: SH3RF1
  Gene Name: SH3 domain containing ring finger 1
  ENST ID: ENST00000510806
  CDS Start-End: 355-591
cagagtttatcaactactgccctgaagggcgcttttctgttttagctgctttcaagcaaatctgtgtcttttagaattgtcaaccttcagctctttttggttgggcaaaattaaacagttctatttttaataacagcgaagaaacatatgtatttaatattgggatcatttaccacgagcgattacatgaggcatggtttcttaaacgctaaagtggcttaaaaaagggaatttagttggatataaaagtaaatttcagagcaaagtctgaaatggatgttacatgagtcattttaagggatgcacacaactatgaacatttctgaagattttttctcagtaaagtagataaagatggatgaatcagccttgttggatcttttggagtgtccggtgtgtctagagcgccttgatgcttctgcgaaggtcttgccttgccagcatacgttttgcaagcgatgtttgctggggatcgtaggttctcgaaatgaactcagatgtcccgagtgcaggactcttgttggctcgggtgtcgaggagcttcccagtaacatcttgctggtcagacttctggatggcatcaaacagagg

SEQ ID NO: 181087 - DNA, 1657 bp, Homo sapiens
  Payload ID: 15662
  Gene Symbol: SH3RF1
  Gene Name: SH3 domain containing ring finger 1
  ENST ID: ENST00000511421
  CDS Start-End: 1-911
ccaaagcattatacaactatgaaggaaaagagcctggagaccttaaattcagcaaaggtgacatcatcattttgcgaagacaagtggatgaaaattggtaccatggggaagtcaatggaatccatggctttttccccaccaactttgtgcagattattaaaccgttacctcagcccccacctcagtgcaaagcactttatgactttgaagtgaaagacaaggaagcagacaaagattgccttccatttgcaaaggatgatgttctgactgtgatccgaagagtggatgaaaactgggctgaaggaatgctggcagacaaaataggaatatttccaatttcatatgttgagtttaactcggctgctaagcagctgatagaatgggataagcctcctgtgccaggagttgatgctggagaatgttcctcggcagcagcccagagcagcactgccccaaagcactccgacaccaagaagaacaccaaaaagcggcactccttcacttccctcactatggccaacaagtcctcccaggcatcccagaaccgccactccatggagatcagcccccctgtcctcatcagctccagcaaccccactgctgctgcacggatcagcgagctgtctgggctctcctgcagtgccccttctcaggttcatataagtaccaccgggttaattgtgaccccgcccccaagcagcccagtgacaactggcccctcgtttactttcccatcagatgttccctaccaagctgcccttggagcgccaccgccgctgctgctgctgctggaatgggaccgaggcccatggcaggatccactgaccagattgcacatttacggccgcagactcgccccagtgtgtatgttgctatatatccatacactcctcggaaagaggatgaactagagctgagaaaaggggagatgtttttagtgtttgagcgctgccaggatggctggttcaaagggacatccatgcataccagcaagataggggttttccctggcaattatgtggcaccagtcacaagggcggtgacaaatgcttcccaagctaaagtccctatgtctacagctggccagacaagtcggggagtgaccatggtcagtccttccacggcaggagggcctgcccagaagctccagggaaatggcgtggctgggagtcccagtgttgtccccgcagctgtggtatcagcagctcacatccagacaagtcctcaggctaaggtcttgttgcacatgacggggcaaatgacagtcaaccaggcccgcaatgctgtgaggacagttgcagcgcacaaccaggaacgccccacggcagcagtgacacccatccaggtacagaatgccgccggcctcagccctgcatctgtgggcctgtcccatcactcgctggcctccccacaacctgcgcctctgatgccaggctcagccacgcacactgctgccatcagtatcagtcgagccagtgcccctctggcctgtgcagcagctgctccactgacttccccaagcatcaccagtgcttctctggaggctgagcccagtggccggatagtgaccgttctccctggactccccacatctcctgacagtgcttcatcagcttgtgggaacagttcagcaaccaaaccagacaaggatagcaaa

SEQ ID NO: 181088 - DNA, 487 bp, Homo sapiens
  Payload ID: 15662
  Gene Symbol: SH3RF1
  Gene Name: SH3 domain containing ring finger 1
  ENST ID: ENST00000502315
  CDS Start-End: 189-487
gcggccggcgcggggtcgacggggacccagcgtcggcggacccctagccgcggagaaggcggtggtctcgacattcccccatccccgccctggagcaaagtctgaaatggatgttacatgagtcattttaagggatgcacacaactatgaacatttctgaagattttttctcagtaaagtagataaagatggatgaatcagccttgttggatcttttggagtgtccggtgtgtctagagcgccttgatgcttctgcgaaggtcttgccttgccagcatacgttttgcaagcgatgtttgctggggatcgtaggttctcgaaatgaactcagatgtcccgagtgcaggactcttgttggctcgggtgtcgaggagcttcccagtaacatcttgctggtcagacttctggatggcatcaaacagaggccttggaaacctggtcctggtgggggaagtgggaccaactgcacaaatgcattaaggtctca

SEQ ID NO: 181089 - DNA, 3027 bp, Homo sapiens
  Payload ID: 15663
  Gene Symbol: SH3RF2
  Gene Name: SH3 domain containing ring finger 2
  Uniprot ID: Q8TEC5
  ENST ID: ENST00000359120
  CDS Start-End: 223-2412
aaagcggttggcagcagcggcgcttggaggaaaggaagccggttggagggcgcagcgcacccctgctgcgcggaggagggggctgagctgaactcagcagaagttacatgcacaaggcaaaaattctgacgttctcaagagaccagctctgcccccgtggctcaactgaccctaccatgtggacgctgctcctccaggtgggaactggagttttgaaataaaatggatgatttgacgttacttgatcttctggagtgccctgtgtgctttgagaagctcgatgtcacagccaaagtcctcccttgccagcacaccttctgcaaaccatgtctacagagggttttcaaggcccacaaagagctgcggtgccccgaatgcaggacgcctgtgttttccaacattgaggcgctgccggccaacctgctgctcgtgcgccttctggatggagtgcgctcagggcagagctccgggagagggggctccttccgcaggcctggcacgatgaccttgcaggatggcaggaaaagcaggaccaaccccagacgtctgcaggccagtcctttccggctagtgcctaatgtcagaatccacatggatggggtgcctcgagcaaaggccttatgcaactacagagggcagaatcccggtgacctaaggtttaataagggagatatcatccttctccggagacagcttgatgagaattggtaccagggggaaatcaatggcatcagcgggaacttcccagccagctccgtggaagtcatcaagcagctgccccagccgcccccgctctgcagggccctctacaacttcgacctacgaggcaaggacaagagtgagaaccaggattgcctgaccttcctcaaggacgatatcatcactgtgatcagccgagtggatgagaactgggcagaaggcaagttaggagataaagtaggcatcttccctatcttgtttgtagagccaaacctcaccgcaagacaccttttagagaagaacaaaggtcgccagtcatcccgcacaaaaaacctgtccctggtgtcctcgtcctccagaggcaacacgtctaccctccgtaggggcccagggtccaggaggaaggtgcctgggcagttttccatcacaacagccttgaacactctcaaccggatggtccattctccttcagggcgccatatggtagagatcagcaccccagtgctcatcagctccagcaacccctctgtgatcacccagcccatggagaaagcagacgttccttccagctgtgtgggacaggtcagcacttatcaccccgcacctgtctctccaggacattccacagccgtggtcagtctgcctggctcccagcaacacctctcagcgaacatgtttgtagccctgcactcctactcagcccatggacccgatgagctggacctgcaaaagggagaaggcgtcagggtcctggggaagtgccaggacggctggctcaggggcgtctccttggtcaccgggcgagtcggcatcttcccaaacaattacgtcatccccattttcagaaagacctctagttttccagactcccggagccctggtctctacaccacatggacgttatccacctcctctgtgtcctcccaaggcagcatttcagaaggtgatccacggcaaagccgtcccttcaaatccgtctttgtgcccactgccatagtcaaccccgtgagaagcacagccggccctgggactttaggacaagggtctcttcggaaagggcggagcagcatgagaaagaatggatccctgcagagacccctccagtccgggatccccactctcgtggtaggctccctcagacgcagccccaccatggtccttcggcctcagcagttccaattctaccagccacaggggatcccctcctccccctcagccgtggtggtggagatggggtccaagcctgccctcacgggggagcccgccctcacgtgcatcagcaggggcagtgaggcctggatccactccgcggccagctccctcattatggaagacaaagaaatccccatcaagagtgagcctctgccaaaaccgcccgcatctgccccaccatccatcctggtgaaaccagaaaactcaagaaatggcatcgaaaagcaagtcaaaaccgtgagatttcagaattacagccctcctcccaccaaacattacacctcccatcccacctccggaaagcctgaacagccagccaccctcaaggcgtcccagcctgaagcagcgtccttgggcccagagatgaccgtcctatttgcccaccgaagtggctgccactccggacagcagacagacctccggagaaagtcagctcttggcaaggccacaaccctggtgtccactgcctcaggcacgcagaccgtgtttcccagcaaatgaacctacgggtggcttttcctagaccccaaagaggtgaattgcatttaaatacagtctgcctccactgagggcatcctgccattctttggggacttgagcatgggtccttgttcttcctatttcacctccaggaaagcaaaagtgggagcagaaattcctgccctgggtgggaggatagatggcgtggccttccaaacatacaaacataatgatttgatgccacaaagctcgcttactcagaccaaggagtgaaaaattgtcgtgcccactttatgccccagcatggagtatgtggcctcttgtcatccccgtgttactgtgtagaatttctatggtgtcctaaagggggctgcagcaggggtgtgacaacggtgggattgttggcgttgcttctttgaccttacaatatcctcaacaagcattagaacaacttctgccatcttctggggcctgtacactggccactagtagctgccatatctttttccctctgtaaagtcataatcctggctgcaaagggaggatttctgcgcggggtgtgaggtggatactttgaacattctgagaacccaataaaactagaaggagccagcttcctgagtatgctccacttaa

SEQ ID NO: 181090 - DNA, 5607 bp, Homo sapiens
  Payload ID: 15663
  Gene Symbol: SH3RF2
  Gene Name: SH3 domain containing ring finger 2
  Uniprot ID: Q8TEC5
  ENST ID: ENST00000511217
  CDS Start-End: 53-2242
cctaccatgtggacgctgctcctccaggtgggaactggagttttgaaataaaatggatgatttgacgttacttgatcttctggagtgccctgtgtgctttgagaagctcgatgtcacagccaaagtcctcccttgccagcacaccttctgcaaaccatgtctacagagggttttcaaggcccacaaagagctgcggtgccccgaatgcaggacgcctgtgttttccaacattgaggcgctgccggccaacctgctgctcgtgcgccttctggatggagtgcgctcagggcagagctccgggagagggggctccttccgcaggcctggcacgatgaccttgcaggatggcaggaaaagcaggaccaaccccagacgtctgcaggccagtcctttccggctagtgcctaatgtcagaatccacatggatggggtgcctcgagcaaaggccttatgcaactacagagggcagaatcccggtgacctaaggtttaataagggagatatcatccttctccggagacagcttgatgagaattggtaccagggggaaatcaatggcatcagcgggaacttcccagccagctccgtggaagtcatcaagcagctgccccagccgcccccgctctgcagggccctctacaacttcgacctacgaggcaaggacaagagtgagaaccaggattgcctgaccttcctcaaggacgatatcatcactgtgatcagccgagtggatgagaactgggcagaaggcaagttaggagataaagtaggcatcttccctatcttgtttgtagagccaaacctcaccgcaagacaccttttagagaagaacaaaggtcgccagtcatcccgcacaaaaaacctgtccctggtgtcctcgtcctccagaggcaacacgtctaccctccgtaggggcccagggtccaggaggaaggtgcctgggcagttttccatcacaacagccttgaacactctcaaccggatggtccattctccttcagggcgccatatggtagagatcagcaccccagtgctcatcagctccagcaacccctctgtgatcacccagcccatggagaaagcagacgttccttccagctgtgtgggacaggtcagcacttatcaccccgcacctgtctctccaggacattccacagccgtggtcagtctgcctggctcccagcaacacctctcagcgaacatgtttgtagccctgcactcctactcagcccatggacccgatgagctggacctgcaaaagggagaaggcgtcagggtcctggggaagtgccaggacggctggctcaggggcgtctccttggtcaccgggcgagtcggcatcttcccaaacaattacgtcatccccattttcagaaagacctctagttttccagactcccggagccctggtctctacaccacatggacgttatccacctcctctgtgtcctcccaaggcagcatttcagaaggtgatccacggcaaagccgtcccttcaaatccgtctttgtgcccactgccatagtcaaccccgtgagaagcacagccggccctgggactttaggacaagggtctcttcggaaagggcggagcagcatgagaaagaatggatccctgcagagacccctccagtccgggatccccactctcgtggtaggctccctcagacgcagccccaccatggtccttcggcctcagcagttccaattctaccagccacaggggatcccctcctccccctcagccgtggtggtggagatggggtccaagcctgccctcacgggggagcccgccctcacgtgcatcagcaggggcagtgaggcctggatccactccgcggccagctccctcattatggaagacaaagaaatccccatcaagagtgagcctctgccaaaaccgcccgcatctgccccaccatccatcctggtgaaaccagaaaactcaagaaatggcatcgaaaagcaagtcaaaaccgtgagatttcagaattacagccctcctcccaccaaacattacacctcccatcccacctccggaaagcctgaacagccagccaccctcaaggcgtcccagcctgaagcagcgtccttgggcccagagatgaccgtcctatttgcccaccgaagtggctgccactccggacagcagacagacctccggagaaagtcagctcttggcaaggccacaaccctggtgtccactgcctcaggcacgcagaccgtgtttcccagcaaatgaacctacgggtggcttttcctagaccccaaagagagcctgccttggtcatcttcccaggaggaattcatgacaactgggatgcagaagagagcaaatgatctgctgggatggaaactgctcaatggagagtttgtggactgcatgatattccttgaacatcagggatggtacagggataccaatagtctggcctccaagacaggagagtaataggaggaagagcaaatctgtcttcacctgcagtattaatgggtggtgggccagaatggaggaaagcaagtgagtcatgtgctgctacaggttacaccaaactcccatccctctgttactcactgctgttgtcaaagccaaactttatcttgctaatttctcacagcttggcacctaacaaatgacaaggcaggacatccaatgccttcgagctctgtggtctggcctgtctctccagatcagatttagagtgaggtagcagatgacataatattctctttggtgttcaatccgaagaggccaatgcttcagcacaatgtcccctagccatcacccccagcccgactccccaccaagcatcctgcatccctctgccacatcttcattcttttccattctgtcttttccccgataccttctgaccccagggatttctaatagagcataatgatcaagaaaataaagacctggtacataaagagtctcagaaaaaaaatccatgatgttatatgaaagataccaaactgcaatgcttacaaagaggctatttcaagtagaaagatataaatatcacttataaccatgcatcctttatgttcataaataagtcatcataaagaacaagccattagaagacattctaatccttgtttttaaaaaaaagactataatctaagatacaattctaaaattactgtgctaacctgcaagagacattgctcacataaatgaaattcatatataccgtgatgttatttgaaccatatattttcatcttctcctcctctcttaagacatcaataagaatttgatttttaaaggcacatgctgctctgattatcaaagacaataacacaaatgcagcatcactgggatatgtcggttgttttaaagttcagatcctaattttactgaggaagcatcctcagtttttcatccagccctgcttgtaaacaggatccagcatcagccagaccatgagcagagtaaggattgcatctggaggttacagaaatgttttcttctatgtgaagctatcacatgcaggggttaaacaggcagccatcttttaatgcgatgaataatttggacttcttagccacacccttgtctcggttaaccacaggaggaggtgacaatacaccacaagaagccccagagttctggctttatctgccaagtggtaggtgagaagggaagaggtgggattgagcacactggctatttataccttgtcttcaaagccctcttagtcacatttccatcttcatgcattggcttctgccttacaattgagcaataggaaaccaccactcctaatttttgcacgtgctgctttttaagtctctgggaactttccatgaggtatagtggagggtttcataaggatttagctcttccttcgaacctgcttggccgataaaccagatatttttttaaaacacagcatacagattccaaatgatcaaggatcaaaaagtgttggggatgtcaggaaggatgcaaggatgggcttgaatgatcacaatgagtcaacccagaaatgtgcagtagaatagtttgctaatggtgacatctgagttgcatctcccggaaatattgtttcttattattacactttgggtcgggggaaggggtgttaagggtaaaaagaggaaggagcaaatagataaagagaaaaattcatgcctccaggaaacataagcagaaaaactatagacttgtgtctctgcttatttttttaagtacagtgtttttaatagaccaaagagaatctctatgagttaatatgtatgtgaataatgtttataaaaggggtataatgtgttagtcattatggaatattgtataaataaaccttccatatataaaacatataaaaaatgattgcttagggcagtggacacttaaggacttccaaacctttcatatcttcatcccaaaaaatagagcgttccagggctggcaacttatttccttagtatattccactgtaaagccaagaggtgtgggggcttgttttctggttttgtaatttgtaataatccgtatggattactgtaaaatgtctgttgcatgtgtgttggtgttggtgttggtgttgtttacccacatggagtcatcagagatttgttccacactttgtatcctggaaaaccaaaaggaattttcttttcttcgagacagagtctcgctctgtcgcccaggctggagtgcagtggtgccatcttggctcactgcaacctccgcctcccgaattcaagtgattctcctgcctcagcctcccgagtagctgggactacaggtgcgtgccaccttgccctgctaattttttgtatttttagtagagacggggtctcaccgtgttagccaggattgtctcgatctcctgaccttgtgatctgcccgcctcggcctcccaaagtgctgggattacagacgtgagccaccatgcccggcctggaattttctagtaagaagaaaaacatacagaatatgtcttcactgttgggtaactctcaaatttgtagcaatccagattttttgtaaaactgtgctaatgggatatttaatgtcagagttattgtctctcacttcaatatctagtactggataatgtttctcctgggagcacgtatttttttttcaagtcctcttttcctggacttaacatgttcttctagaagacaccagaagtcatgaccctaagccccctcccttcaggaccactttctaccatcggttttcaaaaaactatccacatgttaattctgttttatgttctgtgattctgtggtagactcagtgctttcagagtccagagcttgacttgggttagtggccttaatgaagtgctaaatttgctctttaccgcgagactgatcagaagaagcaaaaggggaaagggggctagaggtccactcgcaccttttacatcagacaagaggaggactgtgccagaaatctgtgcatgaaacaccatctgctcttcatgcagggaggggtcaaccgtgtgaacgtgcagagattactcgagccttctttgccaaaaatatgcattcttcccagctgtaagcgtgtgaagccaaatatgtcttttagcatgaaacaataaaaacatgtttattttcacttaataggttattccccaggcc

SEQ ID NO: 181091 - DNA, 5803 bp, Homo sapiens
  Payload ID: 15664
  Gene Symbol: SH3RF3
  Gene Name: SH3 domain containing ring finger 3
  Uniprot ID: Q8TEJ3
  ENST ID: ENST00000309415
  CDS Start-End: 194-2842
ccggtccccgccacgcaggccggtcggtgagccacttcgcaccgccacagccctagcatcgggccaccagccggggtgaagaaagtcacggcggagcccggctccccagtcctgatgctggctgccggtggcgggctccacgccggccccgggacctaggcagccgcgcgagaccgctgcgggcgcctcccccatgctgctcggagcgtcctggctgtgcgcatccaaggcggccgccgctgctgcgcagagcgagggcgacgaggacaggccaggcgagcgacggcggcgtcgggcggcggccaccgccgcgggggcgggcgaggacatggacgagtcgtcgctgctggacctgctggagtgctccgtgtgtctggagcgcctggacaccacggccaaggtgctgccatgccaacacactttctgccgccgctgcctggagagcatcgtgtgctcgcgccacgagctgcgctgccccgagtgccgcatcctggtgggctgcggcgtggacgaactgcccgccaacatcttgctggtgcgactgctggacggcatccgtcagcggccccgcgcgggcaccagccccggcggcagcccgcccgcgcgtcccatcccaggccagagtgcggcccccacgctcgcgggcggcgggggcggcgcggcaggcagcaccccgggttccccggttttcctctccgcggccgcgggcagcaccgccggcagtctgcgggagctggcgaccagcaggaccgcgccggcggcaaagaatccctgcctgcttccctatggcaaggccctctacagctacgaggggaaggaacctggtgacctcaagttcaacaagggggacatcatcgtcctgcggcgcaaggtggatgaacagtggtaccacggcgagctgcacggcacacagggcttcctcccagccagctatatccagtgcatccagcccttgccacacgccccgccccagggaaaagcactttatgatttcgagatgaaggacaaagaccaagacaaggactgtctgaccttcaccaaggacgagattctgacggtgctcaggagagtggatgagaactgggcggaaggcatgctgggagacaagatcgggatcttcccgctcctgtacgtggagctcaatgactccgccaagcagctcattgagatggacaagccatgcccagccgctgcatccagctgcaatgcctccctgccctctgactccggcgctgtggccagcgtggccccaagtcccactttaagcagctcaggggcggtcagtgcctttcagcggcgtgtggatggcaagaagaacaccaagaaacgccactccttcaccgcgctcagtgtgacgcacagatcctcccaggctgccagccacaggcattccatggaaattagtgctccagtgttgatcagctccagcgatccccgagccgcggccaggattggagaccttgctcatctgtcgtgcgctgctcccacccaggatgtctcctcctcggcgggatctacccccacggctgtcccacgggctgcctcggtgtctggagagcagggcacgcctcccaaggtccagctgcccctcaacgtgtacctggcgctctacgcctacaagccccagaagagtgacgagctggagctgcacaagggagagatgtaccgggtcctcgagaagtgtcaggatggctggttcaagggggcgtctctgaggaccggggtctctggggtgttccccggaaactacgtgacacccgtttccagggtgcctgcaggaggggcagggccgccccggaataatgtagtcggagggtctccactggccaaagggataaccacaaccatgcacccaggcagtgggagtctgagcagcctggccactgccaccaggcccgccctgcccatcaccactccccaggcccacgcccagcaccccacagcctcgcccccaacaggcagctgtctacggcactcagcccagccaacggccagccaagcccggagcaccatttcaacagctgcccactctgcagcccaggctcaggaccggccaactgccaccgtgtcacccctgcgcacccagaactctccatcccgcctgcctgccaccagcctcaggccccactcggtggtgtccccgcagcacagccaccagcccccggtgcagatgtgcccacggccggccatccccctcacatcagcagcatcagccatcacacctcccaacgtcagtgccgcaaacctcaacggggaggctggaggggggcccatcggtgttctgtccacatccagccccaccaacacgggatgcaaactagacgagaagaaaagtgaaaagaaagagaagaagagtgggctcctgaagcttctagccggagcatccaccaagaagaagtcacgctccccgccatctgtgtctccaacccacgacccccaggtggccgtggacgccctgctccaaggtgcagtgggccccgaagtgtcctcactgtccatccacggcagggcagggtcctgccccatagagagcgagatgcagggtgccatggggatggagcctctgcacaggaaggcaggctccttggatctaaacttcacatctccttcccggcaagctccgctgtccatggctgccatccgccccgagcccaagctgttgcccagagagaggtaccgcgtggtggtctcgtacccaccccagagtgaggcggagatcgagctgaaggaaggcgacatcgtctttgtgcacaagaagcgtgaggacggctggtacaaggggaccctgcagcggaacggccgcacaggcctcttcccgggcagcttcgtcgagagcttctgagaactggtgctccctgcacccagctcacagagggggaggccgcctgggaagctccacggcacacagagagggagccatggcgccccaagggttccaggtcatctccaaggcacctggcgggggataccctggcccagggtgggggccagggactgtggaggtcgtgccttctcccaaaacccccaaacggagagcacacctgggatgttcttcaaggaaatgcccaccccctctgtggaaactgcaaagaaagcaccttgaggaagagaggcaggtgccggcgcaggcaggcctgtggctgtggtttgcagccatggcagcgttctcatttaccacctaagcagggttggaggttgcaggaggtctgcaggcgaggtgggtggcatgggggccaggagcgctggagatcatctttctgggctgccctgggcttcccgcggggcccaggttgctctgtcaccattctatatacctcagtcacctgccgcccggctgctcagcaggggtgtttgtgaggccctgggggtgccccggaaggggcaccccaccgcccctgttgggaaccagagcagaatctgtgggcttgtcgcctgccagtagtataagcaacactttctgttcaccaccattgtcccttgcattacttctttcttacagcatatttttaacataaagctgttagactttatatatttctaataggtcagacattgcctatttttcatacatctggtgctgcctttttgtaaaactaataatgacttggttgagcttgaaagaaaagatgtctgaggcgacatcaaaggggcagaatttttatatttcccatatggctttgggagagcgccgagaagccgccatcccgcacctcagcgctggccagtactctgggggctggcggggtggatccattgagggggtcggagggagcttggaagcagccggtttctttaaactcttaccaaaaccccgcgctctgtctagacggtgatgattattattcaagacctggaaacatttcgaggaagggccactataattgtccttttgtgtggcggtagaaggagcacgcaggtcaaccccagccgggaaggcaaaatcttccctttattgcctcagagagaactgcaattagcattctcagaagatgatttcttggtatcaaaatgtgcagtttctacaacagtttagatcaccaccaccatttttcttcttttttaaaaataaataactgctcccatttcaggcagtgcaaaccttcatctgctggagaccagaggtacaaggagatcagggggttgcagcaccgctgcaggcttgcaagatcggggagttgggagggcgagagaggaggaggtgcagctttgatgctgggacctccctgagtggggctgatgaatgtatattcattagcaccatggctcacttcccaggaagactgatcaggagcccttcagggacaattttgttctcaagattcacaccttaggaacacatttttatcacctcaaaattttgatccatcacccctctctccacctatatttttacaaataccattcagacttaaattaagctgaagaaactagcctttggtaacatagggtgtcattggttttcagggatgtaaccaattccagaaatacattcttttgcctggcatgaagactttgaaacacgggccgcttattttcagagttcctgttttgggacgtgacttggctacttgttacttccaggtggtcaccacacggcgggggtcatgcctttccctcccccaagatgataatagatttaatagactcaaagaagttgttcagaatcaaagaagaaaaagtctggcttaaacatagtaacttctgtgtgccaggttaatgacaaccaaaagctctctatttaccattattgccaaacttcatcagttgcccatcctgcaccaaaatcctgtgcgtgtttaaattcacgttgtcaccaaagaggtgcacagatcaacaacctggatgacgcaggtgttctccagggaaaccagaccaagtcaagtctccaggtaacttttttgaagtcttttttttaaggcgcgcaggtaccaagcaacagaatagagtaacctgaacgttcttactctcccaggcatggcccacgtggtgcttcaggtagaaatgtgcttcaccctcctggtggggggcgaggacacagcccactgcatgcagcatggtagagagctggggcgaatatctccatgtctttggaggatgtcagctggccgctttcagggcagagtcgggtgggcgttggtgccaccttaggaaggagagcgatgcgtgggtctggccagagctctggagccaatgccgggctgcctgagagcagaggaaatgcatggcccatgtgcatttctgagtattttaaactcgttcaggccctgcagccttcatgatgatgtagctcgcagagaagagcaggagcagaattagccctttcttcaggccatcttgcctcaaagggtacacatgtttggcggttaagatgaaactaacccttatgtttcatcctggccccatgatgtacacatcttagccatgtagtggccttggggggccacagagatttcctttgaggagcatggtagagtccacagccatggctgaagtcagtggacaccgaggggacaggactgcaggccaccaggggcctctgcccagagggaggcagagaggatggcggccacgggtgctctcctggcatcctcatggggtgatgccaggccgggcacttcaaaacaggctcagccgactgggagatcctttgtactttgcacagttcacacacacaaacacacacaccctatcccaagtgtttttgttagacacaaatgtcagcgtgtgattttggaagacttgtcagtgatgacaaaccatgatgcctgtgtttctgagtctttaaataaaaatgaacatggag

SEQ ID NO: 181092 - DNA, 3861 bp, Homo sapiens
  Payload ID: 15665
  Gene Symbol: SH3BP5L
  Gene Name: SH3-binding domain protein 5-like
  Uniprot ID: Q7L8J4
  ENST ID: ENST00000366472
  CDS Start-End: 1231-2412
atcgagggcatctgaccctgggtgcacgagtgaattaactgagttaatgttgactaagttcctggttagtattcacggagcaattggtgaccccaccaaaacgtcgttcaaggtgcaaggtccagaggcctcgaggagtgggatttacacatcggagccgtccgctcagacgccgttagtggagggttccgccgacttcacgggagtgaggaaagtcacttttggaaatcgactttgccttcgcccgcgaagcccgccagcgtccggactcgagttgcccccggagccactgccggaagtttaccagctcactttcggcgtcgcgcccgcctccgtggagcaggccggaagtggctttccggcagccgccgccgcagctccgtaaagcaagatggcactactcactctgaggctattatctccgttttatatctagtattcctcttctcaccagttactctcgatttccgtcccgcgccctaattttcttcagcaccacattctcatgtttttctttcattcagccttggtggagtatggtctggaggcaacctacggctagcctgagcaacgtggggcaccattttgtacggaaactgaaggcagggcgggggagtgtgaggcctcccgaggaggcccggcttgagagagagcgtgggagggagagcgttgttcaccgatgatgtatttccgcttctggtctgcctggtcgtttttggttggatcggcttgttgcggggagggagggggggagattgtttgcagcatagaagctccgcggacgggaaggtaaactgagctccccagagacgctcatcctacagcctcagctcgggcccagccttctctctccagctgccaccacagcctggaggcgcctgcctccaccctcccgaatggtgctcctcctagcaggcctcggtccaggatccaagccccctttgccccctgccttggagctgttgctccgggtttgtcacagtggactccctgtggcgggaagggaagaacttttgcacagacaaggcttcagctctaggaaccccactgacaacttgaatctcaacctctaacctagtgtgaggttcttcctgtgcccaccttttctgccttttgagaagagaaactcttctcctggccatctagagcccaggaagccccaagctggggccctggtcccagcatgtcagtcctctcttgtgcatagggctctgccctccccctgtcagcatggctgagctcagacaggttccaggagggcgggagaccccacagggggagctgcggcctgaagttgtagaggatgaagtccctaggagcccagtcgcagaagagcctggaggaggtggaagcagcagcagtgaggccaaattgtccccaagagaggaggaagaactggatcctagaatacaggaggagttggagcacctgaaccaggccagcgaggagatcaaccaggtggaactacagctggatgaggccaggaccacctatcggaggatcctacaggagtcggcgaggaaactgaatacacagggttcccacttggggagctgcatcgagaaagcccggccctactatgaggctcggcggctggctaaggaggctcagcaggagacacagaaggcagcgctgcggtacgagcgggccgtaagcatgcacaacgctgctcgagaaatggtgtttgtggctgagcagggcgtcatggctgacaagaaccgactggaccccacgtggcaggagatgctgaaccatgctacctgcaaggtgaatgaggcggaggaagagcggcttcgaggtgagcgggagcaccagcgagtgactcggctgtgccaacaggctgaggctcgggtccaagccctgcagaagaccctccggagggccatcggcaagagccgcccctactttgagctcaaggcccagttcagccagatcctggaggagcacaaggccaaggtgacagaactggagcagcaggtagctcaggccaagacgcgctactccgtggcccttcgtaacctggagcagatcagcgagcagattcacgcacggcgccgcgggggtctgcctccccaccccctgggccctcggcgctcctcccccgtgggggccgaggcaggacccgaggacatggaggacggagacagcgggattgagggggccgagggtgcggggctggaggagggcagcagcctggggcccggccccgcccccgacaccgataccctgagtctgctgagcctgcgcacggtggcttcagacctgcagaagtgcgactccgtggagcacttgcgaggcctctcggaccacgtcagtctggacggccaagagctgggaacgcggagtggagggcgccggggcagcgacggcggagcccgtgggggtcggcaccagcgcagcgtcagcctgtagccgaggggccagggttcctggcttgaatctgccaccacgggccggttggggcccacagtcttctcacgccctctcctctggggcctcgtcttcccgaaggtccccttctccagtgcttccctgggagaggccagctgtgttcgagtcctctgtgcctgccctggcgttctcacagcctcccccttcccctcagcaggcggctctctttgccttacccattcagaaggctcgccctcggcgctctgtctgcctctgcctgccagctcatcacgatctgcagggcattgaccctttgctttccctttctgctccctctctttccatctgtttggctttttccctcagggaacttggtctagaaggcactgggaagctcatcagagaaaatgggtgctgggcctgagtactcccgtcggaggggatggacagtcacccctcccgttggtttccagccccgccccccttcccaaggcaactctggagggtaccctaggtatgctgctgagccctgccccccgtcctgctccagcctgcccgtgtgtaacctgtaagatgtactgtgtgcctccggaagacaccacctttcccttcagcattccctttcatgacctgaggcactctgcgatgtgtgccccaaagcagaacttacagggcctgcaggaagctggtgtcagggagagaaacccaaccccactgtcaacatagggagcatcaccaactccagactggctcctgtgggtatggtgtttccgctgggctgggtcctcaacattgccaaggtgctagtgggtccctaagagggcccatgttgggggtgaagtcatgaggtcctgaaggcttaggcccctgtcattcccaccctcactcttgctgcacagttgtgtttactttttctgggtagaggatgctgaactgactcagcaccctcctgcaggacggggttagggaatttggtgctcaattgctctcccttgctcttccccaaactgaaaatacctactgcaggatccctcggggcacactgaagcttggctgccaaccctcttacttcctttgttacagggaggggttggcttggggtgaaaagttctgccctccgcagggagcagctccagctgcctggcagtgctcccagtttgtagggaagccacaccagatctgggtgccttgggagaaccagtccttccttttgacccaccccaggaagatggagtgctcttttctaggcccatgttctgccagcaaccgggatgcgtgggcaactggactctgcacgggggtctacaggttgagggaggttggtcacaatgagaacctcggggtttgaggtggccatgggcagacagccgaaagggagggagggtgtgggtgtgcgtgtgtgcatgtgctggtgtgtaagggggaaagggtctttcctggttttatttaaataaagtagtttatgtaaca

SEQ ID NO: 181093 - DNA, 2852 bp, Homo sapiens
  Payload ID: 15666
  Gene Symbol: SH3BP1
  Gene Name: SH3-domain binding protein 1
  Uniprot ID: Q9Y3L3
  ENST ID: ENST00000357436
  CDS Start-End: 314-2419
aacctgtggacggccgcggccggcggacacacagcagcgggggcccggccgggggtcgcccgggggcccggaagccggggaagagcgaggaaaccaacttggagagaggagtgacctgggggccgggggcggagtcgtgagcgggggaggagagagccggccgccagcaagagccgcgcggcggcccaggaagcgagagcgccgcccacccatccggggcaagagccgcgccgcaggagaggcaggctggaccgggggctccccgggcccgcgacccccgccgtgaccccgcagcccccagctcgcccccaagatgatgaagaggcagctgcaccgcatgcggcagctggcccagacgggcagcttgggacgcaccccggagaccgctgagttcctgggtgaggacctgctgcaggtagaacagcggctggagccggccaagcgggcagcccacaacatccacaagcggctgcaggcctgtctgcagggccagagcggggcagacatggacaagcgggtgaagaagcttcccctcatggctctgtccaccacgatggctgagagcttcaaggagctggaccctgattccagcatggggaaggccttggagatgagctgtgccatccagaatcagctggcccgcatcctggccgagtttgagatgaccctggagagggacgtcctgcagccactcagcaggctgagtgaggaggagctgccagccatcctcaaacacaagaaaagcctccagaagctcgtgtccgactggaacacactcaagagcaggctcagtcaggcaaccaagaattcaggcagcagtcaaggcctaggaggcagcccgggtagtcacagccatacgaccatggccaacaaggtggagacgctgaaggaggaggaggaggagctgaagaggaaagtggagcaatgcagggacgagtacttggctgacctgtaccactttgttaccaaggaggactcctatgccaactacttcattcgtctcctggagattcaggccgattaccatcgcaggtcactgagctcgctggacacagccctggctgagctgagggagaaccacggccaagcagaccactccccttcgatgacagccacccacttccccagggtgtatggggtgtcgctggcaacccacctgcaagagctgggccgggagattgccctgcccatcgaggcctgcgtcatgatgctgctttctgagggcatgaaggaagagggtctcttccgtctggctgctggggcctcggtgctgaagcgtctcaagcagacaatggcctcggacccccacagcctggaggagttctgctccgacccgcacgctgtggcaggtgccctcaagtcctatctgcgggagctgccagagcctctgatgaccttcgacctctatgatgactggatgagggcagccagcctgaaggagccaggggcccggctgcaggccctccaagaggtgtgcagccgcctaccccccgagaacctcagcaacctcaggtacctgatgaagttcctggcacggctggccgaggagcaggaggtgaacaagatgacacccagcaacatcgccatagtcctgggacccaacttgctgtggccacctgagaaagaaggggaccaggcccagctggatgcagcctccgtgtcttccatccaggtggtgggcgtcgtcgaggcgctgatccagagcgcagacaccctcttccctggagacatcaacttcaacgtgtcaggcctcttctcagctgttaccctccaggacacagtcagtgacaggctggcctctgaggaacttccgtccactgccgtgcccaccccagccaccaccccggctccggctccggctccagctccagctccggccccagccttggcttcagcagctaccaaggaaaggacagagtctgaggtgcctcccagaccagcctcccccaaggtcaccaggagtcccccggagacagctgccccagtggaggacatggctcggaggaccaagcgcccggcgccagcccggcccaccatgccgcccccccaggtctccggctcccgctcctcccctccagccccgcccttgccccctggctctggcagccctgggaccccccaagccctgccccgacgtctggttggcagcagcctccgagcccccacagtgccacccccgttaccccccacaccccctcagcctgcccggcgccaaagccggcgttcaccagcctcccccagcccggcctccccaggtccagcctcccccagcccagtctctttgagtaaccctgcacaggtggacctgggggctgccacagcagagggaggagcccctgaggctatcagtggggtccccactcccccagctatcccccctcagccccgccccaggagccttgcctcagagaccaactgagtggctggtttctccctaagcagccctcagcaccccctccctccccacctggccctcccaggacagctctcgccccccacaaaggggcatgggcctccagcctttgcccacaagtgcctcagtgcccactgggtcggcccccatggccaggagggctcaggacaatcctctatttcctgaccttttcctcgtccaccctgggcttggggacccccccaccggactctccactctccggcaggtcctaggggagccaccggaaggaaggagaggtttgcctgctcctacgggactgattcttctcttgccgacatgttttttgtaaggctggtaaataaattattttggacaaaactggagcagctgcccaaatgatagttttattttctgtccttgaaataaagaagccaattttataaaggggaaaacaata

SEQ ID NO: 181094 - DNA, 3123 bp, Homo sapiens
  Payload ID: 15666
  Gene Symbol: SH3BP1
  Gene Name: SH3-domain binding protein 1
  ENST ID: ENST00000451997
  CDS Start-End: 96-158
gcaagagccgcgccgcaggagaggcaggctggaccgggggctccccgggcccgcgacccccgccgtgaccccgcagcccccagctcgcccccaagatgatgaagaggcagctgcaccgcatgcggcagctggcccagacgggcagcttgggacggtagaacagcggctggagccggccaagcgggcagcccacaacatccacaagcggctgcaggcctgtctgcagggccagagcggggcagacatggacaagcgggtgaagaagcttcccctcatggctctgtccaccacgatggctgagagcttcaaggagctggaccctgattccagcatggggaaggccttggagatgagctgtgccatccagaatcagctggcccgcatcctggccgagtttgagatgaccctggagagggacgtcctgcagccactcagcaggctgagtgaggaggagctgccagccatcctcaaacacaagaaaagcctccagaagctcgtgtccgactggaacacactcaagagcaggctcagtcaggcaaccaagaattcaggcagcagtcaaggcctaggaggcagcccgggtagtcacagccatacgaccatggccaacaaggtggagacgctgaaggaggaggaggaggagctgaagaggaaagtggagcaatgcagggacgagtacttggctgacctgtaccactttgttaccaaggaggactcctatgccaactacttcattcgtctcctggagattcaggccgattaccatcgcaggtcactgagctcgctggacacagccctggctgagctgagggagaaccacggccaagcagaccactccccttcgatgacagccacccacttccccagggtgtatggggtgtcgctggcaacccacctgcaagagctgggccgggagattgccctgcccatcgaggcctgcgtcatgatgctgctttctgagggcatgaaggaagagggtctcttccgtctggctgctggggcctcggtgctgaagcgtctcaagcagacaatggcctcggacccccacagcctggaggagttctgctccgacccgcacgctgtggcaggtgccctcaagtcctatctgcgggagctgccagagcctctgatgaccttcgacctctatgatgactggatgagggcagccagcctgaaggagccaggggcccggctgcaggccctccaagaggtgtgcagccgcctaccccccgagaacctcagcaacctcaggtacctgatgaagttcctggcacggctggccgaggagcaggaggtgaacaagatgacacccagcaacatcgccatagtcctgggacccaacttgctgtggccacctgagaaagaaggggaccaggcccagctggatgcagcctccgtgtcttccatccaggtggtgggcgtcgtcgaggcgctgatccagagcgcagacaccctcttccctggagacatcaacttcaacgtgtcaggcctcttctcagctgttaccctccaggacacagtcagtgacaggctggcctctgaggaacttccgtccactgccgtgcccaccccagccaccaccccggctccggctccggctccagctccagctccggccccagccttggcttcagcagctaccaaggaaaggacagagtctgaggtgcctcccagaccagcctcccccaaggtcaccaggagtcccccggagacagctgccccagtggaggacatggctcggaggagcaccgggagcctggccgctgcagtggagacagcctcgggacgccaggccctggtggtgggcaagcccagcccctacatgttcgagtgcatcacggagaacttcagcatcgaccccgcacgcacgcttatggtgggtgaccgcctggagaccgacatcctctttggccaccgctgcggcatgaccactgtgctcacgctcacaggagtctcccgcctagaagaggcccaggcctacctagcggccggccagcacgacctcgtgccccattactatgtggagagcatcgcagacttgacagaggggttggaggactgagcccactgcacctgcagccacaggcccacccctccccactccctgatcccgtaggtggaggcgatgggtcacgagccatgttaagcacaaccggctccttggtccagttctgcaccggggtggggctgggacccggggaaggtttgagggcccttgcaaccccctcccagcagtggctgggcactctttgctgccccagaagctggtcccctatggattcatcttggcctgacccagccaggtggccttatttcttccctgtcacctcccctccttgaaatctgggccctggtgcctgctgaagattccctctatccctgagtacttagtcttctcccccttccctggggcttctagagctctctctgcccctcaggtcctggcccttgggtccttgtcaaccagaggtctagggaaccacaacccttattgtcctgggtggaccaatccaaaggctaagtgatagtgactcatcaatgttgggtcctgtggggtaccagtttaggttcctaagtaatagtgaccctttcacgtcctggagcccgagtggaccaatcggaagcctaagtgacgatgaccctcgcatgtcctaggtccctgggtggacccatcaggaccccaagtgatagtgacccagtggtcttttagatcctcagtagaacagtccagaagcctgagagacagtggccccttgataatctgggtctcacgggaccagctaggggtccaggtttcagtcagtaaataagagtggtccacgtcctaaagacacctctcctttacaaagacttgtgatgctctggggcttctgtggccaagccccaccctttcctggtcatggtacccgtacagcgttgatggccacagctcgaaggggggctttcgtgtccccctgtgcggtcagtgttttcagtaccacctctctcccgtgcccacttggctatttacttatttatttattgtgtgccagtgatggtgggtgggggctgggccttccccgccacctccacccctgttgtgacctgtccttccgtacttaataaagtgcgcgtgggagtgtt

SEQ ID NO: 181095 - DNA, 2858 bp, Homo sapiens
  Payload ID: 15666
  Gene Symbol: SH3BP1
  Gene Name: SH3-domain binding protein 1
  Uniprot ID: Q9Y3L3
  ENST ID: ENST00000417536
  CDS Start-End: 939-2297
agccacgtggcctcgttcctgttccccttccctaccctgcaggactcgcctccacacttgtgatgtctcctgaagataactccggttggaagtttcttctacctgaaatgaaaccataacccctgcagcatccacttggggtgccagagtcccacctccagcacagtcttcattactggccatggcagggaggagtacagaatgggcaggcccaggacagctggcccatcagaccattagaaacagcgagtccggagttccaggggcttgtccacggccacacagcagcccgtggccccaggaagccaaagctcccagccagtcatccagtggtggggggtttagttccagggggccagaggtcctctgcggaagagagtgcaaggcagtatccgcggcaggcccagagaggccaggacaggtcagaaaggcctacccctctttcgcttggtaccctttcctctttgcgagggatgcaaaggttatttatacttcgggtctgcaggctgcgggtggggcaggcaccccgcctggggcgggttgcgggcgcaggggcaggaatgggcttacctgcttcccgccaccggggctgggcggggcgctgcggggaggaggagccgggcacaacctgtggacggccgcggccggcggacacacagcagcgggggcccggccgggggtcgcccgggggcccggaagccggggaagagcgaggaaaccaacttggagagaggagtgacctgggggccgggggcggagtcgtgagcgggggaggagagagccggccgccagcaagagccgcgcggcggcccaggaagcgagagcgccgcccacccatccggggcaagagccgcgccgcaggagaggcaggctggaccgggggctccccgggcccgcgacccccgccgtgaccccgcagcccccagctcgcccccaagatgatgaagaggcagctgcaccgcatgcggcagctggcccagacgggcagcttgggacgcaccccggagaccgctgagttcctgggtgaggacctgctgcaggtagaacagcggctggagccggccaagcgggcagcccacaacatccacaagcggctgcaggcctgtctgcagggccagagcggggcagacatggacaagcgggtgaagaagcttcccctcatggctctgtccaccacgatggctgagagcttcaaggagctggaccctgattccagcatggggaaggccttggagatgagctgtgccatccagaatcagctggcccgcatcctggccgagtttgagatgaccctggagagggacgtcctgcagccactcagcaggctgagtgaggaggagctgccagccatcctcaaacacaagaaaagcctccagaagctcgtgtccgactggaacacactcaagagcaggctcagtcaggcaaccaagaattcaggcagcagtcaaggcctaggaggcagcccgggtagtcacagccatacgaccatggccaacaaggtggagacgctgaaggaggaggaggaggagctgaagaggaaagtggagcaatgcagggacgagtacttggctgacctgtaccactttgttaccaaggaggactcctatgccaactacttcattcgtctcctggagattcaggccgattaccatcgcaggtcactgagctcgctggacacagccctggctgagctgagggagaaccacggccaagcagaccactccccttcgatgacagccacccacttccccagggtgtatggggtgtcgctggcaacccacctgcaagagctgggccgggagattgccctgcccatcgaggcctgcgtcatgatgctgctttctgagggcatgaaggaagagggtctcttccgtctggctgctggggcctcggtgctgaagcgtctcaagcagacaatggcctcggacccccacagcctggaggagttctgctccgacccgcacgctgtggcaggtgccctcaagtcctatctgcgggagctgccagagcctctgatgaccttcgacctctatgatgactggatgagggcagccagcctgaaggagccaggggcccggctgcaggccctccaagaggtgtgcagccgcctaccccccgagaacctcagcaacctcaggtacctgatgaagttcctggcacggctggccgaggagcaggaggtgaacaagatgacacccagcaacatcgccatagtcctgggacccaacttgctgtggccacctgagaaagaaggcacagagccagccagagagttggggtcacaaaccctttgctgagcagatgcatctctttgtcccagggaccaggcccagctggatgcagcctccgtgtcttccatccaggtggtgggcgtcgtcgaggcgctgatccagagcgcagacaccctcttccctggagacatcaacttcaacgtgtcaggcctcttctcagctgttaccctccaggacacagtcagtgacaggctggcctctgaggaacttccgtccactgccgtgcccaccccagccaccaccccggctccggctccggctccagctccagctccggccccagccttggcttcagcagctaccaaggaaaggacagagtctgaggtgcctcccagaccagcctcccccaaggtcaccaggagtcccccggagacagctgccccagtggaggacatggctcggaggaccaagcgcccggcgccagcccggcccaccatgccgcccccccaggtcctaggggagccaccggaaggaaggagaggtttgcctgctcctacgggactgattcttctcttgccgacatgttttttgtaaggctggtaaataaattattttggacaaaactgg

SEQ ID NO: 181096 - DNA, 9211 bp, Homo sapiens
  Payload ID: 15667
  Gene Symbol: SH3BP2
  Gene Name: SH3-domain binding protein 2
  Uniprot ID: P78314
  ENST ID: ENST00000356331
  CDS Start-End: 262-1947
cagccgggtgacccaggccgaggccggcagaagacagcctgatgccttgaagacttcctcttgcacttttgttggagggtgctggtttgctaaaagcagagagtatttttctttttatttattttgtttttaattttttaattttagctccagctcagttgcccagactggagagcagtggccaatcatagcttactgcctcctggaactcctggctcaatcgatcctcctggataagcctcctccgggtactatagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggctgctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggtgccactgcccaactcggtcttcgtcaacaccacggagtcctgcgaagtggaaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgccttggtggctggggcttgattgggaaggaggggattaccagcttactgggtgcccatgctgatgtctaagtggtgaccgcagcagtacccgggaaccccaacagttggttgtcttgtcttccagggtgcaggtcactgagtgacttccccagggtgcacagcgagtaacagatcaggacccaaacttgggcagtctgggctgggagcccacaccccactcaccagttctgctgcctcaggtcaggccagggcagtgctgctgcagagctagaaggccctgcagctacagctgcttcattccctgcattagtgcctggttactgggtacctcctgagtggctgtccccgttccagaacttgcatacactgagcgggctacagagctagaaggccctgcagctacagctgcttcattccctgcattagcgagcagttattgggtacctcctgcatgcctggtcccattccagacaggggcctctggcctggctgagttcacagcccagtctggggacagctgggtatgaggtgcttacggcacagtgtccagggcagctgggtgtgcagggactgggggctcccggaagattttttggaggaagtaacagctacgatgggatgggaacagtggaccctaagcaggccaagggtgcgtagggacggtggtacccagatgcccaagtcttccaggcaatacctggctcaggcccagccccaatccatccccttactttctgccatggagttccagcaggtcactctccctggcacaccttccaggctggatttttaatgaaacagactcagggaggtaggggctggcagggaccctagaatccttgtgatttttcttagcaccttatgtcagggaaacctaaactgaggtcagcacttgggcccactgacagtgactgactgggggagaaggtcctgcagcccccttcccctgggtgtgttctggggacctgtggtttgctggcggaaacaagtgatgaggctggttagcggatgtgggaggctgtgaccccagggggccatagggtgcggtggaactgcaggccctgcagatgacggcagccagctgcttccaggaaccaggtgtccaaggccacctctgcaggggtttcctcttcagcctgcctggggtgagaggtcagtgcaccacagccgaggctggagcacagggagcttctgttgttctgatctatctctggaaaaccagccattcctcctccctgcagtcagaattctttgccctgtctgacctgaacttgcttagggagtcatgccactccccactgtggccatagtttctcttcctgtaaaattttattattttagttttttgtttttgagatgtagtctcaccctgtcgcccaggctggagtgcaatgccgtgatctccgctcactgccacctccgcctctctagttcaagcgattttcctgcctcagcctcccgagtagctgggattccaggcgcccgccaccacgcctggctaattttttgtatttttagtagagacgggattttatcatgttggccaggctggtctcgaactcctgacctcaggtgatctgcccaccttggcctcccaaagtgctgggattacaggcatgagccactgtgcctggccccttcctgtaaaatttttaaatggagaattgggtgcgagatgtggtttccagcctggtgcctggggtgctgagctagtgagtggtgcagtccaggacacctttgctttatgtcacttacacggtcacctggagccggctcaagtggctaaagcatcctggggcccagagccaggtgataggtccctctggccaactggacagttgaggcctgtggttacccgaagcccagctggggccctggtccagcctcgcctcccagactctgcacctgctagcacagctgtccacgtctgtgtgagctgctctaggccgagggcctcagtttcaagagtgtgttggggtgggatggggcaggccgtggtcctccagcatgaagaaggagccatgaggagttcccatgacctcccgagacttgccataagtgttctagtccacatataagggtagggttgggattaccatttactgaccacatctgtgaggtgccgagctgggtgcttgacatcatttgcttggagaagcagctgctagtagacccattttacaggtgagagaaccaagtctcacagaggcctgggttcaagtcccacctctgccactaactggcatgtgaccctatctatccttcactgctctgagcctagaccctggcccctgcctggctccctgccaggctccctgccacccctcacgacctctgatggtcgttgtgggggtctcttgcctggctcccagggctagggttagggctctggaggtgctttcactcaaccaagggggccacagcactggggagtgaaactgccccgcctcaccctgcgttgccctctgggtctgtgagggtgggctggcaggaggcctaggccttgccctaggggcagtcctgcttcctcattttatagatagggaaactgaggctttgggaggactcactgacatacctaccttcaagatgagttcaggtgggctcagttctggggcttgggaaaagggccccagtggctttgggaagcacccccagcccagggtgaaacatgcttcttctcttcctgtggttccatccgaaggattgtggtgagccccgtgccttcagttaataaagatttgtattgtgaaaagattttttcttttttttttgggacacagtctcactctgtcgcccaggctagagtggattggcgtgatctcggctcaatgcaaatctccagggttcaatcgattctcctgcctcaccctcccatgtagctgggattacagctgcctgccaaatttttgtatttttagtggaaccggggtttcaccatgttggccaggctggtcttgaactcctgacctcaactgatccgcccaccttggcctcccaagtgctgggattacaggcgcgagccacggcgcccagccttgaaaagatgtttttagaaccagaagaaacctcggttcccactgatccttctgggccacgttgtgcggagctcccctgctggttggggctcagcgcagccccagggaggtgcttcctgcacctcaggatgggcgagggtgggcattgggggagagggggacctgggacctgcggcttagttccctgaggcaggcagggcttattggggccatttcatagaaaggcagattgaagctcagcagggaagaggcttttgagggtgatccaggcgctggagggatggcctaggacaccagggtcacaccaggaacatgggagggccgtgcttgtctctagacgaggggaatgggggaagggccacaacctctgtttctgtgacccagcagcatcaagcccctcgctgggcacctcgcacacaccccctgccttatctctgcctgcacgccctgttccctccacctagactgcctgctgagggggcagtgccaggaggttgcctgtccttggggaagaggggcagtgaccctgtgaagatgcttgacagacaacccccaccacctcagaagtgtgtgtgagtggtgaacccttttaagccatcttccagccattctcactggagggagatttgatgggtacagagcagacccctacctgtctaccctccttcggacccctaggaagcttcgcaggccttccaggctgccagacagctgccctggcgttgccgtctgcttcttccctggccccactctgaggggctcagagctgaggcagaatccctttttcattcatttcctgcagaataaaacaacatacagaaaagtgaataaaacataaatgcacaacctaacacactgttaggaagtgaacgatctgcaaccaccatcaggaaatagttttgccagcacccaagtgccctcccctcacagtgtcacttccggcctctctgccctggcttatgtgagtcttgtgttcttgtttttctaaaaagtcttcagcacccaattatgcaggcattgcagtattttcctgtttctgtgctttatccccttgaatcatacagatgcaaattctggcagctggcttctttggctcgttattatgtctgtgagatttattcatgttgctgtgcgtagtatagtttgtgcatgttcattgctaaaaacttccattgtttggctgtatcgtagttcacagattcatttcactgtcagtcaagcttgtccaatgcatgcagcccaggatgcctttgaatgtggcccaacacaaatttgtaaactttcttaaaacattataaagatttttgtttgcgatttttttttttagctcatcagctatagttagtggtagtgtattttatgcgtgacccgagacagttcttccggtatggtccatggaagccaaaagattggacatgcctgctgtagatggacagttggtttgtttctagtttggggtaactacacacaatgctgctagcaacagttttgtccatgtctctgatgcacgtgtgttttttgcaaatggtgcacaaatttttctagggtttgtactcaggagtctgactcctgggttctagggtatgaagatctttctaaatattgttctagtttacgtgcccaccagcagtaaaacagaattcccttgccttcccatccttggcagacatttcacttttgccagtctggtggggtgtatagttatggccttaatttgcatttagctaattaccaaggagattgagcatatttttatgtttttattaaccattttgattttgtctcctgtgaagtgtctatcatcttttgcccattttttaacttgttgtctttttctttttcttttctttttttttttttctgagacagggtctcactctgttgccctggctggagtgcagtggtgcaatctcagctcactgcagccttgagtcaggctcaggtgattctctcacctcagcctcccaagtagctgggaccacaggcccacaccaccaagcccagctaattttttgtatttttaagtagagacgggtttcatcatgttatgcaggctgctctcaaactcttgagctcaagcgatctgctggcctcagcctcccaaagttgggattataggcgtgagctaccagattttttcttattaatctaataattctttgtatagtcttgatattatccataatgtgtattgcaaatatcttctctaactctggcttgactgtttatggtgtcctttttttttggggggggttttttgagacaaggtcttgctctgtcacccaggctggagtgttatggcacaatcttggcttattgcagcctcaattcctaggcttaaacagtcctcccacctcagcctcctgagtagccggaactacagtcacgcacttccatgtccagataattttttttttttttttagagataggatcttactatgccccagctggtctcaaactcctagactcaatgagcctcccatcttgacctcccaaagtgctgggagtacaggcatgagccactgtgcatgccagttcttatttttaatgcagttgaattgatcagtgttttcattttggttagtgctttttgtggcttaagaaattctttccaggctgggtacagtggctcacacctgtaatgccagcactttgggggcagaggcaggaggattacttgagctcaggagtttgagaccaacctggacaacatggcgaaacaccatctctacaaaaaatacaaaaattagctggacatggtggtgcgtgcctgtagtcccagctactcaggtggctggggtgagaggattgcttgagcccagaaggtcaaggctgcagtgagctgtgattgtgccactgcacttcagcctgtgagacagagtgagaccctatctcaaaaaaaaccaaaaaaaaaaaaaaaaaaaagaaaaccactgaaattatttccactccaaggtcatgaagatagtctcttagattatattctgaaatccttataaatgtaaatttcatatttaggcctttaattcacctagatttggttttttgcatatggtgtgaggtaaggattcactttcatttttttctctccatagggttacacacctgtcctatcattgtttgtaatctaactttctgcgcccatctgcaatgccacctctgtcatatgtccacatatgacatatgtagatctgttgttggattctttcctctgttccattagtctgtctgttcttgtgccaatatcaagctgtcttcattattatcaattatgtattgagatctgataaagtaagtcttttccaccttatttttcttctttgagagtgtcttgactattctggctctttgtattttcatgtaaggtttttctcccatataagttttaaaatcagcttgtcaattccaacaacaatgatgcacttgatagtttgggaatttattatagctatcaatcagttttgggaaaattgacgtctttacaatattgagttttctgattcatgaacatggtttacctctctttccatttgggtcttctttaaggtttaccaataggattttatatttttgtccattgtggtcttgcttatcttaagtttgatttgtaaatattttatgtttcttttagtctattgtaaattgtgtatttttaatttcatttttttttttgttaatagcatataaaacacaccttgtcttttaactggagcattttgtccattgtgtatttaatgtaattaaatctaccatcttattttatgctaca

SEQ ID NO: 181097 - DNA, 9211 bp, Homo sapiens
  Payload ID: 15667
  Gene Symbol: SH3BP2
  Gene Name: SH3-domain binding protein 2
  Uniprot ID: P78314
  ENST ID: ENST00000442312
  CDS Start-End: 180-1949
acttggtgctgcccagggagcagggaacaggaagtcccgggtggggaggaagcaccggcggccacaggcctcagaagcagcaggagtgagctgtgggcacagctgtggggcagccaggcgcgtcaggcctcacatgtctgggagatgtaggctgcctgggctggtggcccctgagccgcatggcctccctgggccccaggacaccggccccgagcaggtcacgaggacggagggccatgtgttgggtcagcaccatcagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggctgctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggtgccactgcccaactcggtcttcgtcaacaccacggagtcctgcgaagtggaaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgccttggtggctggggcttgattgggaaggaggggattaccagcttactgggtgcccatgctgatgtctaagtggtgaccgcagcagtacccgggaaccccaacagttggttgtcttgtcttccagggtgcaggtcactgagtgacttccccagggtgcacagcgagtaacagatcaggacccaaacttgggcagtctgggctgggagcccacaccccactcaccagttctgctgcctcaggtcaggccagggcagtgctgctgcagagctagaaggccctgcagctacagctgcttcattccctgcattagtgcctggttactgggtacctcctgagtggctgtccccgttccagaacttgcatacactgagcgggctacagagctagaaggccctgcagctacagctgcttcattccctgcattagcgagcagttattgggtacctcctgcatgcctggtcccattccagacaggggcctctggcctggctgagttcacagcccagtctggggacagctgggtatgaggtgcttacggcacagtgtccagggcagctgggtgtgcagggactgggggctcccggaagattttttggaggaagtaacagctacgatgggatgggaacagtggaccctaagcaggccaagggtgcgtagggacggtggtacccagatgcccaagtcttccaggcaatacctggctcaggcccagccccaatccatccccttactttctgccatggagttccagcaggtcactctccctggcacaccttccaggctggatttttaatgaaacagactcagggaggtaggggctggcagggaccctagaatccttgtgatttttcttagcaccttatgtcagggaaacctaaactgaggtcagcacttgggcccactgacagtgactgactgggggagaaggtcctgcagcccccttcccctgggtgtgttctggggacctgtggtttgctggcggaaacaagtgatgaggctggttagcggatgtgggaggctgtgaccccagggggccatagggtgcggtggaactgcaggccctgcagatgacggcagccagctgcttccaggaaccaggtgtccaaggccacctctgcaggggtttcctcttcagcctgcctggggtgagaggtcagtgcaccacagccgaggctggagcacagggagcttctgttgttctgatctatctctggaaaaccagccattcctcctccctgcagtcagaattctttgccctgtctgacctgaacttgcttagggagtcatgccactccccactgtggccatagtttctcttcctgtaaaattttattattttagttttttgtttttgagatgtagtctcaccctgtcgcccaggctggagtgcaatgccgtgatctccgctcactgccacctccgcctctctagttcaagcgattttcctgcctcagcctcccgagtagctgggattccaggcgcccgccaccacgcctggctaattttttgtatttttagtagagacgggattttatcatgttggccaggctggtctcgaactcctgacctcaggtgatctgcccaccttggcctcccaaagtgctgggattacaggcatgagccactgtgcctggccccttcctgtaaaatttttaaatggagaattgggtgcgagatgtggtttccagcctggtgcctggggtgctgagctagtgagtggtgcagtccaggacacctttgctttatgtcacttacacggtcacctggagccggctcaagtggctaaagcatcctggggcccagagccaggtgataggtccctctggccaactggacagttgaggcctgtggttacccgaagcccagctggggccctggtccagcctcgcctcccagactctgcacctgctagcacagctgtccacgtctgtgtgagctgctctaggccgagggcctcagtttcaagagtgtgttggggtgggatggggcaggccgtggtcctccagcatgaagaaggagccatgaggagttcccatgacctcccgagacttgccataagtgttctagtccacatataagggtagggttgggattaccatttactgaccacatctgtgaggtgccgagctgggtgcttgacatcatttgcttggagaagcagctgctagtagacccattttacaggtgagagaaccaagtctcacagaggcctgggttcaagtcccacctctgccactaactggcatgtgaccctatctatccttcactgctctgagcctagaccctggcccctgcctggctccctgccaggctccctgccacccctcacgacctctgatggtcgttgtgggggtctcttgcctggctcccagggctagggttagggctctggaggtgctttcactcaaccaagggggccacagcactggggagtgaaactgccccgcctcaccctgcgttgccctctgggtctgtgagggtgggctggcaggaggcctaggccttgccctaggggcagtcctgcttcctcattttatagatagggaaactgaggctttgggaggactcactgacatacctaccttcaagatgagttcaggtgggctcagttctggggcttgggaaaagggccccagtggctttgggaagcacccccagcccagggtgaaacatgcttcttctcttcctgtggttccatccgaaggattgtggtgagccccgtgccttcagttaataaagatttgtattgtgaaaagattttttcttttttttttgggacacagtctcactctgtcgcccaggctagagtggattggcgtgatctcggctcaatgcaaatctccagggttcaatcgattctcctgcctcaccctcccatgtagctgggattacagctgcctgccaaatttttgtatttttagtggaaccggggtttcaccatgttggccaggctggtcttgaactcctgacctcaactgatccgcccaccttggcctcccaagtgctgggattacaggcgcgagccacggcgcccagccttgaaaagatgtttttagaaccagaagaaacctcggttcccactgatccttctgggccacgttgtgcggagctcccctgctggttggggctcagcgcagccccagggaggtgcttcctgcacctcaggatgggcgagggtgggcattgggggagagggggacctgggacctgcggcttagttccctgaggcaggcagggcttattggggccatttcatagaaaggcagattgaagctcagcagggaagaggcttttgagggtgatccaggcgctggagggatggcctaggacaccagggtcacaccaggaacatgggagggccgtgcttgtctctagacgaggggaatgggggaagggccacaacctctgtttctgtgacccagcagcatcaagcccctcgctgggcacctcgcacacaccccctgccttatctctgcctgcacgccctgttccctccacctagactgcctgctgagggggcagtgccaggaggttgcctgtccttggggaagaggggcagtgaccctgtgaagatgcttgacagacaacccccaccacctcagaagtgtgtgtgagtggtgaacccttttaagccatcttccagccattctcactggagggagatttgatgggtacagagcagacccctacctgtctaccctccttcggacccctaggaagcttcgcaggccttccaggctgccagacagctgccctggcgttgccgtctgcttcttccctggccccactctgaggggctcagagctgaggcagaatccctttttcattcatttcctgcagaataaaacaacatacagaaaagtgaataaaacataaatgcacaacctaacacactgttaggaagtgaacgatctgcaaccaccatcaggaaatagttttgccagcacccaagtgccctcccctcacagtgtcacttccggcctctctgccctggcttatgtgagtcttgtgttcttgtttttctaaaaagtcttcagcacccaattatgcaggcattgcagtattttcctgtttctgtgctttatccccttgaatcatacagatgcaaattctggcagctggcttctttggctcgttattatgtctgtgagatttattcatgttgctgtgcgtagtatagtttgtgcatgttcattgctaaaaacttccattgtttggctgtatcgtagttcacagattcatttcactgtcagtcaagcttgtccaatgcatgcagcccaggatgcctttgaatgtggcccaacacaaatttgtaaactttcttaaaacattataaagatttttgtttgcgatttttttttttagctcatcagctatagttagtggtagtgtattttatgcgtgacccgagacagttcttccggtatggtccatggaagccaaaagattggacatgcctgctgtagatggacagttggtttgtttctagtttggggtaactacacacaatgctgctagcaacagttttgtccatgtctctgatgcacgtgtgttttttgcaaatggtgcacaaatttttctagggtttgtactcaggagtctgactcctgggttctagggtatgaagatctttctaaatattgttctagtttacgtgcccaccagcagtaaaacagaattcccttgccttcccatccttggcagacatttcacttttgccagtctggtggggtgtatagttatggccttaatttgcatttagctaattaccaaggagattgagcatatttttatgtttttattaaccattttgattttgtctcctgtgaagtgtctatcatcttttgcccattttttaacttgttgtctttttctttttcttttctttttttttttttctgagacagggtctcactctgttgccctggctggagtgcagtggtgcaatctcagctcactgcagccttgagtcaggctcaggtgattctctcacctcagcctcccaagtagctgggaccacaggcccacaccaccaagcccagctaattttttgtatttttaagtagagacgggtttcatcatgttatgcaggctgctctcaaactcttgagctcaagcgatctgctggcctcagcctcccaaagttgggattataggcgtgagctaccagattttttcttattaatctaataattctttgtatagtcttgatattatccataatgtgtattgcaaatatcttctctaactctggcttgactgtttatggtgtcctttttttttggggggggttttttgagacaaggtcttgctctgtcacccaggctggagtgttatggcacaatcttggcttattgcagcctcaattcctaggcttaaacagtcctcccacctcagcctcctgagtagccggaactacagtcacgcacttccatgtccagataattttttttttttttttagagataggatcttactatgccccagctggtctcaaactcctagactcaatgagcctcccatcttgacctcccaaagtgctgggagtacaggcatgagccactgtgcatgccagttcttatttttaatgcagttgaattgatcagtgttttcattttggttagtgctttttgtggcttaagaaattctttccaggctgggtacagtggctcacacctgtaatgccagcactttgggggcagaggcaggaggattacttgagctcaggagtttgagaccaacctggacaacatggcgaaacaccatctctacaaaaaatacaaaaattagctggacatggtggtgcgtgcctgtagtcccagctactcaggtggctggggtgagaggattgcttgagcccagaaggtcaaggctgcagtgagctgtgattgtgccactgcacttcagcctgtgagacagagtgagaccctatctcaaaaaaaaccaaaaaaaaaaaaaaaaaaaagaaaaccactgaaattatttccactccaaggtcatgaagatagtctcttagattatattctgaaatccttataaatgtaaatttcatatttaggcctttaattcacctagatttggttttttgcatatggtgtgaggtaaggattcactttcatttttttctctccatagggttacacacctgtcctatcattgtttgtaatctaactttctgcgcccatctgcaatgccacctctgtcatatgtccacatatgacatatgtagatctgttgttggattctttcctctgttccattagtctgtctgttcttgtgccaatatcaagctgtcttcattattatcaattatgtattgagatctgataaagtaagtcttttccaccttatttttcttctttgagagtgtcttgactattctggctctttgtattttcatgtaaggtttttctcccatataagttttaaaatcagcttgtcaattccaacaacaatgatgcacttgatagtttgggaatttattatagctatcaatcagttttgggaaaattgacgtctttacaatattgagttttctgattcatgaacatggtttacctctctttccatttgggtcttctttaaggtttaccaataggattttatatttttgtccattgtggtcttgcttatcttaagtttgatttgtaaatattttatgtttcttttagtctattgtaaattgtgtatttttaatttcatttttttttttgttaatagcatataaaacacaccttgtcttttaactggagcattttgtccattgtgtatttaatgtaattaaatctaccatcttattttatgcta

SEQ ID NO: 181098 - DNA, 2318 bp, Homo sapiens
  Payload ID: 15667
  Gene Symbol: SH3BP2
  Gene Name: SH3-domain binding protein 2
  Uniprot ID: P78314
  ENST ID: ENST00000435136
  CDS Start-End: 179-1864
gtgagctgtgggcacagctgtggggcagccaggcgcgtcaggcctcacatgtctgggagatgtaggctgcctgggctggtggcccctgagccgcatggcctccctgggccccaggacaccggccccgagcaggtcacgaggacggagggccatgtgttgggtcagcaccatcagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggctgctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggtgccactgcccaactcggtcttcgtcaacaccacggagtcctgcgaagtggaaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttg

SEQ ID NO: 181099 - DNA, 2265 bp, Homo sapiens
  Payload ID: 15667
  Gene Symbol: SH3BP2
  Gene Name: SH3-domain binding protein 2
  Uniprot ID: P78314
  ENST ID: ENST00000452765
  CDS Start-End: 121-1806
gggcgcgggcgggacggagctgcggcggcggcgggtcccgcgggcgggagcgcctggcggccgagtcaagccgccgcctcgacccagggcccgcgggccaggagagcgctcggcggcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggctgctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggtgccactgcccaactcggtcttcgtcaacaccacggagtcctgcgaagtggaaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgccttg

SEQ ID NO: 181100 - DNA, 9158 bp, Homo sapiens
  Payload ID: 15667
  Gene Symbol: SH3BP2
  Gene Name: SH3-domain binding protein 2
  Uniprot ID: P78314
  ENST ID: ENST00000503393
  CDS Start-End: 40-1896
ggggaggagccggcggctgccaggccagggccggcgggcatggcgggctccgggccgcggccgcggagctggggccggcgggaggcgggcgcccgggacgaggcggcggcggccgggggacgcggcccggggccgtgccggtgctcgcaggggaggcgggcgtggatcgccccggggaagccggccatgcccgccgcgtggacgcccttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggctgctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggtgccactgcccaactcggtcttcgtcaacaccacggagtcctgcgaagtggaaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgccttggtggctggggcttgattgggaaggaggggattaccagcttactgggtgcccatgctgatgtctaagtggtgaccgcagcagtacccgggaaccccaacagttggttgtcttgtcttccagggtgcaggtcactgagtgacttccccagggtgcacagcgagtaacagatcaggacccaaacttgggcagtctgggctgggagcccacaccccactcaccagttctgctgcctcaggtcaggccagggcagtgctgctgcagagctagaaggccctgcagctacagctgcttcattccctgcattagtgcctggttactgggtacctcctgagtggctgtccccgttccagaacttgcatacactgagcgggctacagagctagaaggccctgcagctacagctgcttcattccctgcattagcgagcagttattgggtacctcctgcatgcctggtcccattccagacaggggcctctggcctggctgagttcacagcccagtctggggacagctgggtatgaggtgcttacggcacagtgtccagggcagctgggtgtgcagggactgggggctcccggaagattttttggaggaagtaacagctacgatgggatgggaacagtggaccctaagcaggccaagggtgcgtagggacggtggtacccagatgcccaagtcttccaggcaatacctggctcaggcccagccccaatccatccccttactttctgccatggagttccagcaggtcactctccctggcacaccttccaggctggatttttaatgaaacagactcagggaggtaggggctggcagggaccctagaatccttgtgatttttcttagcaccttatgtcagggaaacctaaactgaggtcagcacttgggcccactgacagtgactgactgggggagaaggtcctgcagcccccttcccctgggtgtgttctggggacctgtggtttgctggcggaaacaagtgatgaggctggttagcggatgtgggaggctgtgaccccagggggccatagggtgcggtggaactgcaggccctgcagatgacggcagccagctgcttccaggaaccaggtgtccaaggccacctctgcaggggtttcctcttcagcctgcctggggtgagaggtcagtgcaccacagccgaggctggagcacagggagcttctgttgttctgatctatctctggaaaaccagccattcctcctccctgcagtcagaattctttgccctgtctgacctgaacttgcttagggagtcatgccactccccactgtggccatagtttctcttcctgtaaaattttattattttagttttttgtttttgagatgtagtctcaccctgtcgcccaggctggagtgcaatgccgtgatctccgctcactgccacctccgcctctctagttcaagcgattttcctgcctcagcctcccgagtagctgggattccaggcgcccgccaccacgcctggctaattttttgtatttttagtagagacgggattttatcatgttggccaggctggtctcgaactcctgacctcaggtgatctgcccaccttggcctcccaaagtgctgggattacaggcatgagccactgtgcctggccccttcctgtaaaatttttaaatggagaattgggtgcgagatgtggtttccagcctggtgcctggggtgctgagctagtgagtggtgcagtccaggacacctttgctttatgtcacttacacggtcacctggagccggctcaagtggctaaagcatcctggggcccagagccaggtgataggtccctctggccaactggacagttgaggcctgtggttacccgaagcccagctggggccctggtccagcctcgcctcccagactctgcacctgctagcacagctgtccacgtctgtgtgagctgctctaggccgagggcctcagtttcaagagtgtgttggggtgggatggggcaggccgtggtcctccagcatgaagaaggagccatgaggagttcccatgacctcccgagacttgccataagtgttctagtccacatataagggtagggttgggattaccatttactgaccacatctgtgaggtgccgagctgggtgcttgacatcatttgcttggagaagcagctgctagtagacccattttacaggtgagagaaccaagtctcacagaggcctgggttcaagtcccacctctgccactaactggcatgtgaccctatctatccttcactgctctgagcctagaccctggcccctgcctggctccctgccaggctccctgccacccctcacgacctctgatggtcgttgtgggggtctcttgcctggctcccagggctagggttagggctctggaggtgctttcactcaaccaagggggccacagcactggggagtgaaactgccccgcctcaccctgcgttgccctctgggtctgtgagggtgggctggcaggaggcctaggccttgccctaggggcagtcctgcttcctcattttatagatagggaaactgaggctttgggaggactcactgacatacctaccttcaagatgagttcaggtgggctcagttctggggcttgggaaaagggccccagtggctttgggaagcacccccagcccagggtgaaacatgcttcttctcttcctgtggttccatccgaaggattgtggtgagccccgtgccttcagttaataaagatttgtattgtgaaaagattttttcttttttttttgggacacagtctcactctgtcgcccaggctagagtggattggcgtgatctcggctcaatgcaaatctccagggttcaatcgattctcctgcctcaccctcccatgtagctgggattacagctgcctgccaaatttttgtatttttagtggaaccggggtttcaccatgttggccaggctggtcttgaactcctgacctcaactgatccgcccaccttggcctcccaagtgctgggattacaggcgcgagccacggcgcccagccttgaaaagatgtttttagaaccagaagaaacctcggttcccactgatccttctgggccacgttgtgcggagctcccctgctggttggggctcagcgcagccccagggaggtgcttcctgcacctcaggatgggcgagggtgggcattgggggagagggggacctgggacctgcggcttagttccctgaggcaggcagggcttattggggccatttcatagaaaggcagattgaagctcagcagggaagaggcttttgagggtgatccaggcgctggagggatggcctaggacaccagggtcacaccaggaacatgggagggccgtgcttgtctctagacgaggggaatgggggaagggccacaacctctgtttctgtgacccagcagcatcaagcccctcgctgggcacctcgcacacaccccctgccttatctctgcctgcacgccctgttccctccacctagactgcctgctgagggggcagtgccaggaggttgcctgtccttggggaagaggggcagtgaccctgtgaagatgcttgacagacaacccccaccacctcagaagtgtgtgtgagtggtgaacccttttaagccatcttccagccattctcactggagggagatttgatgggtacagagcagacccctacctgtctaccctccttcggacccctaggaagcttcgcaggccttccaggctgccagacagctgccctggcgttgccgtctgcttcttccctggccccactctgaggggctcagagctgaggcagaatccctttttcattcatttcctgcagaataaaacaacatacagaaaagtgaataaaacataaatgcacaacctaacacactgttaggaagtgaacgatctgcaaccaccatcaggaaatagttttgccagcacccaagtgccctcccctcacagtgtcacttccggcctctctgccctggcttatgtgagtcttgtgttcttgtttttctaaaaagtcttcagcacccaattatgcaggcattgcagtattttcctgtttctgtgctttatccccttgaatcatacagatgcaaattctggcagctggcttctttggctcgttattatgtctgtgagatttattcatgttgctgtgcgtagtatagtttgtgcatgttcattgctaaaaacttccattgtttggctgtatcgtagttcacagattcatttcactgtcagtcaagcttgtccaatgcatgcagcccaggatgcctttgaatgtggcccaacacaaatttgtaaactttcttaaaacattataaagatttttgtttgcgatttttttttttagctcatcagctatagttagtggtagtgtattttatgcgtgacccgagacagttcttccggtatggtccatggaagccaaaagattggacatgcctgctgtagatggacagttggtttgtttctagtttggggtaactacacacaatgctgctagcaacagttttgtccatgtctctgatgcacgtgtgttttttgcaaatggtgcacaaatttttctagggtttgtactcaggagtctgactcctgggttctagggtatgaagatctttctaaatattgttctagtttacgtgcccaccagcagtaaaacagaattcccttgccttcccatccttggcagacatttcacttttgccagtctggtggggtgtatagttatggccttaatttgcatttagctaattaccaaggagattgagcatatttttatgtttttattaaccattttgattttgtctcctgtgaagtgtctatcatcttttgcccattttttaacttgttgtctttttctttttcttttctttttttttttttctgagacagggtctcactctgttgccctggctggagtgcagtggtgcaatctcagctcactgcagccttgagtcaggctcaggtgattctctcacctcagcctcccaagtagctgggaccacaggcccacaccaccaagcccagctaattttttgtatttttaagtagagacgggtttcatcatgttatgcaggctgctctcaaactcttgagctcaagcgatctgctggcctcagcctcccaaagttgggattataggcgtgagctaccagattttttcttattaatctaataattctttgtatagtcttgatattatccataatgtgtattgcaaatatcttctctaactctggcttgactgtttatggtgtcctttttttttggggggggttttttgagacaaggtcttgctctgtcacccaggctggagtgttatggcacaatcttggcttattgcagcctcaattcctaggcttaaacagtcctcccacctcagcctcctgagtagccggaactacagtcacgcacttccatgtccagataattttttttttttttttagagataggatcttactatgccccagctggtctcaaactcctagactcaatgagcctcccatcttgacctcccaaagtgctgggagtacaggcatgagccactgtgcatgccagttcttatttttaatgcagttgaattgatcagtgttttcattttggttagtgctttttgtggcttaagaaattctttccaggctgggtacagtggctcacacctgtaatgccagcactttgggggcagaggcaggaggattacttgagctcaggagtttgagaccaacctggacaacatggcgaaacaccatctctacaaaaaatacaaaaattagctggacatggtggtgcgtgcctgtagtcccagctactcaggtggctggggtgagaggattgcttgagcccagaaggtcaaggctgcagtgagctgtgattgtgccactgcacttcagcctgtgagacagagtgagaccctatctcaaaaaaaaccaaaaaaaaaaaaaaaaaaaagaaaaccactgaaattatttccactccaaggtcatgaagatagtctcttagattatattctgaaatccttataaatgtaaatttcatatttaggcctttaattcacctagatttggttttttgcatatggtgtgaggtaaggattcactttcatttttttctctccatagggttacacacctgtcctatcattgtttgtaatctaactttctgcgcccatctgcaatgccacctctgtcatatgtccacatatgacatatgtagatctgttgttggattctttcctctgttccattagtctgtctgttcttgtgccaatatcaagctgtcttcattattatcaattatgtattgagatctgataaagtaagtcttttccaccttatttttcttctttgagagtgtcttgactattctggctctttgtattttcatgtaaggtttttctcccatataagttttaaaatcagcttgtcaattccaacaacaatgatgcacttgatagtttgggaatttattatagctatcaatcagttttgggaaaattgacgtctttacaatattgagttttctgattcatgaacatggtttacctctctttccatttgggtcttctttaaggtttaccaataggattttatatttttgtccattgtggtcttgcttatcttaagtttgatttgtaaatattttatgtttcttttagtctattgtaaattgtgtatttttaatttcatttttttttttgttaatagcatataaaacacaccttgtcttttaactggagcattttgtccattgtgtatttaatgtaattaaatctaccatcttattttatgcta

SEQ ID NO: 181101 - DNA, 2579 bp, Homo sapiens
  Payload ID: 15667
  Gene Symbol: SH3BP2
  Gene Name: SH3-domain binding protein 2
  Uniprot ID: P78314
  ENST ID: ENST00000515737
  CDS Start-End: 262-555
cagccgggtgacccaggccgaggccggcagaagacagcctgatgccttgaagacttcctcttgcacttttgttggagggtgctggtttgctaaaagcagagagtatttttctttttatttattttgtttttaattttttaattttagctccagctcagttgcccagactggagagcagtggccaatcatagcttactgcctcctggaactcctggctcaatcgatcctcctggataagcctcctccgggtactatagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccggcagcccagaccccagccagcccaggccctgtcccaaacagaggctgggccctaggattccctgctccagggtcctcccaggccgggatcagtttccagcttcacgcatgtcctgggctgggctctatccagtgatgggccatgagctgccctggagggccttctgcactaacaggcagggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggctgctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggtgccactgcccaactcggtcttcgtcaacaccacggagtcctgcgaagtggaaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagcttt

SEQ ID NO: 181102 - DNA, 551 bp, Homo sapiens
  Payload ID: 15667
  Gene Symbol: SH3BP2
  Gene Name: SH3-domain binding protein 2
  ENST ID: ENST00000503219
  CDS Start-End: 124-551
agcgcctggcggccgagtcaagccgccgcctcgacccagggcccgcgggccaggagagcgctcggcgggctgacccttggccctctgcctgccctgctggctggctcccactcatcctgcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccag

SEQ ID NO: 181103 - DNA, 557 bp, Homo sapiens
  Payload ID: 15667
  Gene Symbol: SH3BP2
  Gene Name: SH3-domain binding protein 2
  ENST ID: ENST00000504294
  CDS Start-End: 41-557
actcgaggccagaaagggaagcccctttccagtgggcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaag

SEQ ID NO: 181104 - DNA, 609 bp, Homo sapiens
  Payload ID: 15667
  Gene Symbol: SH3BP2
  Gene Name: SH3-domain binding protein 2
  ENST ID: ENST00000513095
  CDS Start-End: 200-609
aaatgctgctctgtgctgggcctgacacccagggtgcaggttgtttcatggtttgctagggagaagccgagtattcagaggtggccctgcggggaggcagcagggagcttcctcccagggatgcagctgaccttgcgctggagccagagagccctggcctctgaccacaggatgggagggcaggagcagtggaagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaaga

SEQ ID NO: 181105 - DNA, 868 bp, Homo sapiens
  Payload ID: 15667
  Gene Symbol: SH3BP2
  Gene Name: SH3-domain binding protein 2
  Uniprot ID: P78314
  ENST ID: ENST00000513020
  CDS Start-End: 242-535
tcaggggtgcagcctcagcctccacccgccacccgtacccgccctgcctcaggacttcgttcctgctgtacccctgctggctgcctgtccccacaggtggctccttcctccccaccggaggagctgctcccaggcgggaccctgggggtggaatctctgaaatgccttcccctcgggaccctcaccgcgactggacttcgctcagcttcagaccctgggctgcagctgcctaatgagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccggcagcccagaccccagccagcccaggccctgtcccaaacagaggctgggccctaggattccctgctccagggtcctcccaggccgggatcagtttccagcttcacgcatgtcctgggctgggctctatccagtgatgggccatgagctgccctggagggccttctgcactaacagggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccaggtgagcccgggcccagggcatacc

SEQ ID NO: 181106 - DNA, 688 bp, Homo sapiens
  Payload ID: 15667
  Gene Symbol: SH3BP2
  Gene Name: SH3-domain binding protein 2
  ENST ID: ENST00000512014
  CDS Start-End: 107-688
cttgaaattcatagaaccgggtgcaagacataacagccctctgtgtggcctcagatggcagagcagggtggcagcagctgccctggcaggaagagcatgctgcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggctt

SEQ ID NO: 181107 - DNA, 2351 bp, Homo sapiens
  Payload ID: 15667
  Gene Symbol: SH3BP2
  Gene Name: SH3-domain binding protein 2
  Uniprot ID: P78314
  ENST ID: ENST00000511747
  CDS Start-End: 211-1896
ggggaggagccggcggctgccaggccagggccggcgggcatggcgggctccgggccgcggccgcggagctggggccggcgggaggcgggcgcccgggacgaggcggcggcggccgggggacgcggcccggggccgtgccggtgctcgcaggggaggcgggcgtggatcgccccggggaagccggccatgcccgccgcgtggacgcccttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggctgctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggtgccactgcccaactcggtcttcgtcaacaccacggagtcctgcgaagtggaaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgc

SEQ ID NO: 181108 - DNA, 876 bp, Homo sapiens
  Payload ID: 15667
  Gene Symbol: SH3BP2
  Gene Name: SH3-domain binding protein 2
  ENST ID: ENST00000508385
  CDS Start-End: 313-876
acggggcctgggaaactccaaagccggcgtcaggtcatcgaggcctccgggctgattaggactaatggcgctcaggggtgcagcctcagcctccacccgccacccgtacccgccctgcctcaggacttcgttcctgctgtacccctgctggctgcctgtccccacaggtggctccttcctccccaccggaggagctgctcccaggcgggaccctgggggtggaatctctgaaatgccttcccctcgggaccctcaccgcgactggacttcgctcagcttcagaccctgggctgcagctgcctaatgagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactcc

SEQ ID NO: 181109 - DNA, 727 bp, Homo sapiens
  Payload ID: 15667
  Gene Symbol: SH3BP2
  Gene Name: SH3-domain binding protein 2
  ENST ID: ENST00000502260
  CDS Start-End: 300-727
cagaagcagcaggagtgagctgtgggcacagctgtggggcagccaggcgcgtcaggcctcacatgtctgggagatgtaggctgcctgggctggtggcccctgagccgcatggcctccctgggccccaggacaccggccccgagcaggtcacgaggacggagggccatgtgttgggtcagcaccatcagctcctgcccatgttaactcagccgacaccgcagcagcatggtgacaggtccccccagggtgtctgcctctacagaggaagggactgaagcacccagagagctggcagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccag

SEQ ID NO: 181110 - DNA, 866 bp, Homo sapiens
  Payload ID: 15667
  Gene Symbol: SH3BP2
  Gene Name: SH3-domain binding protein 2
  ENST ID: ENST00000513069
  CDS Start-End: 1-571
ccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtg

SEQ ID NO: 181111 - DNA, 5044 bp, Homo sapiens
  Payload ID: 15668
  Gene Symbol: SH3BP4
  Gene Name: SH3-domain binding protein 4
  Uniprot ID: Q9P0V3
  ENST ID: ENST00000344528
  CDS Start-End: 321-3212
gaaacagagacaagcaccccaacagtagggtgcttcgaggtcctggaggggagccctggccctgtggagagagaccgagtcgtgcagcgtccgtggcctgcatttgaaactgaagggcaagaggctggtgagatccgagagtcatgccgctgcgtggaggaacatgctgaacctctggaggaacggctctacctccagcgtctcccttctctcctggacagaaggccgtgtcctgggacttctctgatggcgagaggctgcggctgtaccaggaagaaatatgaagccttagcggctttacccgggaagcgagtttcgagatggcggctcagcggatccgagcggccaactccaatggcctccctcgctgcaagtcagaggggaccctgattgacctgagcgaagggttttcagagacgagctttaatgacatcaaagtgccttctcccagtgccttgctcgtagacaaccccacacctttcggaaatgcaaaggaagtgattgcgatcaaggactattgccccaccaacttcaccacactgaagttctccaagggcgaccatctctacgtcttggacacatctggcggtgagtggtggtacgcacacaacaccaccgaaatgggctacatcccctcctcctatgtgcagcccttgaactaccggaactcaacactgagtgacagcggtatgattgataatcttccagacagcccagacgaggtagccaaggagctggagctgctcgggggatggacagatgacaaaaaagtaccaggcagaatgtacagtaataaccctttctggaatggggtccagaccaatccatttctgaatgggaacgtgcccgtcatgcccagcctggatgagctgaatcccaaaagtactgtggatttgctcctttttgacgcaggtacatcctccttcaccgaatccagctcagccaccacgaatagcactggcaacatcttcgatgagcttccagtcacaaacggactccacgcagagccgccggtcaggcgggacaaccccttcttcagaagcaagcgctcctacagtctctcggaactctccgtcctccaagccaagtccgatgctcccacatcgtcgagtttcttcaccggcttgaaatcacctgcccccgagcaatttcagagccgggaggattttcgaactgcctggctaaaccacaggaagctggcccggtcttgccacgacctggacttgcttggccaaagccctggttggggccagacccaagccgtggagacaaacatcgtgtgcaagctggatagctccgggggtgctgtccagcttcctgacaccagcatcagcatccacgtgcccgagggccacgtcgcccctggggagacccagcagatctccatgaaagccctgctggaccccccgctggagctcaacagtgacaggtcctgcagcatcagccctgtgctggaggtcaagctgagcaacctggaggtgaaaacctctatcatcttggagatgaaagtgtcagccgagataaaaaatgacctttttagcaaaagcacagtgggcctccagtgcctgaggagcgactcgaaggaagggccatatgtctccgtcccgctcaactgcagctgtggggacacggtccaggcacagctgcacaacctggagccctgtatgtacgtggctgtcgtggcccatggcccaagcatcctctacccttccaccgtgtgggacttcatcaataaaaaagtcacagtgggtctctacggccctaaacacatccacccatccttcaagacggtagtgaccatttttgggcatgactgtgccccaaagacgctcctggtcagcgaggtcacacgccaggcacccaaccctgccccggtggccctgcagctgtgggggaagcaccagttcgttttgtccaggccccaggatctcaaggtctgtatgttttccaatatgacgaattacgaggtcaaagccagcgagcaggccaaagtggtgcgaggattccagctgaagctgggcaaggtgagccgcctgatcttccccatcacctcccagaaccccaacgagctctctgacttcacgctgcgggttcaggtgaaggacgaccaggaggccatcctcacccagttttgtgtccagactcctcagccaccccctaaaagtgccatcaagccttccgggcaaaggaggtttctcaagaagaacgaagtcgggaaaatcatcctgtccccgtttgccaccactacaaagtacccgactttccaggaccgcccggtgtccagcctcaagtttggtaagttgctcaagactgtggtgcggcagaacaagaaccactacctgctggagtacaagaagggcgacgggatcgccctgctcagcgaggagcgggtcaggctccggggccagctgtggaccaaggagtggtacatcggctactaccagggcagggtgggcctcgtgcacaccaagaacgtgctggtggtcggcagggcccggcccagcctgtgctcgggccccgagctgagcacctcggtgctgctggagcagatcctgcggccctgcaaattcctcacgtacatctatgcctccgtgaggaccctgctcatggagaacatcagcagctggcgctccttcgctgacgccctgggctacgtgaacctgccgctcacctttttctgccgggcagagctggatagtgagcccgagcgggtggcgtccgtcctagaaaagctgaaggaggactgtaacaacactgagaacaaagaacggaagtccttccagaaggagcttgtgatggccctactgaagatggactgccagggcctggtggtcagactcatccaggactttgtgctcctgaccacggctgtagaggtggcccagcgctggcgggagctggctgagaagctggccaaggtctccaagcagcagatggacgcctacgagtctccccaccgggacaggaacggggttgtggacagcgaggccatgtggaagcctgcgtatgacttcttactcacctggagccatcagatcggggacagctaccgggatgtcatccaggagctgcacctgggcctggacaagatgaaaaaccccatcaccaagcgctggaagcacctcactgggactctgatcttggtgaactccctggacgttctgagagcagccgccttcagccctgcggaccaggacgacttcgtgatttgaatgggtcccctcccctcctgctgctctggagtgcaagccctcttctgccctgcgtgccctgctgtcaccgcggagctgaagagggaggaaggggcggctgctcagacagatttagggcccgccagctaggctacacccatcatgcgccgccctcctccatcgagggagaggcctgaagggactgcctactgcagctcgttgccaatcacatagctttctatttgttaagtataaatttaaatttaaaatcacttttttaacgaatggggggaagggatctatgagaaaggtggtatctaatttttttatggaccataaaggtttaaaagaaaataggggcacaggctgttgaggtttttatgttgttatagacctttttaaattatgttagagatgtatataggtatttaaaggtcactgggagcgtttctgattcccggccacactttgcatttcaacactcagcccggaaagatgctcgttcggttgttggacctctttcactccctgcgtgtaagaaggtgaatcacgtgggaaaaagtggcttttcagtaaacgggtacagctcattctttctgagaaggccccaggtcctgctccctcctcggatttgattgtcttccgtgctttgcctcactcgtagtaaatgaccatccatagaatatgtgaatctttggtgagcttcagtgggcagagtgaagtcccgcattagcatttaggtgccctgagctgtttctgccaatagattagaaagcagccatgagttgacagtctttagggcccctgccagtgtgcaattagtcattgacaagaacaatgccatttgagagtgaggtggtccctgctgctacgaggccattgtactgttttttccttgaggtcaaagcagtgcttcccatagagtttgctgcctcttctgtggacaggaagaaaacttcatgaccgaatcagagccttggtggccactgactctcgtgcttattgcagatgctgtggttggcctcacaagcaacgccttatgctgatgtgcagaggtgccagctgccatttgccaaactctgcatttcatttcatctaaggcttaacccctcttccttcctggtgtacctgtgtctcctcggaaggaagtcatagtttagatgaaaccattttttgtacaatgtaaagatcatctgagcaagatgagcattttgtaaaaatgaaaatgtgactcacataaaatcaggaacttgacacagtgttgcattaataactttagggtgcagacatgctgtgtgaatctcacaatgcgtcgtagatgtcgcgtgttggaagggagcaggaggaaggactgatactggcaaatcagtagagtgaggtgatccttagcaacgtgccaggacacttcctgtgtgcctgcagttgtcagggaccatttgggatcccgaatctcattctctaaaactgctttcttgaaacatgttacttccttagtataatcaatgtatactcccttactggcctgaaacgttgtatagctacttattcagatactgaagaccaacggactgaaaaaaagaacaaacattagctattttatgctgcaagaaccaggacacacaattcgccaatcatcccaccatataaccttcgattgtgcttctcaactccaccccataatttctcccagagaccatctatcaccttttccccaaagaagaaacaaaaccagttgcaccttaaaccatggatattttttcctcaggggctttaaatagtttcctatgcaacgtgtcttgtagcacaaataaaattctacaaaagttgcagtaaattttatttggatattttaa

SEQ ID NO: 181112 - DNA, 5194 bp, Homo sapiens
  Payload ID: 15668
  Gene Symbol: SH3BP4
  Gene Name: SH3-domain binding protein 4
  Uniprot ID: Q9P0V3
  ENST ID: ENST00000392011
  CDS Start-End: 405-3296
cgcccaggcgcgggaccaccctccgcccgccgaggcgggggcccagcgcgcccggcactctcggcggtccgggcccctcgccactaccgccgccgccgccgccgtgagtcccgcggagccgcgcgcgcccccggctgggccgagccgctggccgacgagcggagcctcaggagccggcggggacgccatgcgagccagcgtctcccttctctcctggacagaaggccgtgtcctgggacttctctgatggcgagaggctgcggctgtaccaggaagaaacatattgccgagtggatgccgccgcgcagcgtgtttgcttgaggcagaagcttcagcatctgctgggataactggaggaagaaatatgaagccttagcggctttacccgggaagcgagtttcgagatggcggctcagcggatccgagcggccaactccaatggcctccctcgctgcaagtcagaggggaccctgattgacctgagcgaagggttttcagagacgagctttaatgacatcaaagtgccttctcccagtgccttgctcgtagacaaccccacacctttcggaaatgcaaaggaagtgattgcgatcaaggactattgccccaccaacttcaccacactgaagttctccaagggcgaccatctctacgtcttggacacatctggcggtgagtggtggtacgcacacaacaccaccgaaatgggctacatcccctcctcctatgtgcagcccttgaactaccggaactcaacactgagtgacagcggtatgattgataatcttccagacagcccagacgaggtagccaaggagctggagctgctcgggggatggacagatgacaaaaaagtaccaggcagaatgtacagtaataaccctttctggaatggggtccagaccaatccatttctgaatgggaacgtgcccgtcatgcccagcctggatgagctgaatcccaaaagtactgtggatttgctcctttttgacgcaggtacatcctccttcaccgaatccagctcagccaccacgaatagcactggcaacatcttcgatgagcttccagtcacaaacggactccacgcagagccgccggtcaggcgggacaaccccttcttcagaagcaagcgctcctacagtctctcggaactctccgtcctccaagccaagtccgatgctcccacatcgtcgagtttcttcaccggcttgaaatcacctgcccccgagcaatttcagagccgggaggattttcgaactgcctggctaaaccacaggaagctggcccggtcttgccacgacctggacttgcttggccaaagccctggttggggccagacccaagccgtggagacaaacatcgtgtgcaagctggatagctccgggggtgctgtccagcttcctgacaccagcatcagcatccacgtgcccgagggccacgtcgcccctggggagacccagcagatctccatgaaagccctgctggaccccccgctggagctcaacagtgacaggtcctgcagcatcagccctgtgctggaggtcaagctgagcaacctggaggtgaaaacctctatcatcttggagatgaaagtgtcagccgagataaaaaatgacctttttagcaaaagcacagtgggcctccagtgcctgaggagcgactcgaaggaagggccatatgtctccgtcccgctcaactgcagctgtggggacacggtccaggcacagctgcacaacctggagccctgtatgtacgtggctgtcgtggcccatggcccaagcatcctctacccttccaccgtgtgggacttcatcaataaaaaagtcacagtgggtctctacggccctaaacacatccacccatccttcaagacggtagtgaccatttttgggcatgactgtgccccaaagacgctcctggtcagcgaggtcacacgccaggcacccaaccctgccccggtggccctgcagctgtgggggaagcaccagttcgttttgtccaggccccaggatctcaaggtctgtatgttttccaatatgacgaattacgaggtcaaagccagcgagcaggccaaagtggtgcgaggattccagctgaagctgggcaaggtgagccgcctgatcttccccatcacctcccagaaccccaacgagctctctgacttcacgctgcgggttcaggtgaaggacgaccaggaggccatcctcacccagttttgtgtccagactcctcagccaccccctaaaagtgccatcaagccttccgggcaaaggaggtttctcaagaagaacgaagtcgggaaaatcatcctgtccccgtttgccaccactacaaagtacccgactttccaggaccgcccggtgtccagcctcaagtttggtaagttgctcaagactgtggtgcggcagaacaagaaccactacctgctggagtacaagaagggcgacgggatcgccctgctcagcgaggagcgggtcaggctccggggccagctgtggaccaaggagtggtacatcggctactaccagggcagggtgggcctcgtgcacaccaagaacgtgctggtggtcggcagggcccggcccagcctgtgctcgggccccgagctgagcacctcggtgctgctggagcagatcctgcggccctgcaaattcctcacgtacatctatgcctccgtgaggaccctgctcatggagaacatcagcagctggcgctccttcgctgacgccctgggctacgtgaacctgccgctcacctttttctgccgggcagagctggatagtgagcccgagcgggtggcgtccgtcctagaaaagctgaaggaggactgtaacaacactgagaacaaagaacggaagtccttccagaaggagcttgtgatggccctactgaagatggactgccagggcctggtggtcagactcatccaggactttgtgctcctgaccacggctgtagaggtggcccagcgctggcgggagctggctgagaagctggccaaggtctccaagcagcagatggacgcctacgagtctccccaccgggacaggaacggggttgtggacagcgaggccatgtggaagcctgcgtatgacttcttactcacctggagccatcagatcggggacagctaccgggatgtcatccaggagctgcacctgggcctggacaagatgaaaaaccccatcaccaagcgctggaagcacctcactgggactctgatcttggtgaactccctggacgttctgagagcagccgccttcagccctgcggaccaggacgacttcgtgatttgaatgggtcccctcccctcctgctgctctggagtgcaagccctcttctgccctgcgtgccctgctgtcaccgcggagctgaagagggaggaaggggcggctgctcagacagatttagggcccgccagctaggctacacccatcatgcgccgccctcctccatcgagggagaggcctgaagggactgcctactgcagctcgttgccaatcacatagctttctatttgttaagtataaatttaaatttaaaatcacttttttaacgaatggggggaagggatctatgagaaaggtggtatctaatttttttatggaccataaaggtttaaaagaaaataggggcacaggctgttgaggtttttatgttgttatagacctttttaaattatgttagagatgtatataggtatttaaaggtcactgggagcgtttctgattcccggccacactttgcatttcaacactcagcccggaaagatgctcgttcggttgttggacctctttcactccctgcgtgtaagaaggtgaatcacgtgggaaaaagtggcttttcagtaaacgggtacagctcattctttctgagaaggccccaggtcctgctccctcctcggatttgattgtcttccgtgctttgcctcactcgtagtaaatgaccatccatagaatatgtgaatctttggtgagcttcagtgggcagagtgaagtcccgcattagcatttaggtgccctgagctgtttctgccaatagattagaaagcagccatgagttgacagtctttagggcccctgccagtgtgcaattagtcattgacaagaacaatgccatttgagagtgaggtggtccctgctgctacgaggccattgtactgttttttccttgaggtcaaagcagtgcttcccatagagtttgctgcctcttctgtggacaggaagaaaacttcatgaccgaatcagagccttggtggccactgactctcgtgcttattgcagatgctgtggttggcctcacaagcaacgccttatgctgatgtgcagaggtgccagctgccatttgccaaactctgcatttcatttcatctaaggcttaacccctcttccttcctggtgtacctgtgtctcctcggaaggaagtcatagtttagatgaaaccattttttgtacaatgtaaagatcatctgagcaagatgagcattttgtaaaaatgaaaatgtgactcacataaaatcaggaacttgacacagtgttgcattaataactttagggtgcagacatgctgtgtgaatctcacaatgcgtcgtagatgtcgcgtgttggaagggagcaggaggaaggactgatactggcaaatcagtagagtgaggtgatccttagcaacgtgccaggacacttcctgtgtgcctgcagttgtcagggaccatttgggatcccgaatctcattctctaaaactgctttcttgaaacatgttacttccttagtataatcaatgtatactcccttactggcctgaaacgttgtatagctacttattcagatactgaagaccaacggactgaaaaaaagaacaaacattagctattttatgctgcaagaaccaggacacacaattcgccaatcatcccaccatataaccttcgattgtgcttctcaactccaccccataatttctcccagagaccatctatcaccttttccccaaagaagaaacaaaaccagttgcaccttaaaccatggatattttttcctcaggggctttaaatagtttcctatgcaacgtgtcttgtagcacaaataaaattctacaaaagttgcagtaaattttatttggatattttaacctgttaagtgtgtgtgtgttttctgtacccaaccagactttaaataaaacaaacatgaaacctaa

SEQ ID NO: 181113 - DNA, 5231 bp, Homo sapiens
  Payload ID: 15668
  Gene Symbol: SH3BP4
  Gene Name: SH3-domain binding protein 4
  Uniprot ID: Q9P0V3
  ENST ID: ENST00000409212
  CDS Start-End: 508-3399
accttaagagggacaactgaaacagagacaagcaccccaacagtagggtgcttcgaggtcctggaggggagccctggccctgtggagagagaccgagtcgtgcagcgtccgtggcctgcatttgaaactgaagggcaagaggctggtgagatccgagagtcatgccgctgcgtggaggaacatgctgaacctctggaggaacggctctacctccaggtcaggctggaggcttttgcatttggtttggcgaggagagacagcaggatttctgggtgccggacatgcttctcggtcagagctgcgtctcccttctctcctggacagaaggccgtgtcctgggacttctctgatggcgagaggctgcggctgtaccaggaagaaacatattgccgagtggatgccgccgcgcagcgtgtttgcttgaggcagaagcttcagcatctgctgggataactggaggaagaaatatgaagccttagcggctttacccgggaagcgagtttcgagatggcggctcagcggatccgagcggccaactccaatggcctccctcgctgcaagtcagaggggaccctgattgacctgagcgaagggttttcagagacgagctttaatgacatcaaagtgccttctcccagtgccttgctcgtagacaaccccacacctttcggaaatgcaaaggaagtgattgcgatcaaggactattgccccaccaacttcaccacactgaagttctccaagggcgaccatctctacgtcttggacacatctggcggtgagtggtggtacgcacacaacaccaccgaaatgggctacatcccctcctcctatgtgcagcccttgaactaccggaactcaacactgagtgacagcggtatgattgataatcttccagacagcccagacgaggtagccaaggagctggagctgctcgggggatggacagatgacaaaaaagtaccaggcagaatgtacagtaataaccctttctggaatggggtccagaccaatccatttctgaatgggaacgtgcccgtcatgcccagcctggatgagctgaatcccaaaagtactgtggatttgctcctttttgacgcaggtacatcctccttcaccgaatccagctcagccaccacgaatagcactggcaacatcttcgatgagcttccagtcacaaacggactccacgcagagccgccggtcaggcgggacaaccccttcttcagaagcaagcgctcctacagtctctcggaactctccgtcctccaagccaagtccgatgctcccacatcgtcgagtttcttcaccggcttgaaatcacctgcccccgagcaatttcagagccgggaggattttcgaactgcctggctaaaccacaggaagctggcccggtcttgccacgacctggacttgcttggccaaagccctggttggggccagacccaagccgtggagacaaacatcgtgtgcaagctggatagctccgggggtgctgtccagcttcctgacaccagcatcagcatccacgtgcccgagggccacgtcgcccctggggagacccagcagatctccatgaaagccctgctggaccccccgctggagctcaacagtgacaggtcctgcagcatcagccctgtgctggaggtcaagctgagcaacctggaggtgaaaacctctatcatcttggagatgaaagtgtcagccgagataaaaaatgacctttttagcaaaagcacagtgggcctccagtgcctgaggagcgactcgaaggaagggccatatgtctccgtcccgctcaactgcagctgtggggacacggtccaggcacagctgcacaacctggagccctgtatgtacgtggctgtcgtggcccatggcccaagcatcctctacccttccaccgtgtgggacttcatcaataaaaaagtcacagtgggtctctacggccctaaacacatccacccatccttcaagacggtagtgaccatttttgggcatgactgtgccccaaagacgctcctggtcagcgaggtcacacgccaggcacccaaccctgccccggtggccctgcagctgtgggggaagcaccagttcgttttgtccaggccccaggatctcaaggtctgtatgttttccaatatgacgaattacgaggtcaaagccagcgagcaggccaaagtggtgcgaggattccagctgaagctgggcaaggtgagccgcctgatcttccccatcacctcccagaaccccaacgagctctctgacttcacgctgcgggttcaggtgaaggacgaccaggaggccatcctcacccagttttgtgtccagactcctcagccaccccctaaaagtgccatcaagccttccgggcaaaggaggtttctcaagaagaacgaagtcgggaaaatcatcctgtccccgtttgccaccactacaaagtacccgactttccaggaccgcccggtgtccagcctcaagtttggtaagttgctcaagactgtggtgcggcagaacaagaaccactacctgctggagtacaagaagggcgacgggatcgccctgctcagcgaggagcgggtcaggctccggggccagctgtggaccaaggagtggtacatcggctactaccagggcagggtgggcctcgtgcacaccaagaacgtgctggtggtcggcagggcccggcccagcctgtgctcgggccccgagctgagcacctcggtgctgctggagcagatcctgcggccctgcaaattcctcacgtacatctatgcctccgtgaggaccctgctcatggagaacatcagcagctggcgctccttcgctgacgccctgggctacgtgaacctgccgctcacctttttctgccgggcagagctggatagtgagcccgagcgggtggcgtccgtcctagaaaagctgaaggaggactgtaacaacactgagaacaaagaacggaagtccttccagaaggagcttgtgatggccctactgaagatggactgccagggcctggtggtcagactcatccaggactttgtgctcctgaccacggctgtagaggtggcccagcgctggcgggagctggctgagaagctggccaaggtctccaagcagcagatggacgcctacgagtctccccaccgggacaggaacggggttgtggacagcgaggccatgtggaagcctgcgtatgacttcttactcacctggagccatcagatcggggacagctaccgggatgtcatccaggagctgcacctgggcctggacaagatgaaaaaccccatcaccaagcgctggaagcacctcactgggactctgatcttggtgaactccctggacgttctgagagcagccgccttcagccctgcggaccaggacgacttcgtgatttgaatgggtcccctcccctcctgctgctctggagtgcaagccctcttctgccctgcgtgccctgctgtcaccgcggagctgaagagggaggaaggggcggctgctcagacagatttagggcccgccagctaggctacacccatcatgcgccgccctcctccatcgagggagaggcctgaagggactgcctactgcagctcgttgccaatcacatagctttctatttgttaagtataaatttaaatttaaaatcacttttttaacgaatggggggaagggatctatgagaaaggtggtatctaatttttttatggaccataaaggtttaaaagaaaataggggcacaggctgttgaggtttttatgttgttatagacctttttaaattatgttagagatgtatataggtatttaaaggtcactgggagcgtttctgattcccggccacactttgcatttcaacactcagcccggaaagatgctcgttcggttgttggacctctttcactccctgcgtgtaagaaggtgaatcacgtgggaaaaagtggcttttcagtaaacgggtacagctcattctttctgagaaggccccaggtcctgctccctcctcggatttgattgtcttccgtgctttgcctcactcgtagtaaatgaccatccatagaatatgtgaatctttggtgagcttcagtgggcagagtgaagtcccgcattagcatttaggtgccctgagctgtttctgccaatagattagaaagcagccatgagttgacagtctttagggcccctgccagtgtgcaattagtcattgacaagaacaatgccatttgagagtgaggtggtccctgctgctacgaggccattgtactgttttttccttgaggtcaaagcagtgcttcccatagagtttgctgcctcttctgtggacaggaagaaaacttcatgaccgaatcagagccttggtggccactgactctcgtgcttattgcagatgctgtggttggcctcacaagcaacgccttatgctgatgtgcagaggtgccagctgccatttgccaaactctgcatttcatttcatctaaggcttaacccctcttccttcctggtgtacctgtgtctcctcggaaggaagtcatagtttagatgaaaccattttttgtacaatgtaaagatcatctgagcaagatgagcattttgtaaaaatgaaaatgtgactcacataaaatcaggaacttgacacagtgttgcattaataactttagggtgcagacatgctgtgtgaatctcacaatgcgtcgtagatgtcgcgtgttggaagggagcaggaggaaggactgatactggcaaatcagtagagtgaggtgatccttagcaacgtgccaggacacttcctgtgtgcctgcagttgtcagggaccatttgggatcccgaatctcattctctaaaactgctttcttgaaacatgttacttccttagtataatcaatgtatactcccttactggcctgaaacgttgtatagctacttattcagatactgaagaccaacggactgaaaaaaagaacaaacattagctattttatgctgcaagaaccaggacacacaattcgccaatcatcccaccatataaccttcgattgtgcttctcaactccaccccataatttctcccagagaccatctatcaccttttccccaaagaagaaacaaaaccagttgcaccttaaaccatggatattttttcctcaggggctttaaatagtttcctatgcaacgtgtcttgtagcacaaataaaattctacaaaagttgcagtaaattttatttggatattttaa

SEQ ID NO: 181114 - DNA, 570 bp, Homo sapiens
  Payload ID: 15668
  Gene Symbol: SH3BP4
  Gene Name: SH3-domain binding protein 4
  ENST ID: ENST00000444916
  CDS Start-End: 403-570
aacagagacaagcaccccaacagtagggtgcttcgaggtcctggaggggagccctggccctgtggagagagaccgagtcgtgcagcgtccgtggcctgcatttgaaactgaagggcaagaggctggtgagatccgagagtcatgccgctgcgtggaggaacatgctgaacctctggaggaacggctctacctccagcgtctcccttctctcctggacagaaggccgtgtcctgggacttctctgatggcgagaggctgcggctgtaccaggaagaaacatattgccgagtggatgccgccgcgcagcgtgtttgcttgaggcagaagcttcagcatctgctgggataactggaggaagaaatatgaagccttagcggctttacccgggaagcgagtttcgagatggcggctcagcggatccgagcggccaactccaatggcctccctcgctgcaagtcagaggggaccctgattgacctgagcgaagggttttcagagacgagctttaatgacatcaaagtgccttctcccagtgccttgctcgtagacaaccccacacctttcggaaat

SEQ ID NO: 181115 - DNA, 593 bp, Homo sapiens
  Payload ID: 15668
  Gene Symbol: SH3BP4
  Gene Name: SH3-domain binding protein 4
  ENST ID: ENST00000416021
  CDS Start-End: 228-593
gtgagtcccgcggagccgcgcgcgcccccggctgggccgagccgctggccgacgagcggagcctcaggagccggcggggacgccatgcgagccaggaagaaacatattgccgagtggatgccgccgcgcagcgtgtttgcttgaggcagaagcttcagcatctgctgggataactggaggaagaaatatgaagccttagcggctttacccgggaagcgagtttcgagatggcggctcagcggatccgagcggccaactccaatggcctccctcgctgcaagtcagaggggaccctgattgacctgagcgaagggttttcagagacgagctttaatgacatcaaagtgccttctcccagtgccttgctcgtagacaaccccacacctttcggaaatgcaaaggaagtgattgcgatcaaggactattgccccaccaacttcaccacactgaagttctccaagggcgaccatctctacgtcttggacacatctggcggtgagtggtggtacgcacacaacaccaccgaaatgggctacatcccctcctcctatgtgcagcccttgaactaccggaactcaacactgagtgacagc

SEQ ID NO: 181116 - DNA, 500 bp, Homo sapiens
  Payload ID: 15668
  Gene Symbol: SH3BP4
  Gene Name: SH3-domain binding protein 4
  ENST ID: ENST00000454947
  CDS Start-End: 328-500
agcacagcagcaggggaagaggacagtgaggctgggatgcagcctccatgcagcctgtcgctttctccacaggagctctggcctgggccagactgccgagtcaccctgattcaggagtaggcgtctcccttctctcctggacagaaggccgtgtcctgggacttctctgatggcgagaggctgcggctgtaccaggaagaaacatattgccgagtggatgccgccgcgcagcgtgtttgcttgaggcagaagcttcagcatctgctgggataactggaggaagaaatatgaagccttagcggctttacccgggaagcgagtttcgagatggcggctcagcggatccgagcggccaactccaatggcctccctcgctgcaagtcagaggggaccctgattgacctgagcgaagggttttcagagacgagctttaatgacatcaaagtgccttctcccagtgccttgctcgtagacaaccccacacctttcggaaatgcaaa

SEQ ID NO: 181117 - DNA, 829 bp, Homo sapiens
  Payload ID: 15668
  Gene Symbol: SH3BP4
  Gene Name: SH3-domain binding protein 4
  ENST ID: ENST00000446904
  CDS Start-End: 311-829
cgcagttggctggtgtttgtttgcacaaggattctttggtaacaatctgcagtcggtttctggcggaatgtgaggtgaagtcacgactgactttcgggatggagcgtctcccttctctcctggacagaaggccgtgtcctgggacttctctgatggcgagaggctgcggctgtaccaggaagaaacatattgccgagtggatgccgccgcgcagcgtgtttgcttgaggcagaagcttcagcatctgctgggataactggaggaagaaatatgaagccttagcggctttacccgggaagcgagtttcgagatggcggctcagcggatccgagcggccaactccaatggcctccctcgctgcaagtcagaggggaccctgattgacctgagcgaagggttttcagagacgagctttaatgacatcaaagtgccttctcccagtgccttgctcgtagacaaccccacacctttcggaaatgcaaaggaagtgattgcgatcaaggactattgccccaccaacttcaccacactgaagttctccaagggcgaccatctctacgtcttggacacatctggcggtgagtggtggtacgcacacaacaccaccgaaatgggctacatcccctcctcctatgtgcagcccttgaactaccggaactcaacactgagtgacagcggtatgattgataatcttccagacagcccagacgaggtagccaaggagctggagctgctcgggggatggacagatgacaaaaaagtaccaggcagaatgtacagtaataaccctttctggaatggggtccagaccaatccatttctgaatggg

SEQ ID NO: 181118 - DNA, 2822 bp, Homo sapiens
  Payload ID: 15669
  Gene Symbol: SH3BP5
  Gene Name: SH3-domain binding protein 5 (BTK-associated)
  Uniprot ID: O60239
  ENST ID: ENST00000383791
  CDS Start-End: 222-1589
gcgctgactgccgcggcagaaagggggcggccgcgcccatttcctctgctccgccgcggccggaggtatccgcatcggcgagctgcgtctcccgggtgtcggccccggcggctccccgaccgtgcccggctgtggcgaggcggctccagcccagcctgtggcagccgcgacccccggggcgctccggagcccactgcgcggcgcgcgtgccggctgcctgcatggacgcggcactgaagcggagccgctcggaggagccagccgaaatcctgccgcctgcccgggacgaggaggaggaggaggaagaggggatggagcaggggctggaggaggaagaagaggtggatccccggatccagggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaaaaaaaaaatccaagaacacaattcattttcaccacctctggtgttcagagggggcttttaaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtgggggagaaggttctacagcataagccttatcctgccagccaaggggatttattctaagagaagtgcatgtgaagaatggttgccactgttattagattgacaagatgttaatttctctgtaggttgtaactttaaaaataaatgaaattatttaagggttatgctgcactagtattccttagaggaaacagttctttaaagttaggaaagggagtaggcaggcatgtgttggcaaaggctgttaatagtagttaagtgttaagactgcttttctttaacgttttcatggtaatgcatatttagagcactgtatttttgtcttgttaagaaaatttagcatttctaaaagaaaaaagcaaccctctttcaaactgttaattctgtcacagcctgtatattttagtcatttgtaaatctcttcatacaatagtgacttcttttttgactgatacagtatcttaattacaaggttattttgtacttgtcttaatacactaagtgtaataaaaacggcttgagaaaa

SEQ ID NO: 181119 - DNA, 1880 bp, Homo sapiens
  Payload ID: 15669
  Gene Symbol: SH3BP5
  Gene Name: SH3-domain binding protein 5 (BTK-associated)
  Uniprot ID: O60239
  ENST ID: ENST00000408919
  CDS Start-End: 548-1444
gagaaagccttgctatggatgtgacatttgggctgagatgtggatgatgagaaggagtcaggcagccgtgccctggaggagatagcgatgcagacagcagaagccctgaggacagagccagctgacagcccatgtggtgccagaggggagaactggagaagttaaatcagtccacggatgatatcaacagacgggagactgaacttgaggtccagtaggtgtttgcagatcccttcttaagcctcaactgtgtttcctcggtttcccctggctgcaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaa

SEQ ID NO: 181120 - DNA, 2190 bp, Homo sapiens
  Payload ID: 15669
  Gene Symbol: SH3BP5
  Gene Name: SH3-domain binding protein 5 (BTK-associated)
  Uniprot ID: O60239
  ENST ID: ENST00000426925
  CDS Start-End: 797-1693
aattcataaattcttggccagagtgtgcccatcaacaggggttacacttgccacctccttaaatcccagctcaatgcattctccatgctcctggctattcagggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcagagatctggttctcttatttggaactcatcagatacatggcagagggtgtgaagaggtgctgggcccgtggtacagcagccacctttcagaaggccgtcaaaagagcatcttttcttgcttgaagaaataagggattcataactgaagcagagagaactgggagaagagagtttacccttaaatgttgctgaattgaaatactaaaaaattcctaaaaaggcaaatacaaatcccattttaggatcctgtgggattcatcctgtctcctggagttggtgtgaagcatatagaatttcgctcttgtcatccaggctggagtgcaatggcgtgatctcggctcactgcaacctccacctcccaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggctt

SEQ ID NO: 181121 - DNA, 763 bp, Homo sapiens
  Payload ID: 15669
  Gene Symbol: SH3BP5
  Gene Name: SH3-domain binding protein 5 (BTK-associated)
  ENST ID: ENST00000450625
  CDS Start-End: 69-278
gcctgtggcagccgcgacccccggggcgctccggagcccactgcgcggcgcgcgtgccggctgcctgcatggacgcggcactgaagcggagccgctcggaggagccagccgaaatcctgccgcctgcccgggacgaggaggaggaggaggaagaggggatggagcaggggctggaggaggaagaagaggtggatccccggatccagggagaactggagaagttaaatcagtccacggatgatatcaacagacgggagactgaacttgaggtccagtaggtgtttgcagatcccttcttaagcctcaactgtgtttcctcggtttcccctggctgcaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaag

SEQ ID NO: 181122 - DNA, 903 bp, Homo sapiens
  Payload ID: 15669
  Gene Symbol: SH3BP5
  Gene Name: SH3-domain binding protein 5 (BTK-associated)
  ENST ID: ENST00000366391
  CDS Start-End: 520-903
aggcttttttttttttttttttttttgagacagagtctcactttgttgcccaggctggagtgcagtggcacgatcttggcttgctgcaacctccacctcctggattcaagtgattctcctgcctcagcctcccgagtagctgggagtacaggctcccacaaccatgcccagctaatttttgtatttaggtagaggcggggtttcaccatgttggccaagctggtcttgaactcctggcctcaagtgatccacccgccttggccttccatagtgctgggattacaggtgtgttactgcgcccagcccataagctgccttttaaaattttctccatggagctcttcccatgaaagctgttagtgtctgtaagtcatgaaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctg

SEQ ID NO: 181123 - DNA, 1900 bp, Homo sapiens
  Payload ID: 15669
  Gene Symbol: SH3BP5
  Gene Name: SH3-domain binding protein 5 (BTK-associated)
  ENST ID: ENST00000412806
  CDS Start-End: 149-322
atcggcgagctgcgtctcccgggtgtcggccccggcggctccccgaccgtgcccggctgtggcgaggcggctccagcccagcctgtggcagccgcgacccccggggcgctccggagcccactgcgcggcgcgcgtgccggctgcctgcatggacgcggcactgaagcggagccgctcggaggagccagccgaaatcctgccgcctgcccgggacgaggaggaggaggaggaagaggggatggagcaggggctggaggaggaagaagaggtggatccccggatccagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaaaaaaaaaatccaagaacacaattcattttcaccacctctggtgttcagagggggcttttaaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtgggggagaaggttctacagcataagccttatcctgccagccaaggggatttattctaagagaagtgcatgtgaagaatggttgccactgttattagattgacaagatgttaatttctctgtaggttgtaactttaaaaataaatgaaattatttaagggttatgctgcactagtattccttagaggaaacagttctttaaagttaggaaagggagtaggcaggcatgtgttggcaaaggctgttaatagtagttaagtgttaagactgcttttctttaacgttttcatggtaatgcatatttagagcactgtatttttgtcttgttaagaaaatttagcatttctaaaagaaaaaagcaaccctctttcaaac

SEQ ID NO: 181124 - DNA, 826 bp, Homo sapiens
  Payload ID: 15669
  Gene Symbol: SH3BP5
  Gene Name: SH3-domain binding protein 5 (BTK-associated)
  ENST ID: ENST00000417936
  CDS Start-End: 674-826
tagctgggagtacaggctcccacaaccatgcccagctaatttttgtatttaggtagaggcggggtttcaccatgttggccaagctggtcttgaactcctggcctcaagtgatccacccgccttggccttccatagtgctgggattacaggtgtgttactgcgcccagcccataagctgccttttaaaattttctccatggagctcttcccatgaaagctgttagtgtctgtaagtcatgaagagatctggttctcttatttggaactcatcagatacatggcagagggtgtgaagaggtgctgggcccgtggtacagcagccacctttcagaaggccgtcaaaagagcatcttttcttgcttgaagaaataagggattcataactgaagcagagagaactgggagaagagagtttacccttaaatgttgctgaattgaaatactaaaaaattcctaaaaaggcaaatacaaatcccattttaggatcctgtgggattcatcctgtctcctggagttggtgtgaagcatataggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtcc

SEQ ID NO: 181125 - DNA, 3997 bp, Homo sapiens
  Payload ID: 15670
  Gene Symbol: SGIP1
  Gene Name: SH3-domain GRB2-like (endophilin) interacting protein 1
  Uniprot ID: Q9BQI5
  ENST ID: ENST00000237247
  CDS Start-End: 139-2718
agtttgattccagagccccactcggcggacggaatagacctcagcagcggcgtggtgaggacttagctgggacctggaatcgtatcctcctgtgttttttcagactccttggaaattaaggaatgcaattctgccaccatgatggaaggattgaaaaaacgtacaaggaaggcctttggaatacggaagaaagaaaaggacactgattctacaggttcaccagatagagatggaattcaggggaaaaaaaagacccagaagactcagcttctcctcacctcttgcttctggctcagagccctctcgttaactctgtctcagaagaaaagcaatggggcaccaaatggattttatgcggaaattgattgggaaagatataactcacctgagctggatgaagaaggctacagcatcagacccgaggaacccggctctaccaaaggaaagcacttttattcttcaagtgaatcggaagaagaagaagaatcacataagaaatttaatatcaagattaaaccattgcaatctaaagacattcttaagaatgctgcaactgtagatgaattgaaggcatcaataggcaacatcgcactttccccatcaccagtgaggaaaagtccgaggcgcagcccgggtgcaattaaaaggaacttatccagtgaagaagtggcaagacccaggcgttccacaccaactccagaacttataagcaaaaagcctccagatgacactacggcccttgctcctctctttggcccaccactagaatcagcttttgatgaacagaagacagaagttcttttagatcagcctgagatatggggttcaggccaaccaattaatccaagcatggagtcgccaaagttaacaaggccttttcccactggaacacctccaccactgcctccaaaaaatgtaccagctaccccaccccgaacaggatcccccttaacaattggaccaggaaatgaccagtcagccacagaggtcaaaattgaaaaactaccatccatcaatgacttggacagcatttttgggccagtattgtcccccaagtctgttgctgttaatgctgaagaaaagtgggtccatttttctgatacatccccggaacatgttactccggagttgactccaagggaaaaagtggtgtccccaccagctacaccagacaacccagctgactccccagctccaggccctctcggccccccaggtcccacaggccccccagggcctcctgggcctcctcgcaatgtactatcgccgctcaatttagaagaagtccagaagaaagtcgctgagcagaccttcattaaagatgattacttagaaacaatctcatctcctaaagattttgggttgggacaaagagcaactccacctcccccaccaccacccacctacaggactgtggtttcgtcccccggacctggctcgggccctggtccggggaccaccagtgatgggaaaactgaggctcagagatatcaagtaatttgcccaagtttacaagctggaggcaatgaactggattcatactcaggtgcatcatcccctgctcgaccagccactcctttggttccttgcagaagtaccactccacctccacctcctccccggcctccatcccggccaaagctacctccaggaaaacctggagttggagatgtgtccagaccttttagccctcccattcattcttccagccctcctccaatagcacccttagcgcgggctgaaagcacttcttcaatatcgtcaaccaattccttgagcgcagccaccactcccacagttgagaatgaacagccttccctcgtttggtttgacagaggaaagttttatttgacttttgaaggttcttccaggggacccagccccctaaccatgggagctcaggacactctccctgttgcagcagcatttacagaaacagtcaatgcctatttcaaaggagcagacccaagcaaatgtatcgttaagattaccggagaaatggtgttgtcatttcctgctggcatcaccagacactttgccaacaacccgtccccagctgctctgacttttcgggtgataaatttcagcaggttagaacacgtcctgccaaacccccaacttctctgctgtgataatacacaaaatgatgccaataccaaggaattctgggtaaacatgccaaatttgatgactcacctaaagaaagtgtctgaacaaaaaccccaggctacatattataacgttgacatgctcaaatatcaggtgtctgcccagggcattcagtccacacctctgaacctggcagtgaattggcgatgtgagccttcaagcactgacctgcgcatagattacaaatataatacagatgcaatgacgactgctgtggccctcaacaatgtgcagttcctggtccccatcgacggaggagtcaccaagctccaggcagtgctcccaccagcagtctggaatgctgaacaacagagaatattgtggaagattcctgatatctctcagaagtcagaaaatggaggggtgggttctttgttggcaagatttcagttatctgaaggcccaagcaaaccttctccattggttgtgcagttcacaagtgaaggaagcaccctttctggctgtgacattgaacttgttggagcagggtatcgattttcactcatcaagaaaaggtttgctgcaggaaaatacttggcagataactaatgaaatcttatgcaaggatttggaggattcatataatggagaactgatgtatgagaaacagattttaattttggtttgatgaaaacaaaccaatatctgcacttgggatatatcaggtggaaagtcaatgactttcatctgtgatttccctcacacactaccatgatgaccagtcctacagtatttacttctaggtgtaatattgttaatggttttaaaatgtaattattgtatttgtaaattgtactctcattccagtaaggcagttagacacttgagttttagcattttaccattcctgaaatggatgtaatttaaactgtggtatgtaaatttaatagtagtattgttgaatggcacaatgcttacagaggtagattgcattttgtcaatatataaaatttaaatataatattgatagctgtcataaagggggtgccacatattaaagaaacttaagtggaaccagaagaaaaagaaacaaacttacttttcttcaatgcttagtatgttttactctagtgctaaataaaaactctatcttcaaatgtttagtgggttaaattgagaaactatttcagaaaaaaattctaaggttacagcatattcaaagaaaagcattagttaccactttttaaaaagcttttttttcaaactgcaaatttcataaaaatgcaaactgtgtaaacagggcctcttatttttataacttgtgtaaaaagggaaagcaattcatatttaaagtttaagtatattaaattataatcaagagtaaagaagatgttgaagtcttaactacttgcccctctctacagtttcgcaaatgtggggattgctgaataatcagtcagactaaaaccaaaattgtgattttaagatttcaagactttccgtagttgaactggttaagaatttttgcttagttactctgaatagatgatcttactcatccagtatgggggaatgatacctcacgtcttcctctttacccacaggaatcaaaacgctgagactgagaattttagggaaaaaaaagtccactgtttagatccagaaggagagttttaatcattgtttatatcatttgagaatgaaaaaataagcttcataaatgaaattctattcacattactgtgtaataaatttccttttggatgattaggattcattgtataaaactgtaaatctttgccattcttggagaagcaaaaggagagttatcaaaaatgtatgtcgtttcatcgttgcaaggtataataaaaactgtaattattcaatc

SEQ ID NO: 181126 - DNA, 7768 bp, Homo sapiens
  Payload ID: 15670
  Gene Symbol: SGIP1
  Gene Name: SH3-domain GRB2-like (endophilin) interacting protein 1
  Uniprot ID: Q9BQI5
  ENST ID: ENST00000371037
  CDS Start-End: 78-2564
cttagctgggacctggaatcgtatcctcctgtgttttttcagactccttggaaattaaggaatgcaattctgccaccatgatggaaggattgaaaaaacgtacaaggaaggcctttggaatacggaagaaagaaaaggacactgattctacaggttcaccagatagagatggaattcagcccagcccacacgaaccaccctacaatagcaaagcagagtgtgcgcgtgaaggaggaaaaaaagtttcgaagaaaagcaatggggcaccaaatggattttatgcggaaattgattgggaaagatataactcacctgagctggatgaagaaggctacagcatcagacccgaggaacccggctctaccaaaggaaagcacttttattcttcaagtgaatcggaagaagaagaagaatcacataagaaatttaatatcaagattaaaccattgcaatctaaagacattcttaagaatgctgcaactgtagatgaattgaaggcatcaataggcaacatcgcactttccccatcaccagtgaggaaaagtccgaggcgcagcccgggtgcaattaaaaggaacttatccagtgaagaagtggcaagacccaggcgttccacaccaactccagaacttataagcaaaaagcctccagatgacactacggcccttgctcctctctttggcccaccactagaatcagcttttgatgaacagaagacagaagttcttttagatcagcctgagatatggggttcaggccaaccaattaatccaagcatggagtcgccaaagttaacaaggccttttcccactggaacacctccaccactgcctccaaaaaatgtaccagctaccccaccccgaacaggatcccccttaacaattggaccaggaaatgaccagtcagccacagaggtcaaaattgaaaaactaccatccatcaatgacttggacagcatttttgggccagtattgtcccccaagtctgttgctgttaatgctgaagaaaagtgggtccatttttctgatacatccccggaacatgttactccggagttgactccaagggaaaaagtggtgtccccaccagctacaccagacaacccagctgactccccagctccaggccctctcggccccccaggtcccacaggccccccagggcctcctgggcctcctcgcaatgtactatcgccgctcaatttagaagaagtccagaagaaagtcgctgagcagaccttcattaaagatgattacttagaaacaatctcatctcctaaagattttgggttgggacaaagagcaactccacctcccccaccaccacccacctacaggactgtggtttcgtcccccggacctggctcgggccctggtccggggaccaccagtggtgcatcatcccctgctcgaccagccactcctttggttccttgcagaagtaccactccacctccacctcctccccggcctccatcccggccaaagctacctccaggaaaacctggagttggagatgtgtccagaccttttagccctcccattcattcttccagccctcctccaatagcacccttagcgcgggctgaaagcacttcttcaatatcgtcaaccaattccttgagcgcagccaccactcccacagttgagaatgaacagccttccctcgtttggtttgacagaggaaagttttatttgacttttgaaggttcttccaggggacccagccccctaaccatgggagctcaggacactctccctgttgcagcagcatttacagaaacagtcaatgcctatttcaaaggagcagacccaagcaaatgtatcgttaagattaccggagaaatggtgttgtcatttcctgctggcatcaccagacactttgccaacaacccgtccccagctgctctgacttttcgggtgataaatttcagcaggttagaacacgtcctgccaaacccccaacttctctgctgtgataatacacaaaatgatgccaataccaaggaattctgggtaaacatgccaaatttgatgactcacctaaagaaagtgtctgaacaaaaaccccaggctacatattataacgttgacatgctcaaatatcaggtgtctgcccagggcattcagtccacacctctgaacctggcagtgaattggcgatgtgagccttcaagcactgacctgcgcatagattacaaatataatacagatgcaatgacgactgctgtggccctcaacaatgtgcagttcctggtccccatcgacggaggagtcaccaagctccaggcagtgctcccaccagcagtctggaatgctgaacaacagagaatattgtggaagattcctgatatctctcagaagtcagaaaatggaggggtgggttctttgttggcaagatttcagttatctgaaggcccaagcaaaccttctccattggttgtgcagttcacaagtgaaggaagcaccctttctggctgtgacattgaacttgttggagcagggtatcgattttcactcatcaagaaaaggtttgctgcaggaaaatacttggcagataactaatgaaatcttatgcaaggatttggaggattcatataatggagaactgatgtatgagaaacagattttaattttggtttgatgaaaacaaaccaatatctgcacttgggatatatcaggtggaaagtcaatgactttcatctgtgatttccctcacacactaccatgatgaccagtcctacagtatttacttctaggtgtaatattgttaatggttttaaaatgtaattattgtatttgtaaattgtactctcattccagtaaggcagttagacacttgagttttagcattttaccattcctgaaatggatgtaatttaaactgtggtatgtaaatttaatagtagtattgttgaatggcacaatgcttacagaggtagattgcattttgtcaatatataaaatttaaatataatattgatagctgtcataaagggggtgccacatattaaagaaacttaagtggaaccagaagaaaaagaaacaaacttacttttcttcaatgcttagtatgttttactctagtgctaaataaaaactctatcttcaaatgtttagtgggttaaattgagaaactatttcagaaaaaaattctaaggttacagcatattcaaagaaaagcattagttaccactttttaaaaagcttttttttcaaactgcaaatttcataaaaatgcaaactgtgtaaacagggcctcttatttttataacttgtgtaaaaagggaaagcaattcatatttaaagtttaagtatattaaattataatcaagagtaaagaagatgttgaagtcttaactacttgcccctctctacagtttcgcaaatgtggggattgctgaataatcagtcagactaaaaccaaaattgtgattttaagatttcaagactttccgtagttgaactggttaagaatttttgcttagttactctgaatagatgatcttactcatccagtatgggggaatgatacctcacgtcttcctctttacccacaggaatcaaaacgctgagactgagaattttagggaaaaaaaagtccactgtttagatccagaaggagagttttaatcattgtttatatcatttgagaatgaaaaaataagcttcataaatgaaattctattcacattactgtgtaataaatttccttttggatgattaggattcattgtataaaactgtaaatctttgccattcttggagaagcaaaaggagagttatcaaaaatgtatgtcgtttcatcgttgcaaggtataataaaaactgtaattattcaatctggccctgccatatgaacatttagaaagacaaacttcttcgggagtctcagttgtaaaaccttccctcattaatatctgaaaatgttagtcttcctttaagtcatagaacttatttaaacataaaccaatttctattacaggttatgctattaaatagctgtaattattaagttattatttttataattagttgttaaatttcattttacacccactcaaatttaacaaagaatctttagcccctttaaattttagaattaaattaaatttttaaagttttacttctaaaatgagattgtgactggcaattgtttatagtgaaactttttaaattaatctttgtactcctctatcagtgcttgctaccaagagaatgtccaaaatgatttgttttaccatgggaaaattcttactattcaacaaactctcagttggccccctacagcagtctggtgttgaagtttctttgaacgaactaaatatactcattttatgtaaaggtatccaatttgattttgaaaccaaaatagaaaatgcaaaattctaaattccatgaaacatggaatttatgacaccaaaatcaatggagagtaagcagcagcaaactgagaattatccagcatatgaatataacaatgtgtttttaagtaatcaattcatttaaaaaattgaatattaatacaaagcatattaaaaacatgtaaatattactggttctcatgtctttgtatttatattttattttgttttattttgtatagatctagaatgaattagtaattaaacacaagggtttttttcccaaaaaataattttactgatttttaaaaatttaattaaaaacatagattacagtaatctctaacattattcaaatctttctagggattaaattagaaactatgaagaaatcctataatctcttaactggtctttatggaacagaatgggagtcaacaatttcaaaatgattgaactatgagtaaccagaacctcaatagaaaatgtatcccttcacctttcagaaaagagatcaaataataacacaataagctggtatcagggatttgcattttgacattttgttgtttctttttaattttgtagattataatctcctgttacatctatatccacagtactgtagaataagaattcatgtcctgaaaatggtcccaggcaatgaaagagtctcagttatcaaagacattaagtcagattcatttattcattttattcccaagtcagaacaaaatgaactagtaggtaataaaactattttcagtactaggggttaaaacaaaaagaaattgttctagttaaccagaacaccatttcctgaacgttatgatctttaaaaggttctgctttagcaagataaaaagtataaatgatgctactttattttggcaacatggaaattttgtttttcttttccaataaaatccatattttcgtgaaatttttaaaaataaatttgtatcaaggattagtctgaattttatcataatagaaatttataattactaagaattaaatttttaatcatttttaaagctgtgttcttctctacacccacagccaaaatggaaattcactgtatggtatttgggaatatatttcacctgtaaaagaaagaatgtccacaattcaaacggttttgagttaatagataggaatccctcagtcaaactacagaattttttttgttttatatattcttagtcagcagagtgtttgagctataattacaagtatttccacttctaaatcttcttttagaaaagcagataactataataccttggctctgccactgactcctgccgtatgatattggacaaatcactgcccttttcagtttctcatctttagaatggggagttgggattgccagtggttttcaagcttttcttaacagcagggctttttttctaataaaattgcacatggaatcctggtaggcaaaacagctcaaagcaatgcaggagtttctccaacagtttaaattggggctccccagagcatggtttaaataccataacagtacacaatgatctatcatgtgtcttccaactctgaagttccacagttgtaatttactcagataaaccaccttttgaggctttataagcaaacttgtaaaaacacagtaattgaatgatatacaataaaaactgacagagtgtttaccatgtaccagtcactagagatattagctcatttaattctcttatcaatcaaaaaattgtaagtactctttttaattcctgttttacaagtgatgacactgaggcttaaatagaataatctccccaaaatgacacggcagctgaaagtaacccagctattctgactgcaaaggaaacgccttaattgctttgtccaccctgaacaaaacaatctgttttatgtcactatacgtactccatttgaatgccaaggtagaaggcaccatgaaaaaccattaccaaaataaggataattccaataacaaaactgtcaaaaaagaatcactgcttctcaaaatatgattggtatcatcacttattaatgttttgtatcatcacttattaatgattttggcttggtcaccactatgcctggaagatagtaggcactgataaacattgttaaacaccgtaacaacacaaaatgatctaccacatatcaatgtcttccatctctgaaattccatgattctactttactcagatataccaccttttgtggcattataaggaaacatgtataatcaagttcatacaagctatacacagtaggcatcgataaatttgtattgacagcataaacttctagggatgagatttgggaatatacattttgataagtgctccaaatttgagaatcattgctctagtagatctctaaggtccttcttagttctgacattatatcagattttaagcattaaattctaagatgaaaaccatttttctagtcagtttatttttcattcagtccacttaatttcctccaatcttaaaaaatttttttccctaggaaaatccctatctttttcttaaagttactctgttatactatctcagtctcaaagtagcctgaaatgcattttctcattttcatatttctgtccttttcttcaatgtcttaaaagacttgaagtagaagggaagttgcaagctgttatttattcaaatacaaaatcctaatcaatgtttccttctttgcaagggacattcagatctctaacttgtgagttgaacctatttattttgtaagcttttgactttacaaacatgtggtagcctcattctaaaagagttgcacgaatattttttctcaaaataaccacaggctgtaaattaaattgaacaatacagtagaatatgcagatacatactaaacagatgagtgtgtgtgtatgtgtctgtgtttaagcttttccttttccaaaagattatacatttgagcaaaatcccattcagtctaaatgtactcattttgccacatggttttctgatcagcaatttttttaaaaaatggaagtgttacattatatttaataatatcaaaacaagagtgatctctaaatatagctttgaaagttaatataatatgatgtgtccatgcaatgagtcaaattagattgttgatataaatgaacaaatcaatccaagttacattgattaaagggactatttggatgaccagcctcaccatcttttactgtgtgcactttcctcttaaggttttattgtattttccctgctcctttaggcttttttttcatgtggaaaacagtatctaaatgccattctctcacttatgaattaaatatggctaccattaatgttcctttttgtcagtggagtgtatggaaggaaaatgagataggagtacattgcttaagtctctaaatattaaaaacaacaacaaaac

SEQ ID NO: 181127 - DNA, 4080 bp, Homo sapiens
  Payload ID: 15670
  Gene Symbol: SGIP1
  Gene Name: SH3-domain GRB2-like (endophilin) interacting protein 1
  Uniprot ID: Q9BQI5
  ENST ID: ENST00000371039
  CDS Start-End: 195-2090
ggagaaagagagacggagagagagagagacgcacagatgtgcacggaggccacagacactgacatttggaattccttcaggcggacggaatagacctcagcagcggcgtggtgaggacttagctgggacctggaatcgtatcctcctgtgttttttcagactccttggaaattaaggaatgcaattctgccaccatgatggaaggattgaaaaaacgtacaaggaaggcctttggaatacggaagaaagaaaaggacactgattctacaggttcaccagatagagatggaattaagaaaagcaatggggcaccaaatggattttatgcggaaattgattgggaaagatataactcacctgagctggatgaagaaggctacagcatcagacccgaggaacccggctctaccaaaggaaagcacttttattcttcaagtgaatcggaagaagaagaagaatcacataagaaatttaatatcaagattaaaccattgcaatctaaagacattcttaagaatgctgcaactgtagatgaattgaaggcatcaataggcaacatcgcactttccccatcaccagtgggtgcaattaaaaggaacttatccagtgaagaagtggcaagacccaggcgttccacaccaactccagaacttataagcaaaaagcctccagatgacactacggcccttgctcctctctttggcccaccactagaatcagcttttgatgaacagaagacagaagttcttttagatcagcctgagatatggggttcaggccaaccaattaatccaagcatggagtcgccaaagttaacaaggccttttcccactggaacacctccaccactgcctccaaaaaatgtaccagctaccccaccccgaacaggatcccccttaacaattggaccaggtgcatcatcccctgctcgaccagccactcctttggttccttgcagaagtaccactccacctccacctcctccccggcctccatcccggccaaagctacctccaggaaaacctggagttggagatgtgtccagaccttttagccctcccattcattcttccagccctcctccaatagcacccttagcgcgggctgaaagcacttcttcaatatcgtcaaccaattccttgagcgcagccaccactcccacagttgtgtcagaagacgatgttttttatgacaaactgccctcgtttgaaaggcgctgtgaaacgcctgcaggttcttccaggggacccagccccctaaccatgggagctcaggacactctccctgttgcagcagcatttacagaaacagtcaatgcctatttcaaaggagcagacccaagcaaatgtatcgttaagattaccggagaaatggtgttgtcatttcctgctggcatcaccagacactttgccaacaacccgtccccagctgctctgacttttcgggtgataaatttcagcaggttagaacacgtcctgccaaacccccaacttctctgctgtgataatacacaaaatgatgccaataccaaggaattctgggtaaacatgccaaatttgatgactcacctaaagaaagtgtctgaacaaaaaccccaggctacatattataacgttgacatgctcaaatatcaggtgtctgcccagggcattcagtccacacctctgaacctggcagtgaattggcgatgtgagccttcaagcactgacctgcgcatagattacaaatataatacagatgcaatgacgactgctgtggccctcaacaatgtgcagttcctggtccccatcgacggaggagtcaccaagctccaggcagtgctcccaccagcagtctggaatgctgaacaacagagaatattgtggaagattcctgatatctctcagaagtcagaaaatggaggggtgggttctttgttggcaagatttcagttatctgaaggcccaagcaaaccttctccattggttgtgcagttcacaagtgaaggaagcaccctttctggctgtgacattgaacttgttggagcagggtatcgattttcactcatcaagaaaaggtttgctgcaggaaaatacttggcagataactaatgaaatcttatgcaaggatttggaggattcatataatggagaactgatgtatgagaaacagattttaattttggtttgatgaaaacaaaccaatatctgcacttgggatatatcaggtggaaagtcaatgactttcatctgtgatttccctcacacactaccatgatgaccagtcctacagtatttacttctaggtgtaatattgttaatggttttaaaatgtaattattgtatttgtaaattgtactctcattccagtaaggcagttagacacttgagttttagcattttaccattcctgaaatggatgtaatttaaactgtggtatgtaaatttaatagtagtattgttgaatggcacaatgcttacagaggtagattgcattttgtcaatatataaaatttaaatataatattgatagctgtcataaagggggtgccacatattaaagaaacttaagtggaaccagaagaaaaagaaacaaacttacttttcttcaatgcttagtatgttttactctagtgctaaataaaaactctatcttcaaatgtttagtgggttaaattgagaaactatttcagaaaaaaattctaaggttacagcatattcaaagaaaagcattagttaccactttttaaaaagcttttttttcaaactgcaaatttcataaaaatgcaaactgtgtaaacagggcctcttatttttataacttgtgtaaaaagggaaagcaattcatatttaaagtttaagtatattaaattataatcaagagtaaagaagatgttgaagtcttaactacttgcccctctctacagtttcgcaaatgtggggattgctgaataatcagtcagactaaaaccaaaattgtgattttaagatttcaagactttccgtagttgaactggttaagaatttttgcttagttactctgaatagatgatcttactcatccagtatgggggaatgatacctcacgtcttcctctttacccacaggaatcaaaacgctgagactgagaattttagggaaaaaaaagtccactgtttagatccagaaggagagttttaatcattgtttatatcatttgagaatgaaaaaataagcttcataaatgaaattctattcacattactgtgtaataaatttccttttggatgattaggattcattgtataaaactgtaaatctttgccattcttggagaagcaaaaggagagttatcaaaaatgtatgtcgtttcatcgttgcaaggtataataaaaactgtaattattcaatctggccctgccatatgaacatttagaaagacaaacttcttcgggagtctcagttgtaaaaccttccctcattaatatctgaaaatgttagtcttcctttaagtcatagaacttatttaaacataaaccaatttctattacaggttatgctattaaatagctgtaattattaagttattatttttataattagttgttaaatttcattttacacccactcaaatttaacaaagaatctttagcccctttaaattttagaattaaattaaatttttaaagttttacttctaaaatgagattgtgactggcaattgtttatagtgaaactttttaaattaatctttgtactcctctatcagtgcttgctaccaagagaatgtccaaaatgatttgttttaccatgggaaaattcttactattcaacaaactctcagttggccccctacagcagtctggtgttgaagtttctttgaacgaactaaatatactcattttatgtaaaggtatccaatttgattttgaaaccaaaatagaaaatgcaaaattctaaattccatgaaacatggaatttatgacaccaaaatcaatggagagtaagcagcagcaaactgagaattatccagcatatgaatataacaatgtgtttttaagtaatcaattcatttaaaaaattgaatattaatacaaagcatattaaaaacatgtaaatatta

SEQ ID NO: 181128 - DNA, 3646 bp, Homo sapiens
  Payload ID: 15670
  Gene Symbol: SGIP1
  Gene Name: SH3-domain GRB2-like (endophilin) interacting protein 1
  ENST ID: ENST00000435165
  CDS Start-End: 656-1657
aaaaacagcaggttgcatgacagtttctcagtgaagaggttcaaaaaaggtgagatgctattgctttgtgaatttacaaaggaaagaataatttaactgctcagaattacatgtccggtcactgctttttaatttaaaaaataatagagcatcattagtaatcttgttttctctttgatacataggtaaagggtgttttgtgtctggatgcctaaggtgattccaagggaggggatggaagatatgtgacatcttccctgaaatttatattgatatgcaatgctttgtcatttaaaacctaagctaatgttttctacaatccataactctgagtttatctttttggaaacatagaaggggatgacattgaagatgaaatggatacagcaattgctgaatgacagtttgcccaaattagtgcagttaaaatatgctgacgcccctgcatggccaggaagacttctgctccatgcacacaagcaccaagtatcaagcgaccaccaacacattcccattcctttaggcctccatagctttgcttttgctttctgtttcctgaactaaaaaaaaaaaaaaaagtgtagattgccagccttccctttttcctgcacgctaatggcatgtagtgcctccacccttccctatagtgagattaatgacctgctctgtaactcacattgtgtccttctctctccctttccttaacccttcccatcccgcttcaactcctggccatacagagaatgaacagccttccctcgtttggtttgacagaggaaagttttatttgacttttgaaggttcttccaggggacccagccccctaaccatgggagctcaggacactctccctgttgcagcagcatttacagaaacagtcaatgcctatttcaaaggagcagacccaagcaaatgtatcgttaagattaccggagaaatggtgttgtcatttcctgctggcatcaccagacactttgccaacaacccgtccccagctgctctgacttttcgggtgataaatttcagcaggttagaacacgtcctgccaaacccccaacttctctgctgtgataatacacaaaatgatgccaataccaaggaattctgggtaaacatgccaaatttgatgactcacctaaagaaagtgtctgaacaaaaaccccaggctacatattataacgttgacatgctcaaatatcaggtgtctgcccagggcattcagtccacacctctgaacctggcagtgaattggcgatgtgagccttcaagcactgacctgcgcatagattacaaatataatacagatgcaatgacgactgctgtggccctcaacaatgtgcagttcctggtccccatcgacggaggagtcaccaagctccaggcagtgctcccaccagcagtctggaatgctgaacaacagagaatattgtggaagattcctgatatctctcagaagtcagaaaatggaggggtgggttctttgttggcaagatttcagttatctgaaggcccaagcaaaccttctccattggttgtgcagttcacaagtgaaggaagcaccctttctggctgtgacattgaacttgttggagcagggtatcgattttcactcatcaagaaaaggtttgctgcaggaaaatacttggcagataactaatgaaatcttatgcaaggatttggaggattcatataatggagaactgatgtatgagaaacagattttaattttggtttgatgaaaacaaaccaatatctgcacttgggatatatcaggtggaaagtcaatgactttcatctgtgatttccctcacacactaccatgatgaccagtcctacagtatttacttctaggtgtaatattgttaatggttttaaaatgtaattattgtatttgtaaattgtactctcattccagtaaggcagttagacacttgagttttagcattttaccattcctgaaatggatgtaatttaaactgtggtatgtaaatttaatagtagtattgttgaatggcacaatgcttacagaggtagattgcattttgtcaatatataaaatttaaatataatattgatagctgtcataaagggggtgccacatattaaagaaacttaagtggaaccagaagaaaaagaaacaaacttacttttcttcaatgcttagtatgttttactctagtgctaaataaaaactctatcttcaaatgtttagtgggttaaattgagaaactatttcagaaaaaaattctaaggttacagcatattcaaagaaaagcattagttaccactttttaaaaagcttttttttcaaactgcaaatttcataaaaatgcaaactgtgtaaacagggcctcttatttttataacttgtgtaaaaagggaaagcaattcatatttaaagtttaagtatattaaattataatcaagagtaaagaagatgttgaagtcttaactacttgcccctctctacagtttcgcaaatgtggggattgctgaataatcagtcagactaaaaccaaaattgtgattttaagatttcaagactttccgtagttgaactggttaagaatttttgcttagttactctgaatagatgatcttactcatccagtatgggggaatgatacctcacgtcttcctctttacccacaggaatcaaaacgctgagactgagaattttagggaaaaaaaagtccactgtttagatccagaaggagagttttaatcattgtttatatcatttgagaatgaaaaaataagcttcataaatgaaattctattcacattactgtgtaataaatttccttttggatgattaggattcattgtataaaactgtaaatctttgccattcttggagaagcaaaaggagagttatcaaaaatgtatgtcgtttcatcgttgcaaggtataataaaaactgtaattattcaatctggccctgccatatgaacatttagaaagacaaacttcttcgggagtctcagttgtaaaaccttccctcattaatatctgaaaatgttagtcttcctttaagtcatagaacttatttaaacataaaccaatttctattacaggttatgctattaaatagctgtaattattaagttattatttttataattagttgttaaatttcattttacacccactcaaatttaacaaagaatctttagcccctttaaattttagaattaaattaaatttttaaagttttacttctaaaatgagattgtgactggcaattgtttatagtgaaactttttaaattaatctttgtactcctctatcagtgcttgctaccaagagaatgtccaaaatgatttgttttaccatgggaaaattcttactattcaacaaactctcagttggccccctacagcagtctggtgttgaagtttctttgaacgaactaaatatactcattttatgtaaaggtatccaatttgattttgaaaccaaaatagaaaatgcaaaattctaaattccatgaaacatggaatttatgacaccaaaatcaatggagagtaagcagcagcaaactgagaattatccagcatatgaatataacaatgtgtttttaagtaatcaattcatttaaaaaattgaatattaatacaaagcatattaaaaacatgtaaatatt

SEQ ID NO: 181129 - DNA, 951 bp, Homo sapiens
  Payload ID: 15670
  Gene Symbol: SGIP1
  Gene Name: SH3-domain GRB2-like (endophilin) interacting protein 1
  ENST ID: ENST00000424320
  CDS Start-End: 172-951
gagagacgcacagatgtgcacggaggccacagacactgacatttggaattccttcaggcggacggaatagacctcagcagcggcgtggtgaggacttagctgggacctggaatcgtatcctcctgtgttttttcagactccttggaaattaaggaatgcaattctgccaccatgatggaaggattgaaaaaacgtacaaggaaggcctttggaatacggaagaaagaaaaggacactgattctacaggttcaccagatagagatggaattcagcccagcccacacgaaccaccctacaatagcaaagcagagtgtgcgcgtgaaggaggaaaaaaagtttcgaagaaaagcaatggggcaccaaatggattttatgcggaaattgattgggaaagatataactcacctgagctggatgaagaaggctacagcatcagacccgaggaacccggctctaccaaaggaaagcacttttattcttcaagtgaatcggaagaagaagaagaatcacataagaaatttaatatcaagattaaaccattgcaatctaaagacattcttaagaatgctgcaactgtagatgaattgaaggcatcaataggcaacatcgcactttccccatcaccagtgggtgcaattaaaaggaacttatccagtgaagaagtggcaagacccaggcgttccacaccaactccagaacttataagcaaaaagcctccagatgacactacggcccttgctcctctctttggcccaccactagaatcagcttttgatgaacagaagacagaagttcttttagatcagcctgagatatggggttcaggccaaccaattaatccaagcatggagtcgccaaagttaacaaggccttttcccactggaacacctccaccactgcctccaaaaaatgtaccagctaccccaccccgaacaggatcccccttaaca

SEQ ID NO: 181130 - DNA, 2516 bp, Homo sapiens
  Payload ID: 15671
  Gene Symbol: SH3GL1
  Gene Name: SH3-domain GRB2-like 1
  Uniprot ID: Q99961
  ENST ID: ENST00000269886
  CDS Start-End: 180-1286
aatatcctggccgcgcgggcgcgcgagcggctgaggcggcgccggggcgggcgcggagctggcaagcgggtggcggaggcggcgccgacggggactgctgaggcgcgcagagggtcggcggcgcccgggagcctgtcgctggcgcggtccgggcgggaggctcggcggcgggcggcagcatgtcggtggcggggctgaagaagcagttctacaaggcgagccagctggtcagtgagaaggtcggaggggccgaggggaccaagctggatgatgacttcaaagagatggagaagaaggtggatgtcaccagcaaggcggtgacagaagtgctggccaggaccatcgagtacctgcagcccaacccagcctcgcgggctaagctgaccatgctcaacacggtgtccaagatccggggccaggtgaagaaccccggctacccgcagtcggaggggcttctgggcgagtgcatgatccgccacgggaaggagctgggcggcgagtccaactttggtgacgcattgctggatgccggcgagtccatgaagcgcctggcagaggtgaaggactccctggacatcgaggtcaagcagaacttcattgaccccctccagaacctgtgcgagaaagacctgaaggagatccagcaccacctgaagaaactggagggccgccgcctggactttgactacaagaagaagcggcagggcaagatccccgatgaggagctacgccaggcgctggagaagttcgaggagtccaaggaggtggcagaaaccagcatgcacaacctcctggagactgacatcgagcaggtgagtcagctctcggccctggtggatgcacagctggactaccaccggcaggccgtgcagatcctggacgagctggcggagaagctcaagcgcaggatgcgggaagcttcctcacgccctaagcgggagtataagcccaagccccgggagccctttgaccttggagagcctgagcagtccaacgggggcttcccctgcaccacagcccccaagatcgcagcttcatcgtctttccgatcttccgacaagcccatccggacccctagccggagcatgccgcccctggaccagccgagctgcaaggcgctgtacgacttcgagcccgagaacgacggggagctgggcttccatgagggcgacgtcatcacgctgaccaaccagatcgatgagaactggtacgagggcatgctggacggccagtcgggcttcttcccgctcagctacgtggaggtgcttgtgcccctgccgcagtgactcacccgtgtccccgccccgcccctccgtccacactggccggcaccccctgctgggtctcctgcattccacggagcccctgctgccagggcggtgtctgagcctgccggcgccacctgggccccggcccttgaggtactccctgagcaggaccccacacttgggtgggggggcttatctgggtgggtggggatgcctgtttacactagcgctgactcccaacggtgacggctcccttccccactccatggcgccagcctcctcccccgctccccaacttctcgcccagctggccgaggcggggcaacactaaggtgctcttagaaacactaatgttcctctggggcagcccccacctccgtcctgacccgacgggggcccggcccactgcctaccctcgagtcccgcagccttaacaggatgggatcgagggtccccatggggtggctcagagataggaccctggttttaaatccctcccagcctggtgctggtgatgggccctggccctactccagggccaatgcacccccgcctcacacacgcactccttctcctcaaggccagggcagagggcctcaccgcctcccgggcctgctgtcagcttgcagcccggggacagaggccagctgggatctgcctgaggacagagaacatggtctcctgcagggccctgcctcccaagccccgccctcagaaagccaagtaccttttcagctttttaactgcccccatcccaacccagggaggcctgtgtcactctggcacaagctgccaccaccagccacccacacccaccccagcacacctcacacgggaccacagccgcgctgccgagggccaagcacaaaggttccagtgagcgcatgtcccagcccctggtggccaggctccccttgctgagccgctgccacttcaccctgtgggaagtggccccagccatctcctctagaccaaggcaggcagccccgacatctgcttcctctatcgcccaatgcaaaatcgatgaaatggggagttctctgggccaggccacattcacattcccctccccctgtggtccagtgaagcctccggaccccaggctctgctctgccctgccctgcacccccctcgtcagaagtacatgaggggcgcagagatgagcacacagctttgggcacggtccagggcaaactgaaatgtacgcctgaattttgtaaacagaagtattaaatgtctctttctaca

SEQ ID NO: 181131 - DNA, 1404 bp, Homo sapiens
  Payload ID: 15671
  Gene Symbol: SH3GL1
  Gene Name: SH3-domain GRB2-like 1
  Uniprot ID: Q99961
  ENST ID: ENST00000417295
  CDS Start-End: 158-1120
gcgagcggctgaggcggcgccggggcgggcgcggagctggcaagcgggtggcggaggcggcgccgacggggactgctgaggcgcgcagagggtcggcggcgcccgggagcctgtcgctggcgcggtccgggcgggaggctcggcggcgggcggcagcatgtcggtggcggggctgaagaagcagttctacaaggcgagccagctggtcagtgagaaggtcggaggggccgaggggaccaagctggatgatgacttcaaagagatggagaagaaggtggatgtcaccagcaaggcggtgacagaagtgctggccaggaccatcgagtacctgcagcccaacccaggtgacgcattgctggatgccggcgagtccatgaagcgcctggcagaggtgaaggactccctggacatcgaggtcaagcagaacttcattgaccccctccagaacctgtgcgagaaagacctgaaggagatccagcaccacctgaagaaactggagggccgccgcctggactttgactacaagaagaagcggcagggcaagatccccgatgaggagctacgccaggcgctggagaagttcgaggagtccaaggaggtggcagaaaccagcatgcacaacctcctggagactgacatcgagcaggtgagtcagctctcggccctggtggatgcacagctggactaccaccggcaggccgtgcagatcctggacgagctggcggagaagctcaagcgcaggatgcgggaagcttcctcacgccctaagcgggagtataagcccaagccccgggagccctttgaccttggagagcctgagcagtccaacgggggcttcccctgcaccacagcccccaagatcgcagcttcatcgtctttccgatcttccgacaagcccatccggacccctagccggagcatgccgcccctggaccagccgagctgcaaggcgctgtacgacttcgagcccgagaacgacggggagctgggcttccatgagggcgacgtcatcacgctgaccaaccagatcgatgagaactggtacgagggcatgctggacggccagtcgggcttcttcccgctcagctacgtggaggtgcttgtgcccctgccgcagtgactcacccgtgtccccgccccgcccctccgtccacactggccggcaccccctgctgggtctcctgcattccacggagcccctgctgccagggcggtgtctgagcctgccggcgccacctgggccccggcccttgaggtactccctgagcaggaccccacacttgggtgggggggcttatctgggtgggtggggatgcctgtttacactagcgctgactcccaacggtgacggctcccttccccactccatggcgccagcctcctcccccgctccccaacttctcg

SEQ ID NO: 181132 - DNA, 577 bp, Homo sapiens
  Payload ID: 15671
  Gene Symbol: SH3GL1
  Gene Name: SH3-domain GRB2-like 1
  ENST ID: ENST00000598230
  CDS Start-End: 192-577
ccactgtacctggcacaggtaaatactcattcagcctgacttggacctcagtgatggctccagaccgtggctttgaagaatgggcagaatttggatgtaggaagaagcaaggaaaggagggagagtttccgctggtcagtgagaaggtcggaggggccgaggggaccaagctggatgatgacttcaaagagatggagaagaaggtggatgtcaccagcaaggcggtgacagaagtgctggccaggaccatcgagtacctgcagcccaacccagcctcgcgggctaagctgaccatgctcaacacggtgtccaagatccggggccaggtgaagaaccccggctacccgcagtcggaggggcttctgggcgagtgcatgatccgccacgggaaggagctgggcggcgagtccaactttggtgacgcattgctggatgccggcgagtccatgaagcgcctggcagaggtgaaggactccctggacatcgaggtcaagcagaacttcattgaccccctccagaacctgtgcgagaaagacctgaaggagatccagcaccacctgaagaaactggagggccg

SEQ ID NO: 181133 - DNA, 2194 bp, Homo sapiens
  Payload ID: 15671
  Gene Symbol: SH3GL1
  Gene Name: SH3-domain GRB2-like 1
  Uniprot ID: Q99961
  ENST ID: ENST00000598564
  CDS Start-End: 51-965
agcctgtcgctggcgcggtccgggcgggaggctcggcggcgggcggcagcatgtcggtggcggggctgaagaagcagttctacaaggcgagccagctggtcagtgagaaggtcggaggggccgaggggaccaagctggatgatgacttcaaagagatggagaagaaggtggatgtcaccagcaaggcggtgacagaagtgctggccaggaccatcgagtacctgcagcccaacccagcctcgcgggctaagctgaccatgctcaacacggtgtccaagatccggggccagaacctgtgcgagaaagacctgaaggagatccagcaccacctgaagaaactggagggccgccgcctggactttgactacaagaagaagcggcagggcaagatccccgatgaggagctacgccaggcgctggagaagttcgaggagtccaaggaggtggcagaaaccagcatgcacaacctcctggagactgacatcgagcaggtgagtcagctctcggccctggtggatgcacagctggactaccaccggcaggccgtgcagatcctggacgagctggcggagaagctcaagcgcaggatgcgggaagcttcctcacgccctaagcgggagtataagcccaagccccgggagccctttgaccttggagagcctgagcagtccaacgggggcttcccctgcaccacagcccccaagatcgcagcttcatcgtctttccgatcttccgacaagcccatccggacccctagccggagcatgccgcccctggaccagccgagctgcaaggcgctgtacgacttcgagcccgagaacgacggggagctgggcttccatgagggcgacgtcatcacgctgaccaaccagatcgatgagaactggtacgagggcatgctggacggccagtcgggcttcttcccgctcagctacgtggaggtgcttgtgcccctgccgcagtgactcacccgtgtccccgccccgcccctccgtccacactggccggcaccccctgctgggtctcctgcattccacggagcccctgctgccagggcggtgtctgagcctgccggcgccacctgggccccggcccttgaggtactccctgagcaggaccccacacttgggtgggggggcttatctgggtgggtggggatgcctgtttacactagcgctgactcccaacggtgacggctcccttccccactccatggcgccagcctcctcccccgctccccaacttctcgcccagctggccgaggcggggcaacactaaggtgctcttagaaacactaatgttcctctggggcagcccccacctccgtcctgacccgacgggggcccggcccactgcctaccctcgagtcccgcagccttaacaggatgggatcgagggtccccatggggtggctcagagataggaccctggttttaaatccctcccagcctggtgctggtgatgggccctggccctactccagggccaatgcacccccgcctcacacacgcactccttctcctcaaggccagggcagagggcctcaccgcctcccgggcctgctgtcagcttgcagcccggggacagaggccagctgggatctgcctgaggacagagaacatggtctcctgcagggccctgcctcccaagccccgccctcagaaagccaagtaccttttcagctttttaactgcccccatcccaacccagggaggcctgtgtcactctggcacaagctgccaccaccagccacccacacccaccccagcacacctcacacgggaccacagccgcgctgccgagggccaagcacaaaggttccagtgagcgcatgtcccagcccctggtggccaggctccccttgctgagccgctgccacttcaccctgtgggaagtggccccagccatctcctctagaccaaggcaggcagccccgacatctgcttcctctatcgcccaatgcaaaatcgatgaaatggggagttctctgggccaggccacattcacattcccctccccctgtggtccagtgaagcctccggaccccaggctctgctctgccctgccctgcacccccctcgtcagaagtacatgaggggcgcagagatgagcacacagctttgggcacggtccagggcaaactgaaatgtacgcctgaattttgtaaacagaagtattaaatgtctctttctac

SEQ ID NO: 181134 - DNA, 1036 bp, Homo sapiens
  Payload ID: 15671
  Gene Symbol: SH3GL1
  Gene Name: SH3-domain GRB2-like 1
  ENST ID: ENST00000593591
  CDS Start-End: 620-1036
ctggaaagcggatgaaagaatgtggtggccagggctgcagcgggtttccctctctcccttctctcccctcctctccctatctctcccccctcttcttcctctctttctgttctcactcttcccttgtctttctctctgtctctcccttcttttgccctctcacctcttcttcctctctctctgtctgtcctctccacaccttcttcctgtctgtctgcctgcctgtctctctctttctctatctctcgccttttgcagggctggatttggcaagcacttttcctgagcactgcagcttggtgcgtttctgctcatttcctgttaagcagtacccagggctccctgaactcaggctctgggaggacggccctgtcttccttttcctctccactcctagaaaaacctgctgaccaggccctgagagcagggtcacggggagacctcctcaccacagcaggaagatagacggacagtttcctccattggacctgactcagcagcggcccactgaccgcctgggagggggctcccgcctagcgggccgcagttccacacctggctggtcagtgagaaggtcggaggggccgaggggaccaagctggatgatgacttcaaagagatggagaagaaggtggatgtcaccagcaaggcggtgacagaagtgctggccaggaccatcgagtacctgcagcccaacccagcctcgcgggctaagctgaccatgctcaacacggtgtccaagatccggggccaggtgaagaaccccggctacccgcagtcggaggggcttctgggcgagtgcatgatccgccacgggaaggagctgggcggcgagtccaactttggtgacgcattgctggatgccggcgagtccatgaagcgcctggcagaggtgaaggactccctggacatcgaggtcaagcagaacttcattgaccccctccagaacctgtgcgagaaagacctgaaggagatccagcaccacctgaagaaactggagggccgccgcctggactttgactacaagaagaagcgg

SEQ ID NO: 181135 - DNA, 619 bp, Homo sapiens
  Payload ID: 15671
  Gene Symbol: SH3GL1
  Gene Name: SH3-domain GRB2-like 1
  ENST ID: ENST00000598219
  CDS Start-End: 540-619
atctgggcttcttttttaggggggagctagatccaccataaacattttatgtgtatatgtacaccgtttatcatatacatattgtgacaactgtatatatatatatatattttgagacagagtcttgctctgtcacccaggctggagtgcagtggcgcaatcttggcttactgagaccaacctccgcctcccgggttcaagcgattctcttgcctcagcctcctgagtagctgggattacaggtgcgccaccacacccggctaattttttttgtatttttagtagagacagggtttcaccatgttggtcaggctggtgttgaactcctgacctcatgatctgcccgcctcagcctcccaaagtgctgggattacaggtgtgagccaccgtgcctggcctaaacaacttgtatgtatacatacactgtttatcatatatacgtattgtggcaaccatatgtatgaataagccttcaaaagctggtcagtgagaaggtcggaggggccgaggggaccaagctggatgatgacttcaaagagatggagaagaaggtggatgtcaccagcaaggcggtgacagaagtgctggccaggaccatcgagtacctgcagcccaaccc

SEQ ID NO: 181136 - DNA, 2565 bp, Homo sapiens
  Payload ID: 15672
  Gene Symbol: SH3GL2
  Gene Name: SH3-domain GRB2-like 2
  Uniprot ID: Q99962
  ENST ID: ENST00000380607
  CDS Start-End: 121-1179
atagccccggcggcggcacgaccagaggcggccaggggagcgcgccgccccgctcggccctccagtccccctccgcctcctccctcccgcacagcagccgccagcgcggcctcctgcaccatgtcggtggccggcctcaagaagcagttccataaagccactcagaaagtgagtgagaaggttggaggagctgaaggaaccaagctagatgatgacttcaaagagatggaaaggaaagtggatgtcaccagcagggctgtgatggaaataatgactaaaacaattgaataccttcaacccaatccagcttccagagctaagctcagcatgatcaacaccatgtcaaaaatccgtggccaggagaaggggccaggctatcctcaggcagaggcgctgctggcagaggccatgctcaaatttggaagagagcttggagatgattgcaactttggcccagcacttggtgaggtcggggaggccatgcgggaactgtcggaggtcaaagactctttggacatagaagtgaagcagaacttcattgaccctcttcagaatcttcatgacaaagatcttagggaaattcaacatcatctaaagaagttggagggtcgacgcctggattttgattataagaagaaacgacaaggcaagattccggatgaagagcttcgtcaagctctagagaaatttgatgagtctaaggaaattgctgagtcaagcatgttcaatctcttggagatggatattgaacaagtgagccagctctctgcacttgtgcaagctcagctggagtaccacaagcaggcagtccagatcctgcagcaagtcacggtcagactggaagaaagaataagacaggcttcatctcagcctagaagggaatatcaacctaaaccacgaatgagcctggagtttccaactggagacagtactcagcccaatgggggtctctcccacacaggcactcccaaaccttcaggtgtccaaatggatcagccctgctgccgagctctgtacgactttgaacctgaaaatgaaggggagttgggatttaaagagggcgatatcatcacactcactaaccaaattgatgagaactggtatgaggggatgctgcatggccattcaggcttcttccccatcaattatgtggaaattctggttgccctgccccattaggatgttatgctggctggctcgcctcctcttgacccagatagttacggttaaccactgctttggcaatgctgcttataacacatcccaagtgcaggccgcagtggtccacgtcatccagccccaccaagtgactttggttgacttgtgggctcccacaggagtcatggtgatggatgatatcctcttagcctggtgggcgtggcatgtgctttttaaaacatcatctgagaccagccagtagtcacagaactgctgtttacacagttctcaggaggctgtggtttcttagaatatgaccatgagccatttcacagaaaaaccatcccaccgaagatattgtctatcaccccaggggccatctgaaggtctctttgcatttctccatgcaaagaggagaaagcttttgctttcacactgtcccttcccaaatatgtgagtcatggaattgtcaaagtaagccttccctcaccagcaaattgtctcctgatctgaatgaatttgtctcttaatgcatccatagaaaagtgttaattgtgggttcaaagcattctctgcaaataggcatctcagctcctcacacttatggctatttctgacgtatagccagttttcttccctccttgctattaaagccagagcggtaattccaaattatttttcagtaagacagttaatcagcattattgtgagagggactgaaaagaaattctccattatgaggaattgggaagaaatctggtatccaagcttaaatttcttgctatacagaaactatgtatgtatttaggctatttctgaagggcacagggaagggggaacaaatatcttcacttcagttttatttgtgaattacatgtttcatgaatccatttggcacagagacacaaggaagaaaacactagtaaccatctttccactagttcatatactgagaaacagtaaatacctttcctttccacttttaccctgtgttctttgaacatcatttgtgcagattctgccctcaatgaggaccaaataaagatgatttttgtgcttagcagtttaaggtatatggctgcatatgcaaaactctttcccaattcagtcgctacttttacttctgccctttctatccatcgtcttcattttgtgtgtacagtgctgtgtgtaagcttatcagtgtgtttttttatttgtatcagtcatgaaagtcctgttaggtatgcagagttctatttatctagctgtacagactctttcagaggtttaacgtgctgcttccgatgtgccacctgcagtagtggatcatgtggagtgaaaggcaaatcttactgcttaatgtataaactctcaccacaggaagcatcgctgtttccaataaatattgctgaagacagaaccaaa

SEQ ID NO: 181137 - DNA, 2012 bp, Homo sapiens
  Payload ID: 15673
  Gene Symbol: SH3GL3
  Gene Name: SH3-domain GRB2-like 3
  Uniprot ID: Q99963
  ENST ID: ENST00000324537
  CDS Start-End: 493-1560
gcgatgtcggtggccgggctgaagaagcagttccacaaagccagccagtagagatgggtttcaccatgttggccaatatggtctcgatctcctgacctcgtgatccgcctgcctcggcctcccagagtgctgggattacaggtgtgagccactgtgcccagcctcttctctcactatccgtttctgacaaatgaaaaaaatggatgtgggtcctgcagaacctgaggccagctctaaccagtctttcatggatgcatacacctgcctgcaggcgctgctcccaggttatgaggctggttcttgggtttgactctgggaatcatgctcattgatctgcttttcctaatcatgtcagtgaatacctacacgtgaagaaaactcaagctgcaccataaagctaaaggaagaaggagcttttaagtgaataagaccattttcccaatgagcagtgtcataaacattgaggactctcttaaatcagaagatgaatgaatggatggaatctttgctgggataatatgcaatcaagctaataggtgccttacctggacctcccaacagctatttagtgaaaaaataagtggtgctgaaggaactaaactagacgatgaatttcttgacatggaaaggaaaatagatgttaccaataaagttgttgcagaaattctttcaaaaaccactgaatatcttcagccaaatccagcatacagagctaagctaggaatgctgaacactgtgtcgaagatccgagggcaggtgaagaccacaggatacccgcagacggaaggcttgctgggggactgtatgctgaaatacgggaaggagctcggggaagactccacctttggcaatgcattgatagaagttggtgaatccatgaagctaatggctgaggtgaaagactctcttgatattaatgtaaagcaaacttttattgatccacttcagttactacaagataaagatttaaaagagatcgggcatcacctgaaaaagctggaaggccgccgcctggattacgattataaaaagaaacgagtaggtaagataccagacgaagaagtcagacaagcggtagaaaaatttgaagagtcaaaggagttggctgaaagaagcatgtttaactttttagaaaatgatgtagaacaagtcagccagttggctgtgttcatagaggcagcattagactatcacagacagtccacagagattctgcaggagctgcagagcaagctacagatgcgaatatcagctgcatccagtgtccccagacgagaatacaagccaaggcctgtgaaaaggagttctagtgagctcaatggagtttccaccacctctgtagtgaagacgacaggttctaacattcccatggaccagccctgctgtcgtggtctctatgactttgagccagaaaaccaaggagaattaggatttaaagaaggggacatcattacattaaccaatcaaatagatgaaaactggtatgaaggaatgatacacggagaatcgggattcttccccattaattacgtggaagtgatcgtgcctttacctcagtaaatgtgtaacacaaactctggacatactttcgtaactgaaatgaattcacaccagtgtgctctcagtgcggtgttctgtgacatcctttgctctctgaccaacttaatgacttttgtatgtgtgctctctttataatgtattttatatcactttaatttgtataaatgattttcttgtccttgctacatgaaaatattttcttttttgcttcctgtcctaaaagtcattggttaaatgtatttgcttcctgtggctaaaaataagtctcacccattgcagttatgtcaacgaatggcctatattcctcagctgcaatgaaatggtaacatttgaaactaagaaatgctaaatattttgtttctcgacattcctgatgacgtctggtcttttcttttcattgtattttaagcttacctgtgaatagcccaataaacatgacacactgtgttggc

SEQ ID NO: 181138 - DNA, 1806 bp, Homo sapiens
  Payload ID: 15673
  Gene Symbol: SH3GL3
  Gene Name: SH3-domain GRB2-like 3
  Uniprot ID: Q99963
  ENST ID: ENST00000427482
  CDS Start-End: 307-1350
gcggctcaagtagcccaggtctccacgcaacaatgaagcgtgggcggccccagcagcttcatttgcatatcgccgcggcttggccaatgggctgcgcaggggctttggaacgcagtgttgccatcggcgtgcgcgcgtgtgtgcgagtgtgacagcggctgtggctgtggccgtggccgtgggaggcgggcccggcggagcccagccgcggggggaccggcccgggctcccgctccccgagcgcgtcgcggccgcgtggcccagccgagccttgagaccaccccgcccctgccggtcgcagtcgcgatgtcggtggccgggctgaagaagcagttccacaaagccagccagctatttagtgaaaaaataagtggtgctgaaggaactaaactagacgatgaatttcttgacatggaaaggaaaatagatgttaccaataaagttgttgcagaaattctttcaaaaaccactgaatatcttcagccaaatccagcatacagagctaagctaggaatgctgaacactgtgtcgaagatccgagggcaggtgaagaccacaggatacccgcagacggaaggcttgctgggggactgtatgctgaaatacgggaaggagctcggggaagactccacctttggcaatgcattgatagaagttggtgaatccatgaagctaatggctgaggtgaaagactctcttgatattaatgtaaagcaaacttttattgatccacttcagttactacaagataaagatttaaaagagatcgggcatcacctgaaaaagctggaaggccgccgcctggattacgattataaaaagaaacgagtaggtaagataccagacgaagaagtcagacaagcggtagaaaaatttgaagagtcaaaggagttggctgaaagaagcatgtttaactttttagaaaatgatgtagaacaagtcagccagttggctgtgttcatagaggcagcattagactatcacagacagtccacagagattctgcaggagctgcagagcaagctacagatgcgaatatcagctgcatccagtgtccccagacgagaatacaagccaaggcctgtgaaaaggagttctagtgagctcaatggagtttccaccacctctgtagtgaagacgacaggttctaacattcccatggaccagccctgctgtcgtggtctctatgactttgagccagaaaaccaaggagaattaggatttaaagaaggggacatcattacattaaccaatcaaatagatgaaaactggtatgaaggaatgatacacggagaatcgggattcttccccattaattacgtggaagtgatcgtgcctttacctcagtaaatgtgtaacacaaactctggacatactttcgtaactgaaatgaattcacaccagtgtgctctcagtgcggtgttctgtgacatcctttgctctctgaccaacttaatgacttttgtatgtgtgctctctttataatgtattttatatcactttaatttgtataaatgattttcttgtccttgctacatgaaaatattttcttttttgcttcctgtcctaaaagtcattggttaaatgtatttgcttcctgtggctaaaaataagtctcacccattgcagttatgtcaacgaatggcctatattcctcagctgcaatgaaatggtaacatttgaaactaagaaatgctaaatattttgtttctcgacattcctgatgacgtctggtcttttcttttcattgtattttaagcttacctgtgaatagcccaataaacatgacacactgtgttggcaaaa

SEQ ID NO: 181139 - DNA, 1647 bp, Homo sapiens
  Payload ID: 15673
  Gene Symbol: SH3GL3
  Gene Name: SH3-domain GRB2-like 3
  ENST ID: ENST00000563901
  CDS Start-End: 159-356
gtgacagcggctgtggctgtggccgtggccgtgggaggcgggcccggcggagcccagccgcggggggaccggcccgggctcccgctccccgagcgcgtcgcggccgcgtggcccagccgagccttgagaccaccccgcccctgccggtcgcagtcgcgatgtcggtggccgggctgaagaagcagttccacaaagccagccagctatttagtgaaaaaataagtggtgctgaaggaactaaactagacgatgaatttcttgacatggaaaggaaaatagatgttaccaataaagttgttgcagaaattctttcaaaaaccactgaatatcttcagccaaatccagagctaagctaggaatgctgaacactgtgtcgaagatccgagggcaggtgaagaccacaggatacccgcagacggaaggcttgctgggggactgtatgctgaaatacgggaaggagctcggggaagactccacctttggcaatgcattgatagaagttggtgaatccatgaagctaatggctgaggtgaaagactctcttgatattaatgtaaagcaaacttttattgatccacttcagttactacaagataaagatttaaaagagatcgggcatcacctgaaaaagctggaaggccgccgcctggattacgattataaaaagaaacgagtaggtaagataccagacgaagaagtcagacaagcggtagaaaaatttgaagagtcaaaggagttggctgaaagaagcatgtttaactttttagaaaatgatgtagaacaagtcagccagttggctgtgttcatagaggcagcattagactatcacagacagtccacagagattctgcaggagctgcagagcaagctacagatgcgaatatcagctgcatccagtgtccccagacgagaatacaagccaaggcctgtgaaaaggagttctagtgagctcaatggagtttccaccacctctgtagtgaagacgacaggttctaacattcccatggaccagccctgctgtcgtggtctctatgactttgagccagaaaaccaaggagaattaggatttaaagaaggggacatcattacattaaccaatcaaatagatgaaaactggtatgaaggaatgatacacggagaatcgggattcttccccattaattacgtggaagtgatcgtgcctttacctcagtaaatgtgtaacacaaactctggacatactttcgtaactgaaatgaattcacaccagtgtgctctcagtgcggtgttctgtgacatcctttgctctctgaccaacttaatgacttttgtatgtgtgctctctttataatgtattttatatcactttaatttgtataaatgattttcttgtccttgctacatgaaaatattttcttttttgcttcctgtcctaaaagtcattggttaaatgtatttgcttcctgtggctaaaaataagtctcacccattgcagttatgtcaacgaatggcctatattcctcagctgcaatgaaatggtaacatttgaaactaagaaatgctaaatattttgtttctcgacattcctgatgacgtctggtcttttcttttcattgtattttaagcttacctgtgaatagcccaataaacatgacacactgtgttggc

SEQ ID NO: 181140 - DNA, 1199 bp, Homo sapiens
  Payload ID: 15674
  Gene Symbol: SH3GLB1
  Gene Name: SH3-domain GRB2-like endophilin B1
  Uniprot ID: Q9Y371
  ENST ID: ENST00000482504
  CDS Start-End: 6-1166
ctaggatgaatatcatggacttcaacgtgaagaagctggcggccgacgcaggcaccttcctcagtcgcgccgtgcagttcacagaagaaaagcttggccaggctgagaagacagaattggatgctcacttagagaacctccttagcaaagctgaatgtaccaaaatatggacagaaaaaataatgaaacaaactgaagtgttattgcagccaaatccaaatgccaggatagaagaatttgtttatgagaaactggatagaaaagctccaagtcgtataaacaacccagaacttttgggacaatatatgattgatgcagggactgagtttggcccaggaacagcttatggtaatgcccttattaaatgtggagaaacccaaaaaagaattggaacagcagacagagaactgattcaaacgtcagccttaaattttcttactcctttaagaaactttatagaaggagattacaaaacaattgctaaagaaaggaaactattgcaaaataagagactggatttggatgctgcaaaaacgagactaaaaaaggcaaaagctgcagaaactagaaattcacaactaaactcagctcgccttgaaggagataacattatgatttgggcagaggaggtgacaaaatctgaacaggaattaagaataactcaaagtgaatttgatcgtcaagcagagattaccagacttctgctagagggaatcagcagtacacatgcccatcaccttcgctgtctgaatgactttgtagaagcccagatgacttactatgcacagtgttaccagtatatgttggacctccagaaacaactgggaagttttccatccaattatcttagtaacaacaatcagacttctgtgacacctgtaccatcagttttaccaaatgcgattggttcttctgccatggcttcaacaagtggcctagtaatcacctctccttccaacctcagtgaccttaaggagtgtagtggcagcagaaaggccagggttctctatgattatgatgcagcaaacagtactgaattatcacttctggcagatgaggtgatcactgtgttcagtgttgttggaatggattcagactggctaatgggggaaaggggaaaccagaagggcaaggtgccaattacctacttagaactgctcaattaagtaggtggactatggaaaggttgcccatcatga

SEQ ID NO: 181141 - DNA, 6227 bp, Homo sapiens
  Payload ID: 15674
  Gene Symbol: SH3GLB1
  Gene Name: SH3-domain GRB2-like endophilin B1
  Uniprot ID: Q9Y371
  ENST ID: ENST00000535010
  CDS Start-End: 489-1286
gcgcttgtttttcccttgggacccgggtccacacggcggggtcgcccgtccatctccggctcgcccgcggggcccatcgtcgacgttagcggccgttctccgagccgactgacccatccttggcgctgccgccgcgcgcttgttctcctccctcgccccgccttcatcctccccgttcacggaaacgacagctgcggctgcggggctggcgccgcctccctccacctaccacgtctgccctcgccgctctagccctgcgccccagcccggccgcggcacctccgcctcgccgccgctaggtcggccggctccgcccggctgccgcctaggatgaatatcatggacttcaacgtgaagaagctggcggccgacgcaggcaccttcctcagtcgcgccgtgcagatgccaggatagaagaatttgtttatgagaaactggatagaaaagctccaagtcgtataaacaacccagaacttttgggacaatatatgattgatgcagggactgagtttggcccaggaacagcttatggtaatgcccttattaaatgtggagaaacccaaaaaagaattggaacagcagacagagaactgattcaaacgtcagccttaaattttcttactcctttaagaaactttatagaaggagattacaaaacaattgctaaagaaaggaaactattgcaaaataagagactggatttggatgctgcaaaaacgagactaaaaaaggcaaaagctgcagaaactagaaattcatctgaacaggaattaagaataactcaaagtgaatttgatcgtcaagcagagattaccagacttctgctagagggaatcagcagtacacatgcccatcaccttcgctgtctgaatgactttgtagaagcccagatgacttactatgcacagtgttaccagtatatgttggacctccagaaacaactgggaagttttccatccaattatcttagtaacaacaatcagacttctgtgacacctgtaccatcagttttaccaaatgcgattggttcttctgccatggcttcaacaagtggcctagtaatcacctctccttccaacctcagtgaccttaaggagtgtagtggcagcagaaaggccagggttctctatgattatgatgcagcaaacagtactgaattatcacttctggcagatgaggtgatcactgtgttcagtgttgttggaatggattcagactggctaatgggggaaaggggaaaccagaagggcaaggtgccaattacctacttagaactgctcaattaagtaggtggactatggaaaggttgcccatcatgactttgtatttatatacaattaactctaaataaagcaggttaagtatcttccatgttaatgtgttaagagactgaaaataccagccatcagaaactggcctttctgccaataaagttgcatggtaaatatttcattacagaatttatgttagagctttcatgccaagaatgttttcttacaaaattctctttttattgaggtttcactaataagcagcttctacttttgagcctcaacttaaagcagaactgttttctactggatttttcattaacagcaagctttttcttttatgtaaaataaatctattgtgaattgatatcagcgactcatttattaggtataaataatagccaaagaataaaattaaaatttattttaaactttcggtcttaaaaagagctgtaggatataaacctcttttgtgaaaagtagaattttctgaatgctttcatagacaaaaacgcatttaaactatgtttacctggttttccaacagaaatcaaatgattttaatattatgttttgatgggttattttcagagttgtttggttttttaaacactactgaatggtttcttttaaatttaagaacaactagttcttgaaaagcaataccgtatttctctgataaatttgtagttaaggttctagaaaatctaggacaaatttacttcattaaacataaagtttttaagattattcagttggcacaatttaatgcataattgggattggatccatttactgtactgtggtacagtaaagagaatgtgttcttattgaacagcagatttgtatacaaatacggaataatgcaactacattataaattgtatacgaacaaaataaattgggtcactctgagcttactattaaaacattgaaaatttattaatgaacacaggctatcttgatgaggatctctgcttatgaaacacatactaatgaaattattagtgacacattggaagctagaaaattgctgttggggccattgctataaatcattgtttccatgttaagacttctgttctaattcattcattcaacaaacatttgttgagggccagatactgtgctggtcaactggggatactgtcctgaacaatatgcacacagttcttgcccctgcagagcttaaagaccattaaaggatacagaaaattaagcaattatcctatagtaggattcgtggtgtgatggggaaaatacaaggtactgtatttgggagtcatgtaactccagttttgggagtgagagagggtctggggaagaactgttccagataaaaagatgtgtaaccaagatagcatagcacattctgacaactaaagcaatttactctaacttaagcatgaagtacaaaagtatagttcatttattgagggaatgttaagctattaaaatgatactttttggtacttttaaaaaaatgaatacttaaacaccgttttaaaattttgtgttaagagctcctaataagaacttggtaaacatgttgacaatttaactcacagtctaaactttaaaagtagtagttacccttttatttctgtgccatgagacaaattcttctgcagttttatagttgtacaagatgttttgactcactctcaattgccatattcttaaagaaaccctgaaaagctgctcaagctggtcagttttctgtaaaaccaagtaaatgaaattttctctcccctcagaaaggaagttctacagcctagagtaccatctattgtgttttataagtccagatttaggctttgaaagatcataccaaaacttcagatcgacttaaacagcaactatgaattaggtttatgggaaatgtagtaatacaggggaaagaatatcggtaatggagtgaaatggtcctgggttcaaatccagtcttcctcacatattgtgctctttaagcttcaaatgagatgtataactgccttttccttaccagtaaaatgaggacaataattatgacaccatagggtggttgtgaggattagcaaatgttatcttgtatttcaggtgcctttcagggaaaggcttggcacatagtaaacacatcctgtaaatatcagtttccccttgttagcccctgtagcatcctgacctaccaagtctataggccttgcatatcactgtgcaccagagatacctcttttacatctgggctctgttttctctctatcaatcctatcctccaccctctttaaatcagaccccaggtttaaccttcccacagtcagtataaatcatttttcagaactttcagctttccatcaagtgaaagttgattttagttacccagtaatgtacagaaaccttcaataatgttaagcttcaaaggcttctggtacgtttgtctaccacagaaccaccacaatatatatgcttgttcttaggtttattgctttttattttaatggggtttggttgtttgggttttattttggttttggcttattttaaagtcaagtttagtttttactcaggtaaaggcctgaagtttcttgggcgtggaagaaaaagcttgggaagcctattaattcatggtgcagttcagaattgtttaaataagctctgtgccactgagcttaatctgaaagtatagtgacatgtgaaggatgcacatatgaatgaaaaactaaaataattgtaggctcttctataaatgaaaaaaaaagtgattggattgtgtctacctttttcctcaaagtaatctaacctaaacggtcatggtgttaaaactttttatggtgctaatcagaaaaattgatgttgcaagaaatgaggtctcaaaaatgggaatgtgcctcctcactctgcgtcacatgggaaataaatcctgaggccaggatcaccagtggggtagagtcatcttcatagtctcctgttatcctccccctgaacaaagaacaaagtgagactgggaagctagtgttggggaaacatttctgggataaactgtggagtggagaagacaatggagggcaaggcaaaaacccacagacttgtttacccatagaggccccactcacctccatgctgacagaattccagaaaaattccttccctatctcccaaacacctgaaattctgaaatattgccctactatttagcactttaagcttcagtgaggtgctgtaatggagagatagcttcatagtttagcctatagccaactttgcctcaagacctccagataagatgaagtggcttttacctcatgtgagtctcaaacgctggagagagagttccacaaccacccctgccctttctcccatattacgctcattagaaagtctactcagggctgggtgccgtggctcatgcctgtaatcccagcactttggaggctgaggcgggtggatcatctgaggtcaggagttcgagaccagcctggccaacatggggaaaccctgtctctactgaaaatataaaaattagccgggcatggtggcgtgcacctgtaattccagctactcgggaggctgaggcaggagaatcacttgaaccccagaggcagaggctacagtgagccaagattgcaccactgcactccaacctgggtgatagaataagactcttgtctcaaggaaagaaaaaatgtctactcagtagagcagtgattggcaaagtgtgagaccccagaccggcaatattggcatctcctggagacttgtttaaaatgctgattactattttcaagaactttctaccttcatttttacttattttttgttttcaagggctcatggaatcagtcttccatgtgacagctttttaaatattttaagacaaaaactgagtcttctaatcttaattgtgttctagcagtagtcattgtaattatagttatttttataatttatttgtttagtgtatatctgtcactctagaatgtaggctccctgagataaaaactataattcttttgatggcagttacattcccaactcttagcacaagatctaggacatagtatgaactcaataaatttttgttgaatgaaagaaaaatgcaaatttataagccttttcagagacctactgaatcaaactctgagagtggagcccagcaatctgttgtaaaagctgtttgagtaatactgttgcactctaagcttgagaaccactgcaatagaactaagagaacattcatttcaccttcaggcctattctctgacatcacttgaaaaatcctctctgccttctgtaacccttaaccaacaacagtgccctgtccatgtaggggaaacttctgggctgtattacaagtgggtaggaaggtataaggatatcatagtgggaagtattgcttagaatgccagtacttgtttgctgtggaaggtttctaggaatggattgcttagtctaaagtaagcactaccaccatccacgttttcactcaacacagtgccttttaattggtgactaacatcaaaacaccttgacaaaccgttaaaacagtatcagaaaccatgtgtacatccctgtgcctcttagattgctaagttctgctctcattcttacttcaaaggacactttttaaagaattgttaatgcttttttataatacaagtcatagccctgttggcaaaaagaaaaaagattcagtgagaaagaaaaatcactgataattccatcatccagggagaaccactgttatttaagtatatggccttccagacttttctgtgcatttatagatatttttaatgggatcaaagtgtacatactgttttgtaactttttttcactcaacaataccatgactgtcttgctgtgtcaagtatatttctacatctcttaatggctgcatgatattccatcatatgtgccacattttattaaactactgttcaatttttaggtttccaactttcattaataaagtgcttt

SEQ ID NO: 181142 - DNA, 6371 bp, Homo sapiens
  Payload ID: 15674
  Gene Symbol: SH3GLB1
  Gene Name: SH3-domain GRB2-like endophilin B1
  Uniprot ID: Q9Y371
  ENST ID: ENST00000370558
  CDS Start-End: 325-1422
gtttttcccttgggacccgggtccacacggcggggtcgcccgtccatctccggctcgcccgcggggcccatcgtcgacgttagcggccgttctccgagccgactgacccatccttggcgctgccgccgcgcgcttgttctcctccctcgccccgccttcatcctccccgttcacggaaacgacagctgcggctgcggggctggcgccgcctccctccacctaccacgtctgccctcgccgctctagccctgcgccccagcccggccgcggcacctccgcctcgccgccgctaggtcggccggctccgcccggctgccgcctaggatgaatatcatggacttcaacgtgaagaagctggcggccgacgcaggcaccttcctcagtcgcgccgtgcagttcacagaagaaaagcttggccaggctgagaagacagaattggatgctcacttagagaacctccttagcaaagctgaatgtaccaaaatatggacagaaaaaataatgaaacaaactgaagtgttattgcagccaaatccaaatgccaggatagaagaatttgtttatgagaaactggatagaaaagctccaagtcgtataaacaacccagaacttttgggacaatatatgattgatgcagggactgagtttggcccaggaacagcttatggtaatgcccttattaaatgtggagaaacccaaaaaagaattggaacagcagacagagaactgattcaaacgtcagccttaaattttcttactcctttaagaaactttatagaaggagattacaaaacaattgctaaagaaaggaaactattgcaaaataagagactggatttggatgctgcaaaaacgagactaaaaaaggcaaaagctgcagaaactagaaattcatctgaacaggaattaagaataactcaaagtgaatttgatcgtcaagcagagattaccagacttctgctagagggaatcagcagtacacatgcccatcaccttcgctgtctgaatgactttgtagaagcccagatgacttactatgcacagtgttaccagtatatgttggacctccagaaacaactgggaagttttccatccaattatcttagtaacaacaatcagacttctgtgacacctgtaccatcagttttaccaaatgcgattggttcttctgccatggcttcaacaagtggcctagtaatcacctctccttccaacctcagtgaccttaaggagtgtagtggcagcagaaaggccagggttctctatgattatgatgcagcaaacagtactgaattatcacttctggcagatgaggtgatcactgtgttcagtgttgttggaatggattcagactggctaatgggggaaaggggaaaccagaagggcaaggtgccaattacctacttagaactgctcaattaagtaggtggactatggaaaggttgcccatcatgactttgtatttatatacaattaactctaaataaagcaggttaagtatcttccatgttaatgtgttaagagactgaaaataccagccatcagaaactggcctttctgccaataaagttgcatggtaaatatttcattacagaatttatgttagagctttcatgccaagaatgttttcttacaaaattctctttttattgaggtttcactaataagcagcttctacttttgagcctcaacttaaagcagaactgttttctactggatttttcattaacagcaagctttttcttttatgtaaaataaatctattgtgaattgatatcagcgactcatttattaggtataaataatagccaaagaataaaattaaaatttattttaaactttcggtcttaaaaagagctgtaggatataaacctcttttgtgaaaagtagaattttctgaatgctttcatagacaaaaacgcatttaaactatgtttacctggttttccaacagaaatcaaatgattttaatattatgttttgatgggttattttcagagttgtttggttttttaaacactactgaatggtttcttttaaatttaagaacaactagttcttgaaaagcaataccgtatttctctgataaatttgtagttaaggttctagaaaatctaggacaaatttacttcattaaacataaagtttttaagattattcagttggcacaatttaatgcataattgggattggatccatttactgtactgtggtacagtaaagagaatgtgttcttattgaacagcagatttgtatacaaatacggaataatgcaactacattataaattgtatacgaacaaaataaattgggtcactctgagcttactattaaaacattgaaaatttattaatgaacacaggctatcttgatgaggatctctgcttatgaaacacatactaatgaaattattagtgacacattggaagctagaaaattgctgttggggccattgctataaatcattgtttccatgttaagacttctgttctaattcattcattcaacaaacatttgttgagggccagatactgtgctggtcaactggggatactgtcctgaacaatatgcacacagttcttgcccctgcagagcttaaagaccattaaaggatacagaaaattaagcaattatcctatagtaggattcgtggtgtgatggggaaaatacaaggtactgtatttgggagtcatgtaactccagttttgggagtgagagagggtctggggaagaactgttccagataaaaagatgtgtaaccaagatagcatagcacattctgacaactaaagcaatttactctaacttaagcatgaagtacaaaagtatagttcatttattgagggaatgttaagctattaaaatgatactttttggtacttttaaaaaaatgaatacttaaacaccgttttaaaattttgtgttaagagctcctaataagaacttggtaaacatgttgacaatttaactcacagtctaaactttaaaagtagtagttacccttttatttctgtgccatgagacaaattcttctgcagttttatagttgtacaagatgttttgactcactctcaattgccatattcttaaagaaaccctgaaaagctgctcaagctggtcagttttctgtaaaaccaagtaaatgaaattttctctcccctcagaaaggaagttctacagcctagagtaccatctattgtgttttataagtccagatttaggctttgaaagatcataccaaaacttcagatcgacttaaacagcaactatgaattaggtttatgggaaatgtagtaatacaggggaaagaatatcggtaatggagtgaaatggtcctgggttcaaatccagtcttcctcacatattgtgctctttaagcttcaaatgagatgtataactgccttttccttaccagtaaaatgaggacaataattatgacaccatagggtggttgtgaggattagcaaatgttatcttgtatttcaggtgcctttcagggaaaggcttggcacatagtaaacacatcctgtaaatatcagtttccccttgttagcccctgtagcatcctgacctaccaagtctataggccttgcatatcactgtgcaccagagatacctcttttacatctgggctctgttttctctctatcaatcctatcctccaccctctttaaatcagaccccaggtttaaccttcccacagtcagtataaatcatttttcagaactttcagctttccatcaagtgaaagttgattttagttacccagtaatgtacagaaaccttcaataatgttaagcttcaaaggcttctggtacgtttgtctaccacagaaccaccacaatatatatgcttgttcttaggtttattgctttttattttaatggggtttggttgtttgggttttattttggttttggcttattttaaagtcaagtttagtttttactcaggtaaaggcctgaagtttcttgggcgtggaagaaaaagcttgggaagcctattaattcatggtgcagttcagaattgtttaaataagctctgtgccactgagcttaatctgaaagtatagtgacatgtgaaggatgcacatatgaatgaaaaactaaaataattgtaggctcttctataaatgaaaaaaaaagtgattggattgtgtctacctttttcctcaaagtaatctaacctaaacggtcatggtgttaaaactttttatggtgctaatcagaaaaattgatgttgcaagaaatgaggtctcaaaaatgggaatgtgcctcctcactctgcgtcacatgggaaataaatcctgaggccaggatcaccagtggggtagagtcatcttcatagtctcctgttatcctccccctgaacaaagaacaaagtgagactgggaagctagtgttggggaaacatttctgggataaactgtggagtggagaagacaatggagggcaaggcaaaaacccacagacttgtttacccatagaggccccactcacctccatgctgacagaattccagaaaaattccttccctatctcccaaacacctgaaattctgaaatattgccctactatttagcactttaagcttcagtgaggtgctgtaatggagagatagcttcatagtttagcctatagccaactttgcctcaagacctccagataagatgaagtggcttttacctcatgtgagtctcaaacgctggagagagagttccacaaccacccctgccctttctcccatattacgctcattagaaagtctactcagggctgggtgccgtggctcatgcctgtaatcccagcactttggaggctgaggcgggtggatcatctgaggtcaggagttcgagaccagcctggccaacatggggaaaccctgtctctactgaaaatataaaaattagccgggcatggtggcgtgcacctgtaattccagctactcgggaggctgaggcaggagaatcacttgaaccccagaggcagaggctacagtgagccaagattgcaccactgcactccaacctgggtgatagaataagactcttgtctcaaggaaagaaaaaatgtctactcagtagagcagtgattggcaaagtgtgagaccccagaccggcaatattggcatctcctggagacttgtttaaaatgctgattactattttcaagaactttctaccttcatttttacttattttttgttttcaagggctcatggaatcagtcttccatgtgacagctttttaaatattttaagacaaaaactgagtcttctaatcttaattgtgttctagcagtagtcattgtaattatagttatttttataatttatttgtttagtgtatatctgtcactctagaatgtaggctccctgagataaaaactataattcttttgatggcagttacattcccaactcttagcacaagatctaggacatagtatgaactcaataaatttttgttgaatgaaagaaaaatgcaaatttataagccttttcagagacctactgaatcaaactctgagagtggagcccagcaatctgttgtaaaagctgtttgagtaatactgttgcactctaagcttgagaaccactgcaatagaactaagagaacattcatttcaccttcaggcctattctctgacatcacttgaaaaatcctctctgccttctgtaacccttaaccaacaacagtgccctgtccatgtaggggaaacttctgggctgtattacaagtgggtaggaaggtataaggatatcatagtgggaagtattgcttagaatgccagtacttgtttgctgtggaaggtttctaggaatggattgcttagtctaaagtaagcactaccaccatccacgttttcactcaacacagtgccttttaattggtgactaacatcaaaacaccttgacaaaccgttaaaacagtatcagaaaccatgtgtacatccctgtgcctcttagattgctaagttctgctctcattcttacttcaaaggacactttttaaagaattgttaatgcttttttataatacaagtcatagccctgttggcaaaaagaaaaaagattcagtgagaaagaaaaatcactgataattccatcatccagggagaaccactgttatttaagtatatggccttccagacttttctgtgcatttatagatatttttaatgggatcaaagtgtacatactgttttgtaactttttttcactcaacaataccatgactgtcttgctgtgtcaagtatatttctacatctcttaatggctgcatgatattccatcatatgtgccacattttattaaactactgttcaatttttaggtttccaactttcattaataaagtgctttaaagaaca

SEQ ID NO: 181143 - DNA, 6456 bp, Homo sapiens
  Payload ID: 15674
  Gene Symbol: SH3GLB1
  Gene Name: SH3-domain GRB2-like endophilin B1
  ENST ID: ENST00000616170
  CDS Start-End: 331-1515
gcgcttgtttttcccttgggacccgggtccacacggcggggtcgcccgtccatctccggctcgcccgcggggcccatcgtcgacgttagcggccgttctccgagccgactgacccatccttggcgctgccgccgcgcgcttgttctcctccctcgccccgccttcatcctccccgttcacggaaacgacagctgcggctgcggggctggcgccgcctccctccacctaccacgtctgccctcgccgctctagccctgcgccccagcccggccgcggcacctccgcctcgccgccgctaggtcggccggctccgcccggctgccgcctaggatgaatatcatggacttcaacgtgaagaagctggcggccgacgcaggcaccttcctcagtcgcgccgtgcagttcacagaagaaaagcttggccaggctgagaagacagaattggatgctcacttagagaacctccttagcaaagctgaatgtaccaaaatatggacagaaaaaataatgaaacaaactgaagtgttattgcagccaaatccaaatgccaggatagaagaatttgtttatgagaaactggatagaaaagctccaagtcgtataaacaacccagaacttttgggacaatatatgattgatgcagggactgagtttggcccaggaacagcttatggtaatgcccttattaaatgtggagaaacccaaaaaagaattggaacagcagacagagaactgattcaaacgtcagccttaaattttcttactcctttaagaaactttatagaaggagattacaaaacaattgctaaagaaaggaaactattgcaaaataagagactggatttggatgctgcaaaaacgagactaaaaaaggcaaaagctgcagaaactagaaattcacaactaaactcagctcgccttgaaggagataacattatggtaaatttctcttacatgctcaacttcctgcatgtaaaatggctgaagtctgaacaggaattaagaataactcaaagtgaatttgatcgtcaagcagagattaccagacttctgctagagggaatcagcagtacacatgcccatcaccttcgctgtctgaatgactttgtagaagcccagatgacttactatgcacagtgttaccagtatatgttggacctccagaaacaactgggaagttttccatccaattatcttagtaacaacaatcagacttctgtgacacctgtaccatcagttttaccaaatgcgattggttcttctgccatggcttcaacaagtggcctagtaatcacctctccttccaacctcagtgaccttaaggagtgtagtggcagcagaaaggccagggttctctatgattatgatgcagcaaacagtactgaattatcacttctggcagatgaggtgatcactgtgttcagtgttgttggaatggattcagactggctaatgggggaaaggggaaaccagaagggcaaggtgccaattacctacttagaactgctcaattaagtaggtggactatggaaaggttgcccatcatgactttgtatttatatacaattaactctaaataaagcaggttaagtatcttccatgttaatgtgttaagagactgaaaataccagccatcagaaactggcctttctgccaataaagttgcatggtaaatatttcattacagaatttatgttagagctttcatgccaagaatgttttcttacaaaattctctttttattgaggtttcactaataagcagcttctacttttgagcctcaacttaaagcagaactgttttctactggatttttcattaacagcaagctttttcttttatgtaaaataaatctattgtgaattgatatcagcgactcatttattaggtataaataatagccaaagaataaaattaaaatttattttaaactttcggtcttaaaaagagctgtaggatataaacctcttttgtgaaaagtagaattttctgaatgctttcatagacaaaaacgcatttaaactatgtttacctggttttccaacagaaatcaaatgattttaatattatgttttgatgggttattttcagagttgtttggttttttaaacactactgaatggtttcttttaaatttaagaacaactagttcttgaaaagcaataccgtatttctctgataaatttgtagttaaggttctagaaaatctaggacaaatttacttcattaaacataaagtttttaagattattcagttggcacaatttaatgcataattgggattggatccatttactgtactgtggtacagtaaagagaatgtgttcttattgaacagcagatttgtatacaaatacggaataatgcaactacattataaattgtatacgaacaaaataaattgggtcactctgagcttactattaaaacattgaaaatttattaatgaacacaggctatcttgatgaggatctctgcttatgaaacacatactaatgaaattattagtgacacattggaagctagaaaattgctgttggggccattgctataaatcattgtttccatgttaagacttctgttctaattcattcattcaacaaacatttgttgagggccagatactgtgctggtcaactggggatactgtcctgaacaatatgcacacagttcttgcccctgcagagcttaaagaccattaaaggatacagaaaattaagcaattatcctatagtaggattcgtggtgtgatggggaaaatacaaggtactgtatttgggagtcatgtaactccagttttgggagtgagagagggtctggggaagaactgttccagataaaaagatgtgtaaccaagatagcatagcacattctgacaactaaagcaatttactctaacttaagcatgaagtacaaaagtatagttcatttattgagggaatgttaagctattaaaatgatactttttggtacttttaaaaaaatgaatacttaaacaccgttttaaaattttgtgttaagagctcctaataagaacttggtaaacatgttgacaatttaactcacagtctaaactttaaaagtagtagttacccttttatttctgtgccatgagacaaattcttctgcagttttatagttgtacaagatgttttgactcactctcaattgccatattcttaaagaaaccctgaaaagctgctcaagctggtcagttttctgtaaaaccaagtaaatgaaattttctctcccctcagaaaggaagttctacagcctagagtaccatctattgtgttttataagtccagatttaggctttgaaagatcataccaaaacttcagatcgacttaaacagcaactatgaattaggtttatgggaaatgtagtaatacaggggaaagaatatcggtaatggagtgaaatggtcctgggttcaaatccagtcttcctcacatattgtgctctttaagcttcaaatgagatgtataactgccttttccttaccagtaaaatgaggacaataattatgacaccatagggtggttgtgaggattagcaaatgttatcttgtatttcaggtgcctttcagggaaaggcttggcacatagtaaacacatcctgtaaatatcagtttccccttgttagcccctgtagcatcctgacctaccaagtctataggccttgcatatcactgtgcaccagagatacctcttttacatctgggctctgttttctctctatcaatcctatcctccaccctctttaaatcagaccccaggtttaaccttcccacagtcagtataaatcatttttcagaactttcagctttccatcaagtgaaagttgattttagttacccagtaatgtacagaaaccttcaataatgttaagcttcaaaggcttctggtacgtttgtctaccacagaaccaccacaatatatatgcttgttcttaggtttattgctttttattttaatggggtttggttgtttgggttttattttggttttggcttattttaaagtcaagtttagtttttactcaggtaaaggcctgaagtttcttgggcgtggaagaaaaagcttgggaagcctattaattcatggtgcagttcagaattgtttaaataagctctgtgccactgagcttaatctgaaagtatagtgacatgtgaaggatgcacatatgaatgaaaaactaaaataattgtaggctcttctataaatgaaaaaaaaagtgattggattgtgtctacctttttcctcaaagtaatctaacctaaacggtcatggtgttaaaactttttatggtgctaatcagaaaaattgatgttgcaagaaatgaggtctcaaaaatgggaatgtgcctcctcactctgcgtcacatgggaaataaatcctgaggccaggatcaccagtggggtagagtcatcttcatagtctcctgttatcctccccctgaacaaagaacaaagtgagactgggaagctagtgttggggaaacatttctgggataaactgtggagtggagaagacaatggagggcaaggcaaaaacccacagacttgtttacccatagaggccccactcacctccatgctgacagaattccagaaaaattccttccctatctcccaaacacctgaaattctgaaatattgccctactatttagcactttaagcttcagtgaggtgctgtaatggagagatagcttcatagtttagcctatagccaactttgcctcaagacctccagataagatgaagtggcttttacctcatgtgagtctcaaacgctggagagagagttccacaaccacccctgccctttctcccatattacgctcattagaaagtctactcagggctgggtgccgtggctcatgcctgtaatcccagcactttggaggctgaggcgggtggatcatctgaggtcaggagttcgagaccagcctggccaacatggggaaaccctgtctctactgaaaatataaaaattagccgggcatggtggcgtgcacctgtaattccagctactcgggaggctgaggcaggagaatcacttgaaccccagaggcagaggctacagtgagccaagattgcaccactgcactccaacctgggtgatagaataagactcttgtctcaaggaaagaaaaaatgtctactcagtagagcagtgattggcaaagtgtgagaccccagaccggcaatattggcatctcctggagacttgtttaaaatgctgattactattttcaagaactttctaccttcatttttacttattttttgttttcaagggctcatggaatcagtcttccatgtgacagctttttaaatattttaagacaaaaactgagtcttctaatcttaattgtgttctagcagtagtcattgtaattatagttatttttataatttatttgtttagtgtatatctgtcactctagaatgtaggctccctgagataaaaactataattcttttgatggcagttacattcccaactcttagcacaagatctaggacatagtatgaactcaataaatttttgttgaatgaaagaaaaatgcaaatttataagccttttcagagacctactgaatcaaactctgagagtggagcccagcaatctgttgtaaaagctgtttgagtaatactgttgcactctaagcttgagaaccactgcaatagaactaagagaacattcatttcaccttcaggcctattctctgacatcacttgaaaaatcctctctgccttctgtaacccttaaccaacaacagtgccctgtccatgtaggggaaacttctgggctgtattacaagtgggtaggaaggtataaggatatcatagtgggaagtattgcttagaatgccagtacttgtttgctgtggaaggtttctaggaatggattgcttagtctaaagtaagcactaccaccatccacgttttcactcaacacagtgccttttaattggtgactaacatcaaaacaccttgacaaaccgttaaaacagtatcagaaaccatgtgtacatccctgtgcctcttagattgctaagttctgctctcattcttacttcaaaggacactttttaaagaattgttaatgcttttttataatacaagtcatagccctgttggcaaaaagaaaaaagattcagtgagaaagaaaaatcactgataattccatcatccagggagaaccactgttatttaagtatatggccttccagacttttctgtgcatttatagatatttttaatgggatcaaagtgtacatactgttttgtaactttttttcactcaacaataccatgactgtcttgctgtgtcaagtatatttctacatctcttaatggctgcatgatattccatcatatgtgccacattttattaaactactgttcaatttttaggtttccaactttcattaataaagtgcttt

SEQ ID NO: 181144 - DNA, 1985 bp, Homo sapiens
  Payload ID: 15675
  Gene Symbol: SH3GLB2
  Gene Name: SH3-domain GRB2-like endophilin B2
  Uniprot ID: Q9NR46
  ENST ID: ENST00000372554
  CDS Start-End: 126-1340
cggcaggcgggtgcgcggagggctggtgccccgcagcaggtgggcggggtgcggttggcggcggcggctgggccgggggctgccggctgcgctcgggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagccaaagccacgtgtgagggagatacggtgcctgactttcaggagactagacctcgtaattacattctctcggccagcgcctccgcgctctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagctcccagggtgccatatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctaggcaggtgcccccatcccccccgcattctggcctaggcaggagaggatgggcgcagccctgccacttaacttgtttgttggtgacacagttgttcagagtggggagaattcaccccattctgtccctgcccctagtcacctagctgtgagggtgcctgaggctgaatggctccacccctcccccagccctgcttctgacctgtggctctggagcccctgcccctgcctgcatccccgagcaccccaccctccaggctccactaaggagggaggggctgtctgcagcagctgcactcagcacctaggccagggtggggccgccgcagatgggctcaggaagccccaggtgcactcagcgagagccctgcctttcagttgccaaaagctgcatcaggggaatgcggcaaggcacacagggctctggcagcccctggggactgggcgctgcccctgggaggggagagcctggccagggctggtgttgggcccggagcagcatcttccggtgctatcctcccctcccacccctcacagctcaagccaagtccagcggccgcagtcttcacctctccacactcactttttatctggtgtttttacttctgcctgcgtttgctctctagccaataaaccgtccttgtgtgcg

SEQ ID NO: 181145 - DNA, 1365 bp, Homo sapiens
  Payload ID: 15675
  Gene Symbol: SH3GLB2
  Gene Name: SH3-domain GRB2-like endophilin B2
  Uniprot ID: Q9NR46
  ENST ID: ENST00000372559
  CDS Start-End: 61-1248
ggctgggccgggggctgccggctgcgctcgggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagccaaagccacgacggtgcctgactttcaggagactagacctcgtaattacattctctcggccagcgcctccgcgctctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctagctcaagccaagtccagcggccgcagtcttcacctctccacactcactttttatctggtgtttttacttctgcctgcgtttgctctctagccaataaaccgtccttgtgtgcgagtca

SEQ ID NO: 181146 - DNA, 2982 bp, Homo sapiens
  Payload ID: 15675
  Gene Symbol: SH3GLB2
  Gene Name: SH3-domain GRB2-like endophilin B2
  Uniprot ID: Q9NR46
  ENST ID: ENST00000372564
  CDS Start-End: 147-1334
cgggcgggcaggcgggcaggccggcaggcgggtgcgcggagggctggtgccccgcagcaggtgggcggggtgcggttggcggcggcggctgggccgggggctgccggctgcgctcgggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagccaaagccacgacggtgcctgactttcaggagactagacctcgtaattacattctctcggccagcgcctccgcgctctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctaggcaggtgcccccatcccccccgcattctggcctaggcaggagaggatgggcgcagccctgccacttaacttgtttgttggtgacacagttgttcagagtggggagaattcaccccattctgtccctgcccctagtcacctagctgtgagggtgcctgaggctgaatggctccacccctcccccagccctgcttctgacctgtggctctggagcccctgcccctgcctgcatccccgagcaccccaccctccaggctccactaaggagggaggggctgtctgcagcagctgcactcagcacctaggccagggtggggccgccgcagatgggctcaggaagccccaggtgcactcagcgagagccctgcctttcagttgccaaaagctgcatcaggggaatgcggcaaggcacacagggctctggcagcccctggggactgggcgctgcccctgggaggggagagcctggccagggctggtgttgggcccggagcagcatcttccggtgctatcctcccctcccacccctcacagctcaagccaagtccagcggccgcagtcttcacctctccacactcactttttatctggtgtttttacttctgcctgcgtttgctctctagccaataaaccgtccttgtgtgcgagtcacctgggctcctgtcagggcctggccctgagggtggtaaagggaaaggtagactcaccctctgccccactcttccacagagtgagcaggggccctgtggctgccccggcccccagctctctagttgggaagaagtgcagccctccctgtcttctgcggggcctgtgcctctcagagggcagtgctgttcctggacatgaagccgcacaaggaacgttttattcctaagaaaaagtttcctaaatttggattgtggagcggactgtagaatgcgtctgacagttcagttcaagcacaagaagtgggtagcggtcagtgctgtctgcaggtcgggcgtttcacccagcatgtgcccccgtgccatgggttctcatgccgtcctcagtgtccacatttcacagatgagatcagcaagacagtcagctcctcaagggaccacagttggcaagtggccaagcagggactgaagcccaggcagcctgattctagaaaccctaagtgatgtctgtgttttagatggcccctagcaggacctagcattctgacttcagtcctgagaaggccaacagccagtaggccccactgttggggcttctgaagaggggatcgggggatgacgggggcacggggctataaataggaaggcacagagcttcaagaaaggctcacccagggatgagctcagcccactgggccaatgaaagcagggtcaaggacaggaccagcgcaggccaaggaagggaatatctgacagcgcccacccagccaaaccctcagcccaaggacaggaatgaggagatgctggtgaactagccatccatcagtacctgccttcccccgaggctgcagccccactcccaggcgcctggccaggggagttttctaggttctgagagccacgttgtcatccctgggctttgaagttaaacatcacacagctgtctataaacaagattttaatatctgtataaatagaccacagaattaccaaaactgcaaa

SEQ ID NO: 181147 - DNA, 1415 bp, Homo sapiens
  Payload ID: 15675
  Gene Symbol: SH3GLB2
  Gene Name: SH3-domain GRB2-like endophilin B2
  ENST ID: ENST00000416629
  CDS Start-End: 57-1181
gggccgggggctgccggctgcgctcgggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagccaaagccacgctctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctaggcaggtgcccccatcccccccgcattctggcctaggcaggagaggatgggcgcagccctgccacttaacttgtttgttggtgacacagttgttcagagtggggagaattcaccccattctgtccctgcccctagtcacctagctgtgagggtgcctgaggctgaatggctccacccctcccccagccctgcttctgacctgtggctctggagcccctgcccctgcctgcatccc

SEQ ID NO: 181148 - DNA, 837 bp, Homo sapiens
  Payload ID: 15675
  Gene Symbol: SH3GLB2
  Gene Name: SH3-domain GRB2-like endophilin B2
  ENST ID: ENST00000455407
  CDS Start-End: 150-224
cggcgggcgggcaggcgggcaggccggcaggcgggtgcgcggagggctggtgccccgcagcaggtgggcggggtgcggttggcggcggcggctgggccgggggctgccggctgcgctcgggccgtgcgcggcggccgtgcgggcacgccatggacttcaacatgaagaagctggcgtcggacgcgggcatcttcttcacccgggcggtgcagggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagccaaagccacgacggtgcctgactttcaggagactagacctcgtaattacattctctcggccagcgcctccgcgctctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagatttcccggcaccttcgtgggcaccacagagcccgcctccccacccctgagcagcacctcacccaccactgctgcggccactatgcctgtggtgccctctgtggccagcctggcccctcc

SEQ ID NO: 181149 - DNA, 720 bp, Homo sapiens
  Payload ID: 15675
  Gene Symbol: SH3GLB2
  Gene Name: SH3-domain GRB2-like endophilin B2
  ENST ID: ENST00000416230
  CDS Start-End: 45-428
gccggctgcgctcgggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgacaggatcttgctgtgtcacccagactggagtgcagtggtgcaatcatagcttactactatagcctcaaactcctgggttcaaatgatccttccgcctgggcctcccagagtattgggattacagggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagc

SEQ ID NO: 181150 - DNA, 1468 bp, Homo sapiens
  Payload ID: 15675
  Gene Symbol: SH3GLB2
  Gene Name: SH3-domain GRB2-like endophilin B2
  ENST ID: ENST00000417224
  CDS Start-End: 32-1234
gggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagccaaagccacgacggtgcctgactttcaggagactagacctcgtaattacattctctcggccagcgcctccgcgctctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagctcccagggtgccatatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctaggcaggtgcccccatcccccccgcattctggcctaggcaggagaggatgggcgcagccctgccacttaacttgtttgttggtgacacagttgttcagagtggggagaattcaccccattctgtccctgcccctagtcacctagctgtgagggtgcctgaggctgaatggctccacccctcccccagccctgcttctgacctgtggctctggagcccctgcccctgcctgcatccc

SEQ ID NO: 181151 - DNA, 538 bp, Homo sapiens
  Payload ID: 15675
  Gene Symbol: SH3GLB2
  Gene Name: SH3-domain GRB2-like endophilin B2
  ENST ID: ENST00000425236
  CDS Start-End: 1-180
gtggaggagttcctgtatgagaagctggacaggaaggtcccctcaagggtcaccaacggggagctgctggctcagtacatggcagacgcggccagtgagctggggccgaccaccccctatggatcttgctgtgtcacccagactggagtgcagtggtgcaatcatagcttactactatagcctcaaactcctgggttcaaatgatccttccgcctgggcctcccagagtattgggattacagggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagccaaagccacgacggtgcctgactttcaggagactagacctcgtaattacattctctcggccagcgcctccgcggtaagc

SEQ ID NO: 181152 - DNA, 1944 bp, Homo sapiens
  Payload ID: 15676
  Gene Symbol: SH3KBP1
  Gene Name: SH3-domain kinase binding protein 1
  ENST ID: ENST00000379697
  CDS Start-End: 150-1811
gccgccactgaggaagaagccggcccagccgccgccgcgtccggaccctcgcgcctggatcccagcgccccgatcccggcgccccaacccccacgcccgcctccgccaactttcacgctgcctcggcggcccggcccggctcgacgccaatggtggaggccatagtggagtttgactaccaggcccagcacgatgatgagctgacgatcagcgtgggtgaaatcatcaccaacatcaggaaggaggatggaggctggtgggagggacagatcaacggcaggagaggtttgttccctgacaactttgtaagagaaataaagaaagagatgaagaaagaccctctcaccaacaaagctccagaaaagcccctgcacgaagtgcccagtggaaactctttgctgtcttctgaaacgattttaagaaccaataagagaggcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaaggcctgaaggtctccctccagcttctctgctgccctttccagctcacggagcaaaaggaaagactacctttgaagggacaattctgtaccgagctgcaccgggaaagacggagggccacagacgctattacagtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggtactgctgtgctctcacctccggggcgggtgtggggtggctatggaaggaacacaggaggggaactgactgccacagaccttgggaggaagggagaggagaagggggtgctcaagcttccctcttacatcctccagcaaaattatctgaagacaccggccacttctgtccttgctcctgcactcaggcaggagtgagtgtgaggttgaggggtgcggtgtgggtttcatgaggactgggtacccagcatttaggccctgctcacacacaggggtttttcctgggccttattagaagcaaggccaactgcccttcagcctggaaatgcaggtggcgtgtccctctttgtccccctggatgttgtg

SEQ ID NO: 181153 - DNA, 2678 bp, Homo sapiens
  Payload ID: 15676
  Gene Symbol: SH3KBP1
  Gene Name: SH3-domain kinase binding protein 1
  Uniprot ID: Q96B97
  ENST ID: ENST00000379698
  CDS Start-End: 68-1954
gagcacggaacttattcctgcccagagttcagacacagccagaaattaccatttcatacttcacagaatggaggtttcagcagccaaagccccaagtgccgcagacttgtctgagattgaaataaagaaagagatgaagaaagaccctctcaccaacaaagctccagaaaagcccctgcacgaagtgcccagtggaaactctttgctgtcttctgaaacgattttaagaaccaataagagaggcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaagtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaa

SEQ ID NO: 181154 - DNA, 3819 bp, Homo sapiens
  Payload ID: 15676
  Gene Symbol: SH3KBP1
  Gene Name: SH3-domain kinase binding protein 1
  Uniprot ID: Q96B97
  ENST ID: ENST00000379716
  CDS Start-End: 126-1409
tttggtcccaagtatgactcagggttaggctgggtcctcaggctccgtgctgttggaaggaagtgggaggattccaggggagttctgggaccttttcaaactgaagagaggaggctggctgcatcatgggagaagagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatgaaaacaagggagggaaagttgtattatttcctgcactgggttacccgtgtgtgttatcgtttaaactgtattcacataatgtcatttgccttgctcacttgtaaccccttcctcaggtccaagagaatgggaggagggtcatgttgaagtgtagccactggaactttcttgcatttatggagttgctttttctttcccaaggaaactgatgtttgcctgtccgctttatctttgtagtacatgaacagttcagccttagactatgtaactgttttctcatccttagctgaaaatgaggggcctactgtattgcgagactgttcaggggtaggggtggagggggtggtcccttaatggcccctgaagatgttggatgtgtttctcaaaagctgctttgtctctttcctgagtttaatagtgaaactactaaacattaatagatttgcacagccacaaagaatgagagttgataataccgaagaagtgatgcaaaaacaaaaaatcacattactgatcattgatagtattacaaataaatgtctcttcctttctcttcctcccttcctccccctgccttcctcttaacctatgtgctcatccttgctacttgaggctgttatttccctccgagtatttaaggagcccaaacaccttggtcttcctgggtgggggcataattaagggaagggagtgtataaggaaggaaacctcataccctccattcccatccctggatatattgccttttcagcagcctcgggttcagtgtgcttggggtcaggagtgccaggttcccaagagcagcgtaaaacatccctgtaccccttgacagttataagcatttctgcgttaaacttgaagattccagagattccccacgacctaatgatctaagaatgcagattggattctttgatgttcaaatttctcatttacttatgaaaatccctaattatatagttttatataatgtgtatacagagtaggattgttgatgaaattgagcggttggaacaccctcatggaacactggcaacatggaatgtagagagctgatgtcttccccctcatagaggccattggcttcctttgtataaggagagggagaagtgattctggaaggagaagttggtatgtctagcttcattgcggcccctcgggctacccagcaagaggattctgcatcaaggaactggacgagccgctacccaaactgccaccatctttactctttacaaaatggacccatcgagaatgttgaaaagcttggaagtatcacttttgaaaaaaaaaaaaattattttgcattcagcatggactcgaccaggcatctatggagattatttttttgcttcattttataaagttgtatttagaaaagtcttaagtattgtgctttgtaaa

SEQ ID NO: 181155 - DNA, 1941 bp, Homo sapiens
  Payload ID: 15676
  Gene Symbol: SH3KBP1
  Gene Name: SH3-domain kinase binding protein 1
  ENST ID: ENST00000379726
  CDS Start-End: 1-1938
ctcaccaacaaagctccagaaaagcccctgcacgaagtgcccagtggaaactctttgctgtcttctgaaacgattttaagaaccaataagagaggcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaaggcctgaaggtctccctccagcttctctgctgccctttccagctcacggagcaaaaggaaagactacctttgaagggacaattctgtaccgagctgcaccgggaaagacggagggccacagacgctattacagtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaata

SEQ ID NO: 181156 - DNA, 4731 bp, Homo sapiens
  Payload ID: 15676
  Gene Symbol: SH3KBP1
  Gene Name: SH3-domain kinase binding protein 1
  Uniprot ID: Q96B97
  ENST ID: ENST00000397821
  CDS Start-End: 292-2289
cgcaatttccactcgcggggagcaggaaacccggcgcagccgggcgcattgggccgcgatgcaacagcagcagcaggagtcgccccggggcagcagcggcagcagcagcagaggcagcagcgggcggcgctgagccgccgccgccgccactgaggaagaagccggcccagccgccgccgcgtccggaccctcgcgcctggatcccagcgccccgatcccggcgccccaacccccacgcccgcctccgccaactttcacgctgcctcggcggcccggcccggctcgacgccaatggtggaggccatagtggagtttgactaccaggcccagcacgatgatgagctgacgatcagcgtgggtgaaatcatcaccaacatcaggaaggaggatggaggctggtgggagggacagatcaacggcaggagaggtttgttccctgacaactttgtaagagaaataaagaaagagatgaagaaagaccctctcaccaacaaagctccagaaaagcccctgcacgaagtgcccagtggaaactctttgctgtcttctgaaacgattttaagaaccaataagagaggcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaagtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatgaaaacaagggagggaaagttgtattatttcctgcactgggttacccgtgtgtgttatcgtttaaactgtattcacataatgtcatttgccttgctcacttgtaaccccttcctcaggtccaagagaatgggaggagggtcatgttgaagtgtagccactggaactttcttgcatttatggagttgctttttctttcccaaggaaactgatgtttgcctgtccgctttatctttgtagtacatgaacagttcagccttagactatgtaactgttttctcatccttagctgaaaatgaggggcctactgtattgcgagactgttcaggggtaggggtggagggggtggtcccttaatggcccctgaagatgttggatgtgtttctcaaaagctgctttgtctctttcctgagtttaatagtgaaactactaaacattaatagatttgcacagccacaaagaatgagagttgataataccgaagaagtgatgcaaaaacaaaaaatcacattactgatcattgatagtattacaaataaatgtctcttcctttctcttcctcccttcctccccctgccttcctcttaacctatgtgctcatccttgctacttgaggctgttatttccctccgagtatttaaggagcccaaacaccttggtcttcctgggtgggggcataattaagggaagggagtgtataaggaaggaaacctcataccctccattcccatccctggatatattgccttttcagcagcctcgggttcagtgtgcttggggtcaggagtgccaggttcccaagagcagcgtaaaacatccctgtaccccttgacagttataagcatttctgcgttaaacttgaagattccagagattccccacgacctaatgatctaagaatgcagattggattctttgatgttcaaatttctcatttacttatgaaaatccctaattatatagttttatataatgtgtatacagagtaggattgttgatgaaattgagcggttggaacaccctcatggaacactggcaacatggaatgtagagagctgatgtcttccccctcatagaggccattggcttcctttgtataaggagagggagaagtgattctggaaggagaagttggtatgtctagcttcattgcggcccctcgggctacccagcaagaggattctgcatcaaggaactggacgagccgctacccaaactgccaccatctttactctttacaaaatggacccatcgagaatgttgaaaagcttggaagtatcacttttgaaaaaaaaaaaaattattttgcattcagcatggactcgaccaggcatctatggagattatttttttgcttcattttataaagttgtatttagaaaagtcttaagtattgtgctttgtaaagaagatgattaaaatgaaattttgtgagaata

SEQ ID NO: 181157 - DNA, 663 bp, Homo sapiens
  Payload ID: 15676
  Gene Symbol: SH3KBP1
  Gene Name: SH3-domain kinase binding protein 1
  ENST ID: ENST00000432234
  CDS Start-End: 38-663
gctgctgtgaacagaggcagcaactggggaattggatatggaaataaagaaagagatgaagaaagaccctctcaccaacaaagctccagaaaagcccctgcacgaagtgcccagtggaaactctttgctgtcttctgaaacgattttaagaaccaataagagaggcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaagtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaagactattgggaagaagttacctgcaactacagcaactccagactcatcaaaaacagaaat

SEQ ID NO: 181158 - DNA, 518 bp, Homo sapiens
  Payload ID: 15676
  Gene Symbol: SH3KBP1
  Gene Name: SH3-domain kinase binding protein 1
  ENST ID: ENST00000431164
  CDS Start-End: 70-518
cgccaaggcggtggcgtggatcttgataggccgtgagctctttggcagaaatgaaactgttaacaaaggatggaaagaagcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaagtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaa

SEQ ID NO: 181159 - DNA, 2363 bp, Homo sapiens
  Payload ID: 15677
  Gene Symbol: SHKBP1
  Gene Name: SH3KBP1 binding protein 1
  Uniprot ID: Q8TBC3
  ENST ID: ENST00000291842
  CDS Start-End: 50-2173
gggtgcacacccggaagtgggtgcgggccagccggctcgcccgggggccatggcagcagcggctactgcagccgagggggtccccagtcgggggcctcccggggaagtcattcatctgaatgtgggaggcaagagattcagtacctctcgccagactctcacctggatcccagactccttcttctccagtcttctgagcggacgcatctcgacgctgaaagatgagaccggagcaatcttcatcgacagggaccctacagtcttcgcccccatcctcaacttcctgcgcaccaaagagttggatcccaggggtgtccacggttccagcctcctccatgaagcccagttctatgggctcactcctctggttcgtcgcctgcagcttcgagaggagttggatcgatcttcttgtggaaacgtcctcttcaatggttacctgccgccaccagtgttcccagtgaagcggcggaaccggcacagcctagtggggcctcagcagctaggaggacggccagcccctgtccgacggagcaacacgatgccccccaaccttggcaatgcagggctgctgggccgaatgctggatgagaaaacccctccctcaccctcaggacaacctgaggagccggggatggtgcgcctggtgtgtggacaccataattggatcgctgtggcctatacccagtttctagtctgctacaggttgaaggaagcctctggctggcagctggtgttttccagcccccgcctggactggcccatcgaacgactggcgctcacagcccgggtgcatggtggggctttgggtgaacatgacaagatggtggcagcagccaccggcagcgagatcctgctatgggctctgcaggcggaaggcggtggctccgagataggggtctttcatctgggggtgcctgtggaggccttgttcttcgtcgggaaccagctcattgctacaagccacacagggcgcatcggggtgtggaatgccgtcaccaagcactggcaggtccaggaggtgcagcccatcaccagttatgacgcggcaggctccttcctcctcctgggctgcaacaacggctccatttactacgtggatgtgcagaagttccccttgcgcatgaaagacaacgacctccttgtcagcgagctctatcgggacccagcggaggatggggtcaccgccctcagtgtctacctcacccccaagaccagtgacagtgggaactggatcgagatcgcctatggcaccagctcagggggcgtgcgggtcatcgtgcagcacccggagactgtgggctcggggcctcagctcttccagaccttcactgtgcaccgcagccctgtcaccaagatcatgctgtcggagaagcacctcatctcagtctgtgccgacaacaaccacgtgcggacatggtctgtgactcgcttccgcggcatgatttccacccagcccggctccaccccactcgcttcctttaagatcctggctctggagtcggcagatgggcatggcggctgcagtgctggcaatgacattggcccctacggtgagcgggacgaccagcaagtgttcatccagaaggtggtgcccagtgccagccagctcttcgtgcgtctctcatctactgggcagcgggtgtgctccgtgcgctccgtggacggctcacccacgacagccttcacagtgctggagtgcgagggctcccggcggctcggctctcggccccggcgctacctgctcactggccaggccaacggcagcttggccatgtgggacctaaccaccgccatggacggcctcggccaggcccctgcaggtggcctgacggagcaagagctgatggaacagctggaacactgtgagctggccccgccggctccttcagctccctcatggggctgtctccccagcccctcaccccgcatctccctcaccagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccacccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaccccgggttcagggccagggcctccttggaataaatggttattgttactaggtccccaccttccctcttttctggaagccaaagtcaccctccccaataaagtcctcactgccaa

SEQ ID NO: 181160 - DNA, 575 bp, Homo sapiens
  Payload ID: 15677
  Gene Symbol: SHKBP1
  Gene Name: SH3KBP1 binding protein 1
  ENST ID: ENST00000595523
  CDS Start-End: 142-255
gcattcctcacccgctcctcttcatctcttgcgtccgtttaccttccccgcccagattcagtacctctcgccagactctcacctggatcccagactccttcttctccagtcttctgagcggacgcatctcgacgctgaaagatgagaccggagcaatcttcatcgacagggaccctacagtcttcgcccccatcctcaacttcctgcgcaccaaagagttggatcccagcattctctgttcacccccacacctagaccctgacctctagtcaattctactacccaggggtgtccacggttccagcctcctccatgaagcccagttctatgggctcactcctctggttcgtcgcctgcagcttcgagaggagttggatcgatcttcttgtggaaacgtcctcttcaatggttacctgccgccaccagtgttcccagtgaagcggcggaaccggcacagcctagtggggcctcagcagctaggaggacggccagcccctgtccgacggagcaacacgatgccccccaaccttggcaatgcagggctgctgggccgaatgctggatgagaaaacccct

SEQ ID NO: 181161 - DNA, 552 bp, Homo sapiens
  Payload ID: 15677
  Gene Symbol: SHKBP1
  Gene Name: SH3KBP1 binding protein 1
  ENST ID: ENST00000595631
  CDS Start-End: 160-552
atcctgcgggagggggacgcattcctcacccgctcctcttcatctcttgcgtccgtttaccttccccgcccagattcagtacctctcgccagactctcacctggatcccagactccttcttctccagtcttctgagcggacgcatctcgacgctgaaagatgagaccggagcaatcttcatcgacagggaccctacagtcttcgcccccatcctcaacttcctgcgcaccaaagagttggatcccagttcgtcgcctgcagcttcgagaggagttggatcgatcttcttgtggaaacgtcctcttcaatggttacctgccgccaccagtgttcccagtgaagcggcggaaccggcacagcctagtggggcctcagcagctaggaggacggccagcccctgtccgacggagcaacacgatgccccccaaccttggcaatgcagggctgctgggccgaatgctggatgagaaaacccctccctcaccctcaggacaacctgaggagccggggatggtgcgcctggtgtgtggacaccataattggatcgctgtg

SEQ ID NO: 181162 - DNA, 913 bp, Homo sapiens
  Payload ID: 15677
  Gene Symbol: SHKBP1
  Gene Name: SH3KBP1 binding protein 1
  ENST ID: ENST00000600320
  CDS Start-End: 1-752
gcgagctctatcgggacccagcggaggatggggtcaccgccctcagtgtctacctcacccccaagaccagtgacagtgggaactggatcgagatcgcctatggcaccagctcagggggcgtgcgggtcatcgtgcagcacccggagactgtgggctcggggcctcagctcttccagaccttcactgtgcaccgcagccctgtcaccaagatcatgctgtcggagaagcacctcatctcagtctgtgccgacaacaaccacgtgcggacatggtctgtgactcgcttccgcggcatgatttccacccagcccggctccaccccactcgcttcctttaagatcctggctctggagtcggcagatgggcatggcggctgcagtgctggcaatgacattgcaggtggcctgacggagcaagagctgatggaacagctggaacactgtgagctggccccgccggctccttcagctccctcatggggctgtctccccagcccctcaccccgcatctccctcaccagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccacccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaccccgggttcagggccagggcctccttggaataaatggttattgttactaggtccccaccttccctcttttctggaagccaaagtc

SEQ ID NO: 181163 - DNA, 823 bp, Homo sapiens
  Payload ID: 15677
  Gene Symbol: SHKBP1
  Gene Name: SH3KBP1 binding protein 1
  ENST ID: ENST00000595945
  CDS Start-End: 36-461
aagtgggtgcgggccagccggctcgcccgggggccatggcagcagcggctactgcagccgagggggtccccagtcgggggcctcccggggaagtcattcatctgaatgtgggaggcaagagattcagtacctctcgccagactctcacctggatcccagactccttcttctccagtcttctgagcggacgcatctcgacgctgaaagatgagaccggagcaatcttcatcgacagggaccctacagtcttcgcccccatcctcaacttcctgcgcaccaaagagttggatcccaggggtgtccacggttccagcctcctccatgaagcccagttctatgggctcactcctctggtcctcctgttgcagttcgtcgcctgcagcttcgagaggagttggatcgatcttcttgtggaaacgtcctcttcaatggttacctgccgccaccagtgttcccagtgaagcggcggaaccggcacagcctagtggggcctcagcagctaggaggacggccagcccctgtccgacggagcaacacgatgccccccaaccttggcaatgcagggctgctgggccgaatgctggatgagaaaacccctccctcaccctcaggacaacctgaggagccggggatggtgcgcctggtgtgtggacaccataattggatcgctgtggcctatacccagtttctagtctgctacaggttgaaggaagcctctggctggcagctggtgttttccagcccccgcctggactggcccatcgaacgactggcgctcacagcccgggtgcatggtggggctttgggtgaacatgacaagatg

SEQ ID NO: 181164 - DNA, 684 bp, Homo sapiens
  Payload ID: 15677
  Gene Symbol: SHKBP1
  Gene Name: SH3KBP1 binding protein 1
  ENST ID: ENST00000595726
  CDS Start-End: 1-494
ggcagatgggcatggcggctgcagtgctggcaatgacattggcccctacggtgagcgggacgaccagcaagtgttcatccagaaggtggtgcccagtgccagccagctcttcgtgcgtctctcatctactgggcagcgcaggtggcctgacggagcaagagctgatggaacagctggaacactgtgagctggccccgccggctccttcagctccctcatggggctgtctccccagcccctcaccccgcatctccctcaccagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccacccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaccccgggttcagggccagggcctccttggaataaatggttattgttactaggtccccaccttccctcttttctggaagccaaagtcaccctccccaataaagtcctcactgccaa

SEQ ID NO: 181165 - DNA, 773 bp, Homo sapiens
  Payload ID: 15677
  Gene Symbol: SHKBP1
  Gene Name: SH3KBP1 binding protein 1
  ENST ID: ENST00000595803
  CDS Start-End: 48-356
gtgcacacccggaagtgggtgcgggccagccggctcgcccgggggccatggcagcagcggctactgcagccgagggggtccccagtcgggggcctcccggggaagtcattcatctgaatgtgggaggcaagagattcagtacctctcgccagactctcacctggatcccagactccttcttctccagtcttctgagcggacgcatctcgacgctgaaagatgagaccggagcaatcttcatcgacagggaccctacagtcttcgcccccatcctcaacttcctgcgcaccaaagagttggatcccaggttggcatggaaaaaggggagggagtccctcactgtcttcagtccctgaggagttctttcacctcctctgaatgtccacgggtgtccacggttccagcctcctccatgaagcccagttctatgggctcactcctctggttcgtcgcctgcagcttcgagaggagttggatcgatcttcttgtggaaacgtcctcttcaatggttacctgccgccaccagtgttcccagtgaagcggcggaaccggcacagcctagtggggcctcagcagctaggaggacggccagcccctgtccgacggagcaacacgatgccccccaaccttggcaatgcagggctgctgggccgaatgctggatgagaaaacccctccctcaccctcaggacaacctgaggagccggggatggtgcgcctggtgtgtggacaccataattggatcgctgtggcctatacccagtttctagtctg

SEQ ID NO: 181166 - DNA, 897 bp, Homo sapiens
  Payload ID: 15677
  Gene Symbol: SHKBP1
  Gene Name: SH3KBP1 binding protein 1
  ENST ID: ENST00000602011
  CDS Start-End: 1-897
cggctccatttactacgtggatgtgcagaagttccccttgcgcatgaaagacaacgacctccttgtcagcgagctctatcgggacccagcggaggatggggtcaccgccctcagtgtctacctcacccccaagaccatctgtgccgacaacaaccacgtgcggacatggtctgtgactcgcttccgcggcatgatttccacccagcccggctccaccccactcgcttcctttaagatcctggctctggagtcggcagatgggcatggcggctgcagtgctggcaatgacattggcccctacggtgagcgggacgaccagcaagtgttcatccagaaggtggtgcccagtgccagccagctcttcgtgcgtctctcatctactgggcagcgggtgtgctccgtgcgctccgtggacggctcacccacgacagccttcacagtgctggagtgcgagggctcccggcggctcggctctcggccccggcgctacctgctcactggccaggccaacggcagcttggccatgtgggacctaaccaccgccatggacggcctcggccaggcccctgcaggtggcctgacggagcaagagctgatggaacagctggaacactgtgagctggccccgccggctccttcagctccctcatggggctgtctccccagcccctcaccccgcatctccctcaccagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccacccacaccagccccgtggccctccagcggtctcggcactcccctcacacctcccaa

SEQ ID NO: 181167 - DNA, 870 bp, Homo sapiens
  Payload ID: 15677
  Gene Symbol: SHKBP1
  Gene Name: SH3KBP1 binding protein 1
  ENST ID: ENST00000593764
  CDS Start-End: 1-789
aagttccccttgcgcatgaaagacaacgacctccttgtcagcgagctctatcgggacccagcggaggatggggtcaccgccctcagtgtctacctcacccccaagaccagtgacagtgggaactggatcgagatcgcctatggcaccagctcagggggcgtgcgggtcatcgtgcagcacccggagactgtgggctcggggcctcagctcttccagaccttcactgtgcaccgcagccctgtcaccaagatcatgctgtcggagaagcacctcatctcagtctgtgccgacaacaaccacgtgcggacatggtctgtgactcgcttccgcggcatgatttccacccagcccggctccaccccactcgcttcctttaagatcctggctctggagtcggcagatgggcatggcggctgcagtgctggcaatgacattggtggcctgacggagcaagagctgatggaacagctggaacactgtgagctggccccgccggctccttcagctccctcatggggctgtctccccagcccctcaccccgcatctccctcaccagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccacccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaccccgg

SEQ ID NO: 181168 - DNA, 716 bp, Homo sapiens
  Payload ID: 15677
  Gene Symbol: SHKBP1
  Gene Name: SH3KBP1 binding protein 1
  ENST ID: ENST00000594298
  CDS Start-End: 1-527
gtgacagtgggaactggatcgagatcgcctatggcaccagctcagggggcgtgcgggtcatcgtgcagcacccggagactgtgggctcggggcctcagctcttccagaccttcactgtgcaccgcagccctgtcaccaagatcatgctgtcggagaagcacctcatctcagcaggtggcctgacggagcaagagctgatggaacagctggaacactgtgagctggccccgccggctccttcagctccctcatggggctgtctccccagcccctcaccccgcatctccctcaccagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccacccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaccccgggttcagggccagggcctccttggaataaatggttattgttactaggtccccaccttccctcttttctggaagccaaagtcaccctccccaataaagtcctcactgcca

SEQ ID NO: 181169 - DNA, 1993 bp, Homo sapiens
  Payload ID: 15677
  Gene Symbol: SHKBP1
  Gene Name: SH3KBP1 binding protein 1
  ENST ID: ENST00000600718
  CDS Start-End: 1-1832
ctgcagccgagggggtccccagtcgggggcctcccggggaagtcattcatctgaatgtgggaggcaagagattcagtacctctcgccagactctcacctggatcccagactccttcttctccagtcttctgagcggacgcatctcgacgctgaaagatgagaccggagcaatcttcatcgacagggaccctacagtcttcgcccccatcctcaacttcctgcgcaccaaagagttggatcccaggggtgtccacggttccagcctcctccatgaagcccagttctatgggctcactcctctggttcgtcgcctgcagcttcgagaggagttggatcgatcttcttgtggaaacgtcctcttcaatggttacctgccgccaccagtgttcccagtgaagcggcggaaccggcacagcctagtggggcctcagcagctaggaggacggccagcccctgtccgacggagcaacacgatgccccccaaccttggcaatgcagggctgctgggccgaatgctggatgagaaaacccctccctcaccctcaggacaacctgaggagccggggatggtgcgcctggtgtgtggacaccataattggatcgctgtggcctatacccagtttctagtctgctacaggttgaaggaagcctctggctggcagctggtgttttccagcccccgcctggactggcccatcgaacgactggcgctcacagcccgggtgcatggtggggctttgggtgaacatgacaagatggtggcagcagccaccggcagcgagatcctgctatgggctctgcaggcggaaggcggtggctccgagataggggtctttcatctgggggtgcctgtggaggccttgttcttcgtcgggaaccagctcattgctacaagccacacagggcgcatcggggtgtggaatgccgtcaccaagcactggcaggtccaggaggtgcagcccatcaccagttatgacgcggcaggctccttcctcctcctgggctgcaacaacggctccatttactacgtggatgtgcagaagttccccttgcgcatgaaagacaacgacctccttgtcagcgagctctatcgggacccagcggaggatggggtcaccgccctcagtgtctacctcacccccaagaccagtgacagtgggaactggatcgagatcgcctatggcaccagctcagggggcgtgcgggtcatcgtgcagcacccggagactgtgggctcggggcctcagctcttccagaccttcactgtgcaccgcagccctgtcaccaagatcatgctgtcggagaagcacctcatctcagtctgtgccgacaacaaccacgtgcggacatggtctgtgactcgcttccgcggcatgatttccacccagcccggctccaccccactcgcttcctttaagatcctggctctggagtcggcagatgggcatggcggctgcagtgctggcaatgacattgcaggtggcctgacggagcaagagctgatggaacagctggaacactgtgagctggccccgccggctccttcagctccctcatggggctgtctccccagcccctcaccccgcatctccctcaccagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccacccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaccccgggttcagggccagggcctccttggaataaatggttattgttactaggtccccaccttccctcttttctggaagccaaagtc

SEQ ID NO: 181170 - DNA, 1019 bp, Homo sapiens
  Payload ID: 15677
  Gene Symbol: SHKBP1
  Gene Name: SH3KBP1 binding protein 1
  ENST ID: ENST00000597396
  CDS Start-End: 1-834
cgcagccctgtcaccaagatcatgctgtcggagaagcacctcatctcagtctgtgccgacaacaaccacgtgcggacatggtctgtgactcgcttccgcggcatgatttccacccagcccggctccaccccactcgcttcctttaagatcctggctctggagtcggcagatgggcatggcggctgcagtgctggcaatgacattggcccctacggtgagcgggacgaccagcaagtgttcatccagaaggtggtgcccagtgccagccagctcttcgtgcgtctctcatctactgggcagcgggtgtgctccgtgcgctccgtggacggctcacccacgacagccttcacagtgctggagtgcgagggctcccggcggctcggctctcggccccggcgctacctgctcactggccaggccaacggcagcttggccatgtgggacctaaccaccgccatggacggcctcggccaggcccctggtggcctgacggagcaagagctgatggaacagctggaacactgtgagctggccccgccggctccttcagctccctcatggggctgtctccccagcccctcaccccgcatctccctcaccagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccacccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaccccgggttcagggccagggcctccttggaataaatggttattgttactaggtccccaccttccctcttttctggaagccaaagtcaccctccccaataaagtcctcact

SEQ ID NO: 181171 - DNA, 623 bp, Homo sapiens
  Payload ID: 15677
  Gene Symbol: SHKBP1
  Gene Name: SH3KBP1 binding protein 1
  ENST ID: ENST00000594862
  CDS Start-End: 1-431
cgaccagcaagtgttcatccagaaggtggtgcccagtgccagccagctcttcgtgcgtctctcatctactgggcagcggtggcctgacggagcaagagctgatggaacagctggaacactgtgagctggccccgccggctccttcagctccctcatggggctgtctccccagcccctcaccccgcatctccctcaccagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccacccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaccccgggttcagggccagggcctccttggaataaatggttattgttactaggtccccaccttccctcttttctggaagccaaagtcaccctccccaataaagtcctcactgccaaca

SEQ ID NO: 181172 - DNA, 785 bp, Homo sapiens
  Payload ID: 15677
  Gene Symbol: SHKBP1
  Gene Name: SH3KBP1 binding protein 1
  ENST ID: ENST00000596163
  CDS Start-End: 1-389
tgggctcggggcctcagctcttccagaccttcactgtgcaccgcagccctgtcaccaagatcatgctgtcggagaagcacctcatctcagtctgtgccgacaacaaccacgtgcggacatggtctgtgactcgcttccgcggcatgatttccacccagcccggctccaccccactcgcttcctttaagatcctggctctggagtcggcagatgggcatggcggctgcagtgctggcaatgacattggcccctacggtgagcgggacgaccagcaagtgttcatccagaaggtggtgcccagtgccagccagctcttcgtgcgtctctcatctactgggcagcggtggcctgacggagcaagagctgatggaacagctggaacactgtgagctggccccgccggctccttcagctccctcatggggctgtctccccagcccctcaccccgcatctccctcaccagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccacccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaccccgggttcaggg

SEQ ID NO: 181173 - DNA, 2284 bp, Homo sapiens
  Payload ID: 15677
  Gene Symbol: SHKBP1
  Gene Name: SH3KBP1 binding protein 1
  ENST ID: ENST00000600733
  CDS Start-End: 46-2094
gcacacccggaagtgggtgcgggccagccggctcgcccgggggccatggcagcagcggctactgcagccgagggggtccccagtcgggggcctcccggggaagtcattcatctgaatgtgggaggcaagagattcagtacctctcgccagactctcacctggatcccagactccttcttctccagtcttctgagcggacgcatctcgacgctgaaagatgagaccggagcaatcttcatcgacagggaccctacagtcttcgcccccatcctcaacttcctgcgcaccaaagagttggatcccaggggtgtccacggttccagcctcctccatgaagcccagttctatgggctcactcctctggttcgtcgcctgcagcttcgagaggagttggatcgatcttcttgtggaaacgtcctcttcaatggttacctgccgccaccagtgttcccagtgaagcggcggaaccggcacagcctagtggggcctcagcagctaggaggacggccagcccctgtccgacggagcaacacgatgccccccaaccttggcaatgcagggctgctgggccgaatgctggatgagaaaacccctccctcaccctcaggacaacctgaggagccggggatggtgcgcctggtgtgtggacaccataattggatcgctgtggcctatacccagtttctagtctgctacaggttgaaggaagcctctggctggcagctggtgttttccagcccccgcctggactggcccatcgaacgactggcgctcacagcccgggtgcatggtggggctttgggtgaacatgacaagatggtggcagcagccaccggcagcgagatcctgctatgggctctgcaggcggaaggcggtggctccgagatagggcgcatcggggtgtggaatgccgtcaccaagcactggcaggtccaggaggtgcagcccatcaccagttatgacgcggcaggctccttcctcctcctgggctgcaacaacggctccatttactacgtggatgtgcagaagttccccttgcgcatgaaagacaacgacctccttgtcagcgagctctatcgggacccagcggaggatggggtcaccgccctcagtgtctacctcacccccaagaccagtgacagtgggaactggatcgagatcgcctatggcaccagctcagggggcgtgcgggtcatcgtgcagcacccggagactgtgggctcggggcctcagctcttccagaccttcactgtgcaccgcagccctgtcaccaagatcatgctgtcggagaagcacctcatctcagtctgtgccgacaacaaccacgtgcggacatggtctgtgactcgcttccgcggcatgatttccacccagcccggctccaccccactcgcttcctttaagatcctggctctggagtcggcagatgggcatggcggctgcagtgctggcaatgacattggcccctacggtgagcgggacgaccagcaagtgttcatccagaaggtggtgcccagtgccagccagctcttcgtgcgtctctcatctactgggcagcgggtgtgctccgtgcgctccgtggacggctcacccacgacagccttcacagtgctggagtgcgagggctcccggcggctcggctctcggccccggcgctacctgctcactggccaggccaacggcagcttggccatgtgggacctaaccaccgccatggacggcctcggccaggcccctgcaggtggcctgacggagcaagagctgatggaacagctggaacactgtgagctggccccgccggctccttcagctccctcatggggctgtctccccagcccctcaccccgcatctccctcaccagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccacccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaccccgggttcagggccagggcctccttggaataaatggttattgttactaggtccccaccttccctcttttctggaagccaaagtcaccctccccaataaagtcctcactgccaa

SEQ ID NO: 181174 - DNA, 810 bp, Homo sapiens
  Payload ID: 15677
  Gene Symbol: SHKBP1
  Gene Name: SH3KBP1 binding protein 1
  ENST ID: ENST00000599575
  CDS Start-End: 34-300
gtgggtgcgggccagccggctcgcccgggggccatggcagcagcggctactgcagccgagggggtccccagtcgggggcctcccggggaagtcattcatctgaatgtgggaggcaagagattcagtacctctcgccagactctcacctggatcccagactccttcttctccagtcttctgagcggacgcatctcgacgctgaaagatgagaccggagcaatcttcatcgacagggaccctacagtcttcgcccccatcctcaacttcctgcgcaccaaagagttggatcccagaccctgacctctagtcaattctactacccaggggtgtccacggttccagcctcctccatgaagcccagttctatgggctcactcctctggttcgtcgcctgcagcttcgagaggagttggatcgatcttcttgtggaaacgtcctcttcaatggttacctgccgccaccagtgttcccagtgaagcggcggaaccggcacagcctagtggggcctcagcagctaggaggacggccagcccctgtccgacggagcaacacgatgccccccaaccttggcaatgcagggctgctgggccgaatgctggatgagaaaacccctccctcaccctcaggacaacctgaggagccggggatggtgcgcctggtgtgtggacaccataattggatcgctgtggcctatacccagtttctagtctgctacaggttgaaggaagcctctggctggcagctggtgttttccagcccccgcctggactggcccatcgaacgactggcgctcacagcccgggtgcatgg

SEQ ID NO: 181175 - DNA, 3128 bp, Homo sapiens
  Payload ID: 15678
  Gene Symbol: SPRN
  Gene Name: shadow of prion protein homolog (zebrafish)
  Uniprot ID: Q5BIV9
  ENST ID: ENST00000414069
  CDS Start-End: 113-568
ggctgagggtccgcgccgccgcccgcccgctccttcccgctcggccgcggcctcagggacggatactccagcgcgcggttccaaccgaggcccgtggtttagccccacgaagatgaactgggcacccgcaacgtgctgggctctgctactggcggccgccttcctctgcgacagcggcgcagccaagggcggccgcggaggtgcgcggggcagtgcccggggaggggtccgcgggggtgcgcgcggggcctcgagggtgcgcgtgaggccggcgcagcgctacggtgccccgggctcctccctgcgcgtggctgccgccggggcggcagccggggcggcggcgggagcggccgcgggcctggcggcgggctcgggctggagaagggccgcgggacccggggaacgcggcctggaggacgaggaggacggggtgcccggaggcaacgggacaggccccggcatctacagctaccgggcgtggacttcgggcgctggacccacgcgcggcccgcgtctctgtctcgtgctgggcggcgccctcggagccctggggctgctgcggccctaggcctggctgggctcggggaccacatctggcccccggcccgcgccatcccccaggatcctccggcctgggctcccccttcctcccttgcccacggtcttggagccccactgggtgcaggagctgctggctgtccctgtggacccgccatccaccgtcctgcccacgccgcctcagcctgccacctcccacctagaggagaccatgggccctgccccacccactccaggatgttagggtcccctcagccaaaaaggcagctgcctgtggctcctgtaccaaccgcccagccacgctccatcgccgcccaaagggaggtgccaaggccaggaacccaagccaccccggctcccctcgcctgcccaggggccgtggtgactcacgggcagggaggcgacatcaggctggttctgccactgagcccctgaggaatctgaccctccccaaaagaagcagtgaaatggaccaaaggacttaagaatttggggggaagtgagggaaaaacgttaggtgctaaccacctgcccagaagagtggatctcacagcccaggaacattcccaagcaggaaaaccgtccgtccgaggaacgtccatcctggctctctgcggctggtgggaaaacacaccctgccctgaggggctgtccaggccttctcccccacaccctcaggccgagatccgtgagagacccactttgctccaacaacttgaaacaagtcactttaccctccttaggacccattttgggggggaaaaaccaacacattccagagctttccaagtcctttgaacttcaggttcacattcagggatcacacagttctgcctgttctcagggcacagcaactgccaatcccgctgaagaggcctccctgggcacagcacaggctgcacggtgcacgcatttccctgaaggcagccccttcttcggaagcagctgttccaggcctcggaacagggcctgggtatccgcgtggtgggctggcagctgacggcctgctcagtggagccaggagctaactcagaccccaaagcaagcagggggccagtggcggggcccagcgcccagcaggacacccatgcaagaggctgagccccccaacatccaaggacaggagagacatggagtggcgctggacagtcacgacaaggacttgcctccagcactggacacacctgtgttaagaccagccctctgcttcccagtcccgccagcctggggcatcctccatgggctcagcactgagaggtcttgggtctgccacgttctctagctctccagtcacccactcatccagggtaggaggggttctccctgccccccgccgtggccttgggatctcaccctctccatgtcctggggacagcctcgccctcagccggactgcatccctcctgggcctgagcctcgggactcagtggacaccaaagtcaagaccagcacccaccacgggccctgccagcctctgccttccccagctggcctgggttctggcctgggtgaggatctggaagctgttggcaggactcaaccaagcactgctctctagctccagggcactaagccacaggaggcagcgccctgcagcctcccgtccacactgccagcaatgcccctggcccagtgagcccagacgctcctccaccccttccagaccaagctcaacgcctccaagaccagcaggccaaggccaagccctgccccagatcctcataggcagagaagcccttctgacatttcccccaggaggcagggggtggtctgagtctcctcacagcagagagacccaccggagccccctcaactttgcagatgcccacctggaaaatgggctgagctgcaccagaccctcacacaccacagcactgcaagctgatggaatgttccagttatgatggacacttcgtgatctgcaatgactgttgattcagcacattagcatctgacacagccaacctgaatacttcctgccccaggcggtcagggttatggcacgatgcaggtggcactcaggggctaacttcaggctgatgagtgtgtggggtatggggcagcagaggcagccagccagcaaagaggggccactgagcaccagggccctggtggaggctgctgtgggacggtcaggccaccaccgcaaagaggcagccggagcttctgcacaggatgtccctggccccaggtcctgcagcaccttagtccatactaccagccccacccaccttccttcctcttccctcttctaggacacaggctgtggaccccttcaggtgcactataatggggctggaggggcccccacatctctcagccccactaatgcagaatcccactacccgtgagctagaaggtgctcagaggccaggggtctctactgcccatgccgggcggccttccagtcattgcacagcaaagccatgtgcagggcgtccccctcaaccctgccctgaacatgccccagggcactgaggggcgaagccagtgcttgggctctgctgctgggagtctctggtctgtgtctgtgtgtgcctgtaagtgtgaaataaacctctctgatggca

SEQ ID NO: 181176 - DNA, 1687 bp, Homo sapiens
  Payload ID: 15679
  Gene Symbol: SHARPIN
  Gene Name: SHANK-associated RH domain interactor
  Uniprot ID: Q9H0F6
  ENST ID: ENST00000359551
  CDS Start-End: 485-1465
gtgtgggcgtggcgggggctggggtctgcgggcgaaggtggcagcccattggaggtcccgggagcgaagtccagctgccgttaggcgctgggatagtcgcacgctggatgcatctacgtccgccgagcccctggggcgaagaggccgcgtccgccttcagttgtggccggtgcttcgccccctgacccttcgcccccaaagaccagctctaacgtgagcgcctcggccgccctgccccagcctcgtacacgccgccagcctcgcccagccggtgtccggagaccctcgggccgtgtccatttgtgggcaaagccagcggggcaggcttggccagagtgcaccactcggcgccgtcccaggcccgacgctctgggcgcgcccggaaccccaggttcgcggcccgtgtttccgaccggcggagggggctcagcggcccgatcccacggaagcgcgctcggaggggtgggacccggccggaccggagatggcgccgccagcgggcggggcggcggcggcggcctcggacttgggctccgccgcagtgctcttggctgtgcacgccgcggtgaggccgctgggcgccgggccagacgccgaggcacagctgcggaggctgcagctgagcgcggaccctgagcggcctgggcgcttccggctggagctgctgggcgcgggacctggggcggttaatttggagtggcccctggagtcagtttcctacaccatccgaggccccacccagcacgagctacagcctccaccaggagggcctggaaccctcagcctgcacttcctcaaccctcaggaagctcagcggtgggcagtcctagtccgaggtgccaccgtggaaggacagaatggcagcaagagcaactcaccaccagccttgggcccagaagcatgccctgtctccctgcccagtcccccggaagcctccacactcaagggccctccacctgaggcagatcttcctaggagccctggaaacttgacggagagagaagagctggcagggagcctggcccgggctattgcaggtggagacgagaagggggcagcccaagtggcagccgtcctggcccagcatcgtgtggccctgagtgttcagcttcaggaggcctgcttcccacctggccccatcaggctgcaggtcacacttgaagacgctgcctctgccgcatccgccgcgtcctctgcacacgttgccctgcaggtccacccccactgcactgttgcagctctccaggagcaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgagaagccccagcccagctggtcctgtccttcctgcaccttcatcaatgccccagaccgccctggctgtgagatgtgtagcacccagaggccctgcacttgggacccccttgctgcagcttccacctagcagccaccagaggttacaaggggagagtggcccttccctcacaagtccgacatctccaggcccccactgaactccggggacctctactgactgcttgctgggacagtcaccagggttggggggaagggccacaaaatgaaaccattaaagacccttaagagcca

SEQ ID NO: 181177 - DNA, 1765 bp, Homo sapiens
  Payload ID: 15679
  Gene Symbol: SHARPIN
  Gene Name: SHANK-associated RH domain interactor
  Uniprot ID: Q9H0F6
  ENST ID: ENST00000398712
  CDS Start-End: 438-1601
attggaggtcccgggagcgaagtccagctgccgttaggcgctgggatagtcgcacgctggatgcatctacgtccgccgagcccctggggcgaagaggccgcgtccgccttcagttgtggccggtgcttcgccccctgacccttcgcccccaaagaccagctctaacgtgagcgcctcggccgccctgccccagcctcgtacacgccgccagcctcgcccagccggtgtccggagaccctcgggccgtgtccatttgtgggcaaagccagcggggcaggcttggccagagtgcaccactcggcgccgtcccaggcccgacgctctgggcgcgcccggaaccccaggttcgcggcccgtgtttccgaccggcggagggggctcagcggcccgatcccacggaagcgcgctcggaggggtgggacccggccggaccggagatggcgccgccagcgggcggggcggcggcggcggcctcggacttgggctccgccgcagtgctcttggctgtgcacgccgcggtgaggccgctgggcgccgggccagacgccgaggcacagctgcggaggctgcagctgagcgcggaccctgagcggcctgggcgcttccggctggagctgctgggcgcgggacctggggcggttaatttggagtggcccctggagtcagtttcctacaccatccgaggccccacccagcacgagctacagcctccaccaggagggcctggaaccctcagcctgcacttcctcaaccctcaggaagctcagcggtgggcagtcctagtccgaggtgccaccgtggaaggacagaatggcagcaagagcaactcaccaccagccttgggcccagaagcatgccctgtctccctgcccagtcccccggaagcctccacactcaagggccctccacctgaggcagatcttcctaggagccctggaaacttgacggagagagaagagctggcagggagcctggcccgggctattgcaggtggagacgagaagggggcagcccaagtggcagccgtcctggcccagcatcgtgtggccctgagtgttcagcttcaggaggcctgcttcccacctggccccatcaggctgcaggtcacacttgaagacgctgcctctgccgcatccgccgcgtcctctgcacacgttgccctgcaggtccacccccactgcactgttgcagctctccaggagcaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgagaagccccagccacaggacctagccctcagcacccccagaagatggacggggaacttggacgcttgtttcccccatcattggggctacccccaggcccccagccagctgcctccagcctgcccagtccactccagcccagctggtcctgtccttcctgcaccttcatcaatgccccagaccgccctggctgtgagatgtgtagcacccagaggccctgcacttgggacccccttgctgcagcttccacctagcagccaccagaggttacaaggggagagtggcccttccctcacaagtccgacatctccaggcccccactgaactccggggacctctactgactgcttgctgggacagtcaccagggttggggggaagggccacaaaatgaaaccattaaagacccttaagagcca

SEQ ID NO: 181178 - DNA, 533 bp, Homo sapiens
  Payload ID: 15679
  Gene Symbol: SHARPIN
  Gene Name: SHANK-associated RH domain interactor
  ENST ID: ENST00000532536
  CDS Start-End: 1-288
gaccctgctttcctctacttgctgtcagctcctcgagaagccccagccacaggacctagccctcagcacccccagaagatggacggggaacttggacgcttgtttcccccatcattggggctacccccaggcccccagccagctgcctccagcctgcccagtccactccagcccagctggtcctgtccttcctgcaccttcatcaatgccccagaccgccctggctgtgagatgtgtagcacccagaggccctgcacttgggacccccttgctgcagcttccacctagcagccaccagaggtaccagaggtggcacaggcaggggaggtggggggcagggcagaatccacaggaatgacccagctcctcccccacaggttacaaggggagagtggcccttccctcacaagtccgacatctccaggcccccactgaactccggggacctctactgactgcttgctgggacagtcaccagggttggggggaagggccacaaaatgaaaccattaaagacccttaagagccagcaa

SEQ ID NO: 181179 - DNA, 4558 bp, Homo sapiens
  Payload ID: 15680
  Gene Symbol: SHC4
  Gene Name: SHC (Src homology 2 domain containing) family, member 4
  Uniprot ID: Q6S5L8
  ENST ID: ENST00000332408
  CDS Start-End: 430-2322
agaacagaaggctggggtgagggtgggagtcgggtgctaaatatttctactaggctcctgcaaggctagtgatgcagcgggccccccgaccggcgctcgcccgggttctgcgcctaagagttggccgtgagcgacccgcgccgccgggagcctgggtctaggctctcccgacaaggattccaaggcgagaacactggtgcctctgcctgggccagggagagactgaaatcagagcaggggaggcgtttcccccatgggctgtcacccttaaggggccgggagccgaggtgggcgagctcgagagcagagttggagaggtggctgctgtgagttgcatcgggcgttgaggtatctgatgtctgcaccgtttatctaccagacgacgaggcgatttatgcaacagtatcctgtttcagcactgccaaggctatgcgagaacgcggccaggacagcctggcaggactcgtgctgtatgtaggactcttcgggcaccccgggatgctgcacagggccaagtacagccgctttcggaacgagtcgatcacgtccttggacgaaggtagctccggaggctcggtcgggaacaagggctcgccgcagcctccccaccccgccctggcacctcacctgccgactgaagatgccaccttgccgtcgcaggagagccccaccccactgtgcaccttgatcccccgcatggcaagcatgaagctggccaacccggccactttgctgagtctgaaaaacttttgcctgggtaccaaagaggtgcctcggctgaagctccaggaaagccgggacccaggttccagcggcccctcttccccagaaaccagtttaagtaggtccgggactgcacctccaccgcagcaggacctggtgggacacagggcaaccgccctaacccctgattcgtgcccgcttcctggccctggggagccaacacttaggagcaggcaggacaggcactttctacagcacctgttggggatgggcatgaactactgtgtgaggtacatgggctgtgttgaagtgctgcaatcaatgagatcactggattttggaatgagaacccaagttacaagggaagcaataagtcgcctgtgtgaagctgtccccggggcaaatggagccattaaaaagcgaaagcctccagttaagttcctatcaacagtccttggcaaaagtaatcttcagttttcaggaatgaatataaaactgaccatctcaacatgcagtctcacattgatgaatcttgacaaccaacagattattgcaaatcatcatatgcagtctatttcatttgcctctggaggggatcctgatactacagactatgttgcctacgtagctaaagatccagttaatcaacgagcctgtcacatattggaatgccacaatggaatggcccaagacgtcataagtaccatagggcaggcttttgaactccggtttaaacagtacttgaaaaatccttctttgaatacttcttgtgaaagtgaggaggtgcatattgatagccatgccgaggagagagaagatcatgaatattacaatgaaattccagggaagcagccaccagtaggtggtgtttcagatatgcggatcaaagttcaagccacggaacaaatggcttactgccccatacagtgtgaaaagttgtgctatttgcctggaaactccaagtgcagcagtgtatatgagaactgtttagaacaaagcagggcaataggtaatgtccatccaagaggggtgcagtcccagcgagatacctcattattgaagcacacgtgccgagtggatctctttgatgacccctgctacattaatacacaggctcttcaaagtacacctggctctgctggaaatcaaaggtcagcccaaccactggggagcccatggcactgcggaaaggcaccagaaactgttcagccgggtgccacagcccagcctgccagctcacattctttgccacacattaagcagcagctgtggagcgaagaatgctatcatggcaagctgagcaggaaggcggcagagagcctcttggtaaaggatggggactttttggttcgagagagtgcaacatcccctggccaatatgtgctgagtggactacagggaggccaagcaaaacatcttctcctggtggatcctgaaggcaaggtgaggaccaaggatcatgtatttgataatgtcggccaccttatcagataccatatggataacagtttgccaatcatctcctctggaagcgaagtaagccttaaacaaccagtgagaaaagataataatccagcacttttgcattccaacaaatgacagtattgaagcaccatcacactgatatttcaagaaaccccattttgtattaggacacaaagataatttaaactttgtttgtagataaaatagagcacaaactgtgaagtgcatctttccaagaccatcatggaccaggtcctctataaaatgaagaactaacaaaaattagtcttcagaaatgaaaatcagaaaagaggaagagggttggtcattttaaaagaaattatatgtatgcacggatgtcactttttaaggccatattgcattgataacaagctaaaagcacaactaaaatttcacatgctaacgacaacttgaatgaactgctggggcagtggtatgtgcctttcaacttgataatttgggggacattttcatattgggagattaattctaagtatcttcatgttctatgactatagaaccatttgccaaaaaaaaaagcttttcttgctacaaaaaataagcaattttcttgagccttattgactttattacattttctgtttagcagcatttttcactgcaatgttaaaataaatatgacattgaattcgaactgtgtgtatgtcagtggaatcaaatcaaaagccactaacatggctgtctgtttcattggactgtcccatttgctggttaaaaggattggggcccaaatcctctggcctagcatttctcagtgtttgctattcagactgtctaaatacagcatgtgacaagctgaagaagccaaatctatcagtcatttctgatttcattatattctccccctcttcctgctaaaaagacaaaaaacaaaaaacaaaaaaaacaaaaaaaacctcatgagtgcatggatttaaaagagggcaaacaaaaccagtattcttcatatttactattcaaattggtttcattcttagtaaaagtacagaatctatttgaaattatagtaaaatttcttcttgattggctgacactgaatcatagtttctcacctacatatatccttagcacctcgtatagatatgatcagacaaaatgcagaaggaaaaaaaaacatattgaatgaagcacttggaaagattttccacatgtagaccaactggtaaactaacagagtgattaagcatggtgtacagaaaagcattacgctgagtcttaccagtgtgaccttcagcaagttgctgaatctgtttgggttccagtttccttggcaataaaatgagctaaatgggctaggtgaatttggaggactacttcagtcctaacttatagtatgagtctctaaaaagcaagtttttcatttgttagaggtcgttattgataaccagtctgtatagttaaggtaaaaaattaagcttttcttctatagtctgtgtccatactcacagaatgaatggcacacctgagatcaacattcacatagtttagactccaaaccattcagtctaaaatactgaaactttggaatatagggaatgatgataaaagtggatttggtttgagtagcagaaaactacttatgtccttttcttgcctttccaagaaaaatgttttttgtttttttttttaatcttgagttatctggatattgccttgactccatttcattttggctatgtagatacaacttagtctttgtgattgtgatatatttgctaagttttaaataaaacttcttttggatagaaatcattagaaaccaagcatactgcactctaatattttactgtaaaggcttatgatttttatttctactgccattaattttttagatggatttgtttcctcttacacaactagaattaatgtatttttcaccagttttccatataccttaggtcttgatcgtttgtccttaaaaaggggatcagcatgagtatagacagtagaaatgtatgggtagtctaaccacttttatcagagacagagcagggctgtggtctcactctagctgagcagagtattaacttggtagcaagagttcctgatacaaatagatgcaatgactgtaaatggtgtcagcagtacacatggataatcagtatttgactgtaatagtatagtagttaaatacagcacttaaaaataccacagacacagttaaagcaaaaggaaacaataaaaggaatgtctgcatgctattttaatctcacattctttatctgtcttaaagtggaaatccatttgcctataaatacctgtaaacgactttaaaaaataaatgattattgctttgtgacaattgaca

SEQ ID NO: 181180 - DNA, 2799 bp, Homo sapiens
  Payload ID: 15680
  Gene Symbol: SHC4
  Gene Name: SHC (Src homology 2 domain containing) family, member 4
  Uniprot ID: Q6S5L8
  ENST ID: ENST00000396535
  CDS Start-End: 832-1995
tttttaaaaacatgttttacctgtttttaccttcaacttaaaagcctcaggttttaagttgtatatacttatatgaattatatgactgtgtatacttacaggattcaagcacatttcatttattctgcactttatttctattattattacattatagttatgtagaattatacaactcaccataatgtagaatcaatgggagccctgagcttgttttcctgcaactagatggtcccatctgggggtgatgagacacagtgacacccgaggtgtgttccttatgtccggtctattctgtaatctcattttggttgctgttactgtggaaaatcctgcctcacaaagataggatgttgaaaatggaaggaggcttttcagtacttttgtggcaatctcaggatgttccgccttgactttaatcgagaacgtatggagatttgaagttgtctcaaacatacttttaaggccaccgtcatttgcaatatcaagcagttgatcctcttctagcgtggacaaagtggattcacctggcttattcacaaatgggtcacagatccattccgtcttttgtggatgagaagtgtgatggttaatactgagtgtcaacttgattggattgaaggatacaagtattgatcattggtgtgtctgtgagggtgttgccaaaggagattaacatttgagtcagtgggctgcgaaaggcagacccacccttaatctggttgggcacaatctaatcagctgccagcttggctagaatataagcaggcagaaaaatgtgaaaagagagactggcctagcctcccagcctaaatctttctcctgtgttggatgcttcctgccctcgaacattggattcccaagttcttcagtttcagaactcggactggctctcctctctccttagcctgcagacagcctattgtaggaccttgtgatcatattattgcaaatcatcatatgcagtctatttcatttgcctctggaggggatcctgatactacagactatgttgcctacgtagctaaagatccagttaatcaacgagcctgtcacatattggaatgccacaatggaatggcccaagacgtcataagtaccatagggcaggcttttgaactccggtttaaacagtacttgaaaaatccttctttgaatacttcttgtgaaagtgaggaggtgcatattgatagccatgccgaggagagagaagatcatgaatattacaatgaaattccagggaagcagccaccagtaggtggtgtttcagatatgcggatcaaagttcaagccacggaacaaatggcttactgccccatacagtgtgaaaagttgtgctatttgcctggaaactccaagtgcagcagtgtatatgagaactgtttagaacaaagcagggcaataggtaatgtccatccaagaggggtgcagtcccagcgagatacctcattattgaagcacacgtgccgagtggatctctttgatgacccctgctacattaatacacaggctcttcaaagtacacctggctctgctggaaatcaaaggtcagcccaaccactggggagcccatggcactgcggaaaggcaccagaaactgttcagccgggtgccacagcccagcctgccagctcacattctttgccacacattaagcagcagctgtggagcgaagaatgctatcatggcaagctgagcaggaaggcggcagagagcctcttggtaaaggatggggactttttggttcgagagagtgcaacatcccctggccaatatgtgctgagtggactacagggaggccaagcaaaacatcttctcctggtggatcctgaaggcaaggtgaggaccaaggatcatgtatttgataatgtcggccaccttatcagataccatatggataacagtttgccaatcatctcctctggaagcgaagtaagccttaaacaaccagtgagaaaagataataatccagcacttttgcattccaacaaatgacagtattgaagcaccatcacactgatatttcaagaaaccccattttgtattaggacacaaagataatttaaactttgtttgtagataaaatagagcacaaactgtgaagtgcatctttccaagaccatcatggaccaggtcctctataaaatgaagaactaacaaaaattagtcttcagaaatgaaaatcagaaaagaggaagagggttggtcattttaaaagaaattatatgtatgcacggatgtcactttttaaggccatattgcattgataacaagctaaaagcacaactaaaatttcacatgctaacgacaacttgaatgaactgctggggcagtggtatgtgcctttcaacttgataatttgggggacattttcatattgggagattaattctaagtatcttcatgttctatgactatagaaccatttgccaaaaaaaaaagcttttcttgctacaaaaaataagcaattttcttgagccttattgactttattacattttctgtttagcagcatttttcactgcaatgttaaaataaatatgacattgaattcgaactgtgtgtatgtcagtggaatcaaatcaaaagccactaacatggctgtctgtttcattggactgtcccatttgctggttaaaaggattggggcccaaatcctctggcctagcatttctcagtgtttgctattcagactgtctaaatacagcatgtgacaagctgaagaagccaaatctatcagtcatttctgatttcattatattctccccctcttcctgctaaaaagacaaaaaacaaaaa

SEQ ID NO: 181181 - DNA, 1447 bp, Homo sapiens
  Payload ID: 15680
  Gene Symbol: SHC4
  Gene Name: SHC (Src homology 2 domain containing) family, member 4
  ENST ID: ENST00000537958
  CDS Start-End: 221-1255
aggtaccgcctcctacttggcgcgccactgtggttggagtagctcagtgttttctccggggtgttggcgtcgccttttgagctacgtttccatcgattcgaacttcgtatctagggaccctgcatgcaagagcttatagtgaagaaatacttggtcccatttcttttcgcctgggaggtatctttccactattagcaatgcgattattgcaaatcatcatatgcagtctatttcatttgcctctggaggggatcctgatactacagactatgttgcctacgtagctaaagatccagttaatcaacgagcctgtcacatattggaatgccacaatggaatggcccaagacgtcataagtaccatagggcaggcttttgaactccggtttaaacagtacttgaaaaatccttctttgaatacttcttgtgaaagtgaggaggtgcatattgatagccatgccgaggagagagaagatcatgaatattacaatgaaattccagggaagcagccaccagtaggtggtgtttcagatatgcggatcaaagttcaagccacggaacaaatggcttactgccccatacagtgtgaaaagttgtgctatttgcctggaaactccaagtgcagcagtgtatatgagaactgtttagaacaaagcagggcaataggtaatgtccatccaagaggggtgcagtcccagcgagatacctcattattgaagcacacgtgccgagtggatctctttgatgacccctgctacattaatacacaggctcttcaaagtacacctggctctgctggaaatcaaaggtcagcccaaccactggggagcccatggcactgcggaaaggcaccagaaactgttcagccgggtgccacagcccagcctgccagctcacattctttgccacacattaagcagcagctgtggagcgaagaatgctatcatggcaagctgagcaggaaggcggcagagagcctcttggtaaaggatggggactttttggttcgagagagtgcaacatcccctggccaatatgtgctgagtggactacagggaggccaagcaaaacatcttctcctggtggatcctgaaggcaaggtgaggaccaaggatcatgtatttgataatgtcggccaccttatcagataccatatggataacagtttgccaatcatctcctctggaagcgaagtaagccttaaacaaccagtgagaaaagataataatccagcacttttgcattccaacaaatgacagtattgaagcaccatcacactgatatttcaagaaaccccattttgtattaggacacaaagataatttaaactttgtttgtagataaaatagagcacaaactgtgaagtgcatctttccaagaccatcatggaccaggtcctctataaaatgaagaactaacaaaaattagtcttcagaaatgaaaatcag

SEQ ID NO: 181182 - DNA, 821 bp, Homo sapiens
  Payload ID: 15680
  Gene Symbol: SHC4
  Gene Name: SHC (Src homology 2 domain containing) family, member 4
  ENST ID: ENST00000557797
  CDS Start-End: 81-515
gaagaaatacttggtcccatttcttttcgcctgggaggtatctttccactattagcaatgcgattattgcaaatcatcatatgcagtctatttcatttgcctctggaggggatcctgatactacagactatgttgcctacgtagctaaagatccagttaatcaacgagcctgtcacatattggaatgccacaatggaatggcccaagacgtcataagtaccatagggcaggcttttgaactccggtttaaacagtacttgaaaaatccttctttgaatacttcttgtgaaagtgaggaggtgcatattgatagccatgccgaggagagagaagatcatgaatattacaatgaaattccagggaagcagccaccagtaggtggtgtttcagatatgcggatcaaagttcaagccacggaacaaatggcttactgccccatacagtgtgaaaagttgtgctatttggtaatgtccatccaagaggggtgcagtcccagcgagatacctcattattgaagcacacgtgccgagtggatctctttgatgacccctgctacattaatacacaggctcttcaaagtacacctggctctgctggaaatcaaaggtcagcccaaccactggggagcccatggcactgcggaaaggcaccagaaactgttcagccgggtgccacagcccagcctgccagctcacattctttgccacacattaagcagcagctgtggagcgaagaatgctatcatggcaagctgagcaggaaggcggcagagagcctcttggtaaaggatggggactttttggttcgagagagtgcaacat

SEQ ID NO: 181183 - DNA, 885 bp, Homo sapiens
  Payload ID: 15680
  Gene Symbol: SHC4
  Gene Name: SHC (Src homology 2 domain containing) family, member 4
  ENST ID: ENST00000558220
  CDS Start-End: 502-885
accgcctcctacttggcgcgccactgtggttggagtagctcagtgttttctccggggtgttggcgtcgccttttgagctacgtttccatcgattcgaacttcgtatctagggaccctgcatgcaagagcgtaacagtttctgtgttacttaaccctactgctgcttgtaatgctgcaaaccggaaaataaccttacatggccttcgtaacatttaatgctccttcccccccttcctcttcccctgggcaatttaccgatgtactgatgacttgtaaatccacgtctccaaaccagacaacatccataaccacagatcagcatattaagaactaatccattttgtccttttagtgttttcatttaaaaagttaaattcacaaacaacagatatattgtactttttttttttttagttatagtgaagaaatacttggtcccatttcttttcgcctgggaggtatctttccactattagcaatgcgattattgcaaatcatcatatgcagtctatttcatttgcctctggaggggatcctgatactacagactatgttgcctacgtagctaaagatccagttaatcaacgagcctgtcacatattggaatgccacaatggaatggcccaagacgtcataagtaccatagggcaggcttttgaactccggtttaaacagtacttgaaaaatccttctttgaatacttcttgtgaaagtgaggaggtgcatattgatagccatgccgaggagagagaagatcatgaatattacaatgaaattccagggaagcagccaccagtaggtggtgtttcagatatgcggatcaaagttcaagccacggaacaaatggcttactgccccatacagtgtgaaaagttgtgctatttg

SEQ ID NO: 181184 - DNA, 3472 bp, Homo sapiens
  Payload ID: 15681
  Gene Symbol: SHC1
  Gene Name: SHC (Src homology 2 domain containing) transforming protein 1
  Uniprot ID: P29353
  ENST ID: ENST00000368445
  CDS Start-End: 216-1967
gaggctccacgttgggcggggatggggcctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatccactccggaatgagtctctgtcatcgctggaggaaggggcttctgggtccacccccccggaggagctgccttccccatcagcttcatccctggggcccatcctgcctcctctgcctggggacgatagtcccactaccctgtgctccttcttcccccggatgagcaacctgaggctggccaacccggctggggggcgcccagggtctaagggggagccaggaagggcagctgatgatggggaggggatcgtaggggcagccatgccagactcaggccccctacccctcctccaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttcta

SEQ ID NO: 181185 - DNA, 2879 bp, Homo sapiens
  Payload ID: 15681
  Gene Symbol: SHC1
  Gene Name: SHC (Src homology 2 domain containing) transforming protein 1
  ENST ID: ENST00000368449
  CDS Start-End: 310-1374
agagaagaggctccacgttgggcggggatggggcctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatccactccggaatgagtctctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttcta

SEQ ID NO: 181186 - DNA, 3059 bp, Homo sapiens
  Payload ID: 15681
  Gene Symbol: SHC1
  Gene Name: SHC (Src homology 2 domain containing) transforming protein 1
  Uniprot ID: P29353
  ENST ID: ENST00000368450
  CDS Start-End: 133-1554
gagtgtaataaagtttctccagggaggcagggcccggggagaaagttggagcggtaacctaagctggcagtggcgtgatccggcaccaaatcggcccgcggtgcggtgcggagactccatgaggccctggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttcta

SEQ ID NO: 181187 - DNA, 3062 bp, Homo sapiens
  Payload ID: 15681
  Gene Symbol: SHC1
  Gene Name: SHC (Src homology 2 domain containing) transforming protein 1
  Uniprot ID: P29353
  ENST ID: ENST00000368453
  CDS Start-End: 133-1557
gagtgtaataaagtttctccagggaggcagggcccggggagaaagttggagcggtaacctaagctggcagtggcgtgatccggcaccaaatcggcccgcggtgcggtgcggagactccatgaggccctggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttcta

SEQ ID NO: 181188 - DNA, 780 bp, Homo sapiens
  Payload ID: 15681
  Gene Symbol: SHC1
  Gene Name: SHC (Src homology 2 domain containing) transforming protein 1
  ENST ID: ENST00000366442
  CDS Start-End: 368-780
ggttagtgaggccggaagtgagtgtaataaagtttctccagggaggcagggcccggggagaaagttggagcggtaacctaagctggcagtggcgtgatccggcaccaaatcggcccgcggtgcggtgcggagactccatgaggccctgacggagtttcgctcttatcgtccaggctggagtgcaatggtgcgatctcggctcactgcaacctccgcctcctgagttcaagtgattctcctgcctcagcctcctgagtagctgggattacaggcgcccaccaccacgcccggctaatttttgtatttttagtagagacggggtttccccatgttggctaggctagcctcgaactcctgacctcaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactg

SEQ ID NO: 181189 - DNA, 1305 bp, Homo sapiens
  Payload ID: 15681
  Gene Symbol: SHC1
  Gene Name: SHC (Src homology 2 domain containing) transforming protein 1
  ENST ID: ENST00000444664
  CDS Start-End: 1-892
ggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtgagatggggtttcgccatgttgcccaagctgttcttgaactcccgggctcaagtgatccgcctccctcggcctcccagagtgctgggattacaggcacggaccaccatgcccagcctccacatctttttttgcactgtgtatactcttctgagacatgccaacttcctccaggtcaagaaaggggtatatagctctcagcttcactctttcagggctgatgtcgcctttgccttttctcacttcactgacctgtctattcctacaactgtctctttctagagaagcctcaatgatcaggattgacaggccacactctcccccaccatttttttctcctccttcaagcctcttgtctgtttcaccctcttccaccttggaggctgaggtcttatttgactcttcacctgaattgaccttcttccttcccaccctcccaggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatgga

SEQ ID NO: 181190 - DNA, 692 bp, Homo sapiens
  Payload ID: 15681
  Gene Symbol: SHC1
  Gene Name: SHC (Src homology 2 domain containing) transforming protein 1
  ENST ID: ENST00000412170
  CDS Start-End: 93-692
gaaagttggagcggtaacctaagctggcagtggcgtgatccggcaccaaatcggcccgcggtgcggtgcggagactccatgaggccctggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacaggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacagg

SEQ ID NO: 181191 - DNA, 550 bp, Homo sapiens
  Payload ID: 15681
  Gene Symbol: SHC1
  Gene Name: SHC (Src homology 2 domain containing) transforming protein 1
  ENST ID: ENST00000444179
  CDS Start-End: 162-550
ggcaggcaggcgctgggtctgagtacccctctttccccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccc

SEQ ID NO: 181192 - DNA, 3481 bp, Homo sapiens
  Payload ID: 15681
  Gene Symbol: SHC1
  Gene Name: SHC (Src homology 2 domain containing) transforming protein 1
  Uniprot ID: P29353
  ENST ID: ENST00000448116
  CDS Start-End: 222-1976
agagaagaggctccacgttgggcggggatggggcctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatccactccggaatgagtctctgtcatcgctggaggaaggggcttctgggtccacccccccggaggagctgccttccccatcagcttcatccctggggcccatcctgcctcctctgcctggggacgatagtcccactaccctgtgctccttcttcccccggatgagcaacctgaggctggccaacccggctggggggcgcccagggtctaagggggagccaggaagggcagctgatgatggggaggggatcgtaggggcagccatgccagactcaggccccctacccctcctccaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttcta

SEQ ID NO: 181193 - DNA, 780 bp, Homo sapiens
  Payload ID: 15681
  Gene Symbol: SHC1
  Gene Name: SHC (Src homology 2 domain containing) transforming protein 1
  ENST ID: ENST00000414115
  CDS Start-End: 181-780
cccagttgagtgggaggcaggcaggcaggcgctgggtctgagtacccctctttccccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacaggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggcccccc

SEQ ID NO: 181194 - DNA, 2494 bp, Homo sapiens
  Payload ID: 15682
  Gene Symbol: SHC2
  Gene Name: SHC (Src homology 2 domain containing) transforming protein 2
  Uniprot ID: P98077
  ENST ID: ENST00000264554
  CDS Start-End: 1-1749
atgacgcagggtccgggcgggcgcgcgcccccggcgccccccgcgccccccgagcccgaggcgcccaccaccttctgcgcgttgctgccccgaatgccgcagtggaagttcgcggccccgggcggcttcctgggccgcggcccggcggcggcgcgggcggctggggcctcggggggcgcggacccccaacccgagccggcgggcccggggggcgtcccggcgctggcggccgccgtcctgggcgcctgcgagccccgctgcgccgcgccctgtcccctgcccgcgctcagccgctgtcggggcgcggggtcgcgggggtcgcggggcgggcggggggcggcggggtccggggacgccgccgccgccgccgagtggatccggaagggcagcttcatccacaaacccgcgcacggctggctacaccccgacgccagggtcctggggcccggggtctcctacgtcgtgcggtacatgggctgcatcgaggttctccgctctatgcgctccctggactttaacacgcgcacgcaggtgaccagggaagccatcaaccggctccatgaggccgtgcctggcgtccggggatcctggaagaaaaaggcccccaacaaggccctggcgtccgtcctgggcaagagcaaccttcgctttgccggcatgagcatctccatccacatctccactgatggcctcagcctctccgtgcctgccacgcgccaggtcatcgccaaccaccacatgccgtccatctccttcgcgtcaggcggagacacggacatgacggattacgtggcctacgtcgccaaggaccccatcaaccagagagcctgccacatcctggagtgctgtgagggcctggcacagagcatcatcagcaccgtgggccaagctttcgagctgcgcttcaagcagtacctgcacagcccgcccaaggtggcgctgcccccagaaaggctggcagggccggaggagtcggcctggggggacgaggaggactctttggagcacaattactacaacagcatcccggggaaggagccgccgctgggcgggctagtggactccaggctggccctgacacagccctgcgccctcacggccctcgaccagggcccatctccttctctaagagatgcctgcagcctgccatgggacgtggggtccaccggtacagctccaccgggggacggctacgtgcaggcggacgcccggggccccccggaccacgaggagcacctgtatgtcaacacccagggtctggacgcccccgagccggaggacagccccaaaaaggatctgtttgacatgcgaccctttgaggatgccctgaagttgcatgagtgctcagtggcggcaggcgtgacagcagcccctcttcccttggaggaccagtggcccagcccccctacccgccgggcccctgtggcccccacggaggaacagctgcgtcaggagccctggtaccacggccggatgagccgccgggcggcagagaggatgcttcgagctgacggggacttccttgtgcgagacagcgtcaccaaccccgggcagtatgtcctcaccggcatgcacgccgggcagcccaagcacctgctgctcgtggaccccgagggcgtggtacggacgaaggacgtgctgtttgagagcatcagccacctgatcgaccaccacctgcagaacgggcagcccatcgtggccgccgagagtgagctgcacctgcgtggcgtggtctcacgggagccctgagccaggtgaccgttctcagccctggctcctgcctgttctcagccccggctcctgcctgtcatggccttggggctctcagccctcctcctggatcctggtcaggccgaaccaccgctgcctctccttcctccgcatgagcctctggcatggtccttcctccagctggccccgggctgggcagagcctcctcctgccggggcccctgcccaccccctcctttgcctggagtgagggtgttcataccaaagacggaaccatttcgcctttaaagaaaatatatccagaagcagccgctgcctcggagccctggcccttgggtccccctctcgcctggctggttcggtctaacgccccggagagtcagggctcccaggaccctggggaggaggcggattccgggcctggctgggcttcctcttcccacctgaggactgggtgcacagttgtctttgaggggggacgcttaaggtgctttggggttctcaggccaggatacatgctggcgctgaagtgcaggcagccttgaggtcacctgggatctcggggtagccaggctgctccaagacagtggatatcgaggcagtcgtgaggcccctactccacctgggagcaggggaaggacgtggttgcctggcctgggctgcgcccagcagcttccccccagtcctgccctcccagctgtcgacccagatgggatgttcggatcggtttgtaattaaacctgggaatggccacaagagcacaa

SEQ ID NO: 181195 - DNA, 816 bp, Homo sapiens
  Payload ID: 15682
  Gene Symbol: SHC2
  Gene Name: SHC (Src homology 2 domain containing) transforming protein 2
  ENST ID: ENST00000590170
  CDS Start-End: 1-416
gagggcctggcacagagcatcatcagcaccgtgggccaagctttcgagctgcgcttcaagcagtacctgcacagcccgcccaaggtggcgctgcccccagaaaggctggcagggccggaggagtcggcctggggggacgaggaggactctttggagcacaattactacaacagcatcccggggaaggagccgccgctgggcgggctagtggactccaggctggccctgacacagccctgcgccctcacggccctcgaccagggcccatctccttctctaagagatgcctgcagcctgccatgggacgtggggtccaccggtacaggaccagtggcccagcccccctacccgccgggcccctgtggcccccacggaggaacagctgcgtcaggagccctggtaccacggccggatgagccgccgggcggcagagaggatgcttcgagctgacggggacttccttgtgcgagacagcgtcaccaaccccgggcagtatgtcctcaccggcatgcacgccgggcagcccaagcacctgctgctcgtggaccccgagggcgtggtacggacgaaggacgtgctgtttgagagcatcagccacctgatcgaccaccacctgcagaacgggcagcccatcgtggccgccgagagtgagctgcacctgcgtggcgtggtctcacgggagccctgagccaggtgaccgttctcagccctggctcctgcctgttctcagccccggctcctgcctgtcatggccttggggctctcagccctcctcctggatcctggtcaggccgaaccaccgctgcctctccttcc

SEQ ID NO: 181196 - DNA, 951 bp, Homo sapiens
  Payload ID: 15682
  Gene Symbol: SHC2
  Gene Name: SHC (Src homology 2 domain containing) transforming protein 2
  ENST ID: ENST00000590222
  CDS Start-End: 1-208
cgacgccagggtcctggggcccggggtctcctacgtcgtgcggtacatgggctgcatcgaggttctccgctctatgcgctccctggactttaacacgcgcacgcaggtgaccagctcctgccaccactcaggctgcagacaggatctcgacacggaccccgcgtcaggctcagggcctcctgctcgctgctccaacccccacatctgatgccgagccttccttgtgggccgaggccagggacacactggtccctgggaaagagggtggtagaggggccagagctgggggccgggcctctgccggatgcaaggacgcacgtggagtgggctggtgcccaagctgcacctgtcctgtggggcactcctcccccagggaagccatcaaccggctccatgaggccgtgcctggcgtccggggatcctggaagaaaaaggcccccaacaaggccctggcgtccgtcctgggcaagagcaaccttcgctttgccggcatgagcatctccatccacatctccactgatggcctcagcctctccgtgcctgccacgcgccaggtcatcgccaaccaccacatgccgtccatctccttcgcgtcaggcggagacacggacatgacggattacgtggcctacgtcgccaaggaccccatcaaccagagagcctgccacatcctggagtgctgtgagggcctggcacagagcatcatcagcaccgtgggccaagctttcgagctgcgcttcaagcagtacctgcacagcccgcccaaggtggcgctgcccccagaaaggctggcagggccggaggagtcggcctggggggacgaggaggactctttggagcacaattactacaacagcatcccggggaaggagccgccgctgggcgggctagtggactccaggctggccctgacacagccctgcgccctcacggccctcgaccagggcccat

SEQ ID NO: 181197 - DNA, 569 bp, Homo sapiens
  Payload ID: 15683
  Gene Symbol: SHC3
  Gene Name: SHC (Src homology 2 domain containing) transforming protein 3
  ENST ID: ENST00000375831
  CDS Start-End: 109-426
cccacgggagaagcacccacctacgtcaacactcagcagatcccaccacaggcctggccggctgcggtcagcagtgctgagagcagcccaaggaaagacctctttgacatgaaaccttttgaagatgctctcaagaaccagcccttggggcccgtgttaagcaaggcagcctccgtggagtgcatcagccctgtgtcacctagagccccagatgccaagatgctggaggaactgcaagccgagacttggtaccaaggagagatgagcaggaaggaggcagaggggctgctggagaaagacggagacttcctggtcaggaagagcaccaccaacccgggctcctttgtcctcacgggcatgcacaatggccaggccaagcacctgctgctcgtggacccagaaggcacgagaagtaactcctactgatgttggccatccctggcactacagctgtatctgaataatcccgtaggtttggctgaatttttcatcttcccgtcaagaaagacattcatctttacctggggcatagtccaagaattgctaagtttaataaatgcagttaaatc

SEQ ID NO: 181198 - DNA, 9768 bp, Homo sapiens
  Payload ID: 15683
  Gene Symbol: SHC3
  Gene Name: SHC (Src homology 2 domain containing) transforming protein 3
  Uniprot ID: Q92529
  ENST ID: ENST00000375835
  CDS Start-End: 308-2092
tgcttttgctgtgagcagccccaagcagctgggcgctccatcagaggcaactatgacttttgcaaagcaaacgtgcaaccccaagcagcggtctcccgggccggggctgcgcggccgccgctgtgctggcttttaacggtgggagggcaccatcctcttgctctgctctcgttctccagaaggctgtcccggggcccccactctccgtcccgctccggggacagtggctcgcctgctatgcgcggcagcccgcgccggggccggcaccagcagcgcccgggcggatgcagcgagcccacggaggggcatgcttccacgcaccaagtataaccgcttcaggaatgactcggtgacatcggtcgatgaccttctccacagcctgtcggtgagcggcggcggaggcaaggtttcggcggcgcgcgcgaccccggcggcggctccctacttggtgtccggcgaggcgctgcgcaaggcgcccgacgatgggcccggcagcctgggccacctgctccacaaggtgtcccacctgaaactctccagctcgggcctccgcggcctgtcgtcggccgcccgggagcgggcgggcgcgcggctctcgggcagctgcagcgcgcccagcctggccgccccggacggcagtgcgccctcggcgccccgcgccccggccatgagcgccgccaggaagggccggcccggcgacgagccgctgcccaggccccctcggggggcgccgcacgccagcgaccaggtgctggggcccggagtcacctacgtggtcaagtacttggggtgcattgaagttctgcgctcaatgaggtctcttgacttcagtacaagaacacaaattaccagggaagccatcagccgcgtctgtgaagctgtgcctggtgcgaagggagccttcaagaagagaaagcctccaagcaaaatgctgtccagcatcttgggaaagagcaacctccagtttgcgggaatgagcatctctctgaccatctccacggccagtctgaacctgcgaactccggactccaaacagatcatagcgaatcaccacatgcggtccatctccttcgcctctgggggagacccggacacaactgactatgttgcatatgtggctaaggaccctgttaatcgcagagcttgtcacattttggaatgctgtgatgggctggcccaggatgtcatcggctccatcggacaagcctttgagctccggtttaagcaatatttacagtgtcctaccaagattcccgctctccatgatcgaatgcagagtctggatgagccatggacggaagaggagggagatggctcagaccacccatactacaacagcatcccaagcaagatgcctcctccagggggctttcttgatactagactgaaacccagaccccatgctcctgacacagcccagtttgcaggaaaagagcagacttattaccagggaagacacttaggagacacttttggcgaagactggcagcaaacacctttaaggcaagggtcctcggacatctacagcacgccagaagggaaactgcacgtggcccccacgggagaagcacccacctacgtcaacactcagcagatcccaccacaggcctggccggctgcggtcagcagtgctgagagcagcccaaggaaagacctctttgacatgaaaccttttgaagatgctctcaagaaccagcccttggggcccgtgttaagcaaggcagcctccgtggagtgcatcagccctgtgtcacctagagccccagatgccaagatgctggaggaactgcaagccgagacttggtaccaaggagagatgagcaggaaggaggcagaggggctgctggagaaagacggagacttcctggtcaggaagagcaccaccaacccgggctcctttgtcctcacgggcatgcacaatggccaggccaagcacctgctgctcgtggacccagaaggcacgatccggacaaaggacagagtctttgacagtatcagccacctcatcaaccaccacctagaaagcagcctgcccattgtctctgcagggagtgagctgtgtctccagcagccagtggagaggaagcagtgacctggccagcactgctcccagcactgcgcaccaggtcaggaggacctggagtggactagaatcggggctgctggaactgggacagctgcctgtggctcagagccttcttcaaaagcttcaaaaggaaggcttcctttaaggtcaagtttcataaacttggttctgaatttctcatatgcatattaaaggtgtacatacctatacatcctgtacaaattatccctctatatttatattttttaagactaagaaagatgtaagactaatgttctgtgctgtatgtttttaatgaaaaaaaaaaataagtttaactgtagttgtccaggcaaaaatttaattcaactgacccatcccaccgggaaatgccactaggaaggtgtagcctgcagttttacctaataagcacaactggaggggaatagaaacacagaattgtgagggaatcgcaaggcatgctgctcagagcatgcctagccctgcactgaaagctatgagatactggttctgaggcatggctgtgcttgctggtgggagcgggcatcctcccttggcctccctgggacacctcctgtgctccctgcactgcactccacgtgcctggggtgtctacacaactcgctgcagcttcactaaagaacaggtggcactccagcttctccgggtcctgctgagcacagggccccgccacccttgaccccagttgtgcgaggagtacttgggaattcatttcatgccaaaatggcacaaaataagcttcaccaaccaagattttgattgacaagtgcttccctgttctcatgtatctaatgctaaaatgggtatttgtagaagggtggtcggggcaaattcctggtttgtgtctccctctagtcagcggttgactacaggctgcttatggtaattgctagtaaagtcccccgcccgccttatacaataggggagaagcctgtgtgacagcaagagcaggcacccatcccagagctcagtcccgaagactcaggtattgaggcttctggggctgcatgtgccagaaacccaggagtcactggaatccatttgaggtactgcctctggcatgagggatgggggaaaggcctgctgtcccaacaacaaggtttctccgttgctgcagggaagagcatgtgcctgcccccactctttgtcttgactccctttcttccaggtaaaatactgtcatttcctgaggagtcatttggtgttagaaagctggcaatgtttatacctttcaaatactatctgggctgagattgccctgtgattttcacagatgccctttaaagaatagatggatccatttgcttgctggcagcgtggctcttgttctggtgagaccccacagggtacagcaccctgtagggtatgggtcagcagaacagaaagacacactaaacacgcttagagttggatagtgataaatctgatcctgtaaggagagttatgaggagactgaaaaatctggcagataataatactgctaagttctaatgccaatggtatgagccccatttctgccttggggtgtgcgtgtggccagatggaaggacaggttagagctaaccagtgaggatgagtcagggcaggccccagccttcatacatggccttctagggagtctttgcctttgagggtccagtgaatttgagatgacagtgaagtcagtgttctagaatgttctgcagtggattgaaactctggagagtctgacactactgtagactgcactgctgttttctgaaatggttttggcttcaggcatcatgtggatactctgcttagtgatccagaagcagacggctccacggggttgctggcagcagctgcatcaggctcctgccccaagacagcatagacttgggtgctctgagagctgccctgcacatctgtcctctgggaggctgggagccctggagagacacacacagctctgacccacctgtgcatgaatgtgcaccacatagaaaaatgtgcgaaatgaccttctttctacattcatgcattccccacttgtgaaaggtcaaaatgctattataacattcagggacaatagcaaagtaggaaatgcaagttaggagctgtgaatgctgtaacatttgatttactttatttttctcttggggggacttgaatggtaacctgcagctttagtagctcttgctgtgaagtcagtgtctagttcgatggtgatagaaaatatatatattttttgcatgagaatcaatttagaaaatttaaagtattggagtcgaattttttctttttaatattaattcaaaatatacatttttaagctcagattatatattggttacactagaatagtgccagtgaagtgagcaggcttcagacatagcagatggcagcgattttctaatctttgttccctcccatttgtaaagtgggttagagcacacattagttatcccaactcttccctccagcactgtgtggtgggccattcctgtgagcctcacagacacatggggaaagtgaggctggggctggtgccacaccttcctggaggccatgttgtcatctggctgcagagctcttctgctcactcagcatttcgtgagccctgctgtgtgccagcctgtgctttgagctcaggattccaaggcaaaagcaatggaggctcctccctgtctagcctgggcccctcttccccacactttctcaggccacatctctgcctgggcagggcagggaagctgaacaatgaacgcagcgggaatggcattaggccttgcgttccagggcctcaggcttccagggcacagtcgctgctgctgtgctgggccaccctggtcctgcagagtgcacctgggccctgctgtccctccaatgggcacccccaacacttaaccccaaactctatgtcttctgggagtacaaggtgggggccagcagtcctaaaacggcccctctgcccttaccgagtggccctagagacccccacccacctcccctaaccccacgaatgaatcagctgtgcttcaaatgacatctctgtcccacggaggccggctgggcctctcatgggggtgctcattgtggtttaagtcagctttgattcttgacctccaaggctgcctctgagtagctaaccggagaatcgggtggggaggtgaaaaacaccgcagtcaaatgactcaatctttaatcctgtgcttaagacaccactgttgctgttttttatatttgaagcacccaaagactgggcgtccgctcagccttgatgagcgagcagctattttgtcaggccatctatgatgttgggataatggacaaaggcctgattgggccatatatggccttctttagggcctcctggaggtggaggaagttgtgggtaatttctaataaagacgggaaatgacaagccgtgtgtgtaggtaaagtcctaacttaaaaggaaggacaggcctagggaagggtggaccctaaagggcccatgtgccaggggaacagtggacatgtgtgtccagcccaacctccatgtctggtgctgggattctgaaggtggcccccagctcccaaaataaagctttccttttcagtagcgtccgacacttgggtagcttctttctataagcaatgcttgaagatggacgtctgggtcctcatttcctccaaactggctgctacctgaaggcagtcacacatttcttttctgttgggctgagctgggcagaagcctcggactataggcctttccagggcagaggcaatgcgggccacgagtagatacctccatccagcctccaccctggcacacccagaacggcgtggactcaggcgggttgctggatttctctgagccttggcgtgctctacactgcagggctatacatgttcccagcttgagggcgtgctggggattgacaaatatatgaaacatataagcgcaatgattttctaaaattgtgcattcccagcgtgcccattggttctctctcgctggcccaactttgtgtgctgtccataaatccctttctgtggacggtgacagtaggattgggagtgagtgggaagattgtggaaagattgcaaagaggtcattgcaggactcagacagaccttgcagtgggtttcagagtaatactcaggttctcccatggaactttcaaagctggctctaagaaagatgaagaggacaaacccactcctggacatagtgccaacctagaactgtcagctccacacaggatcacagggaagggagcttggtaagacagcccagtagggggccctgcttttcagaagaggaaactggagccatgcaagggcctggggatcaacttagaaaagagcacaggactcacagtcctgggcctgcacgtaaagctagccccctgccccacggaaatggcaagcagtgcttccctccaggggttctacatctgtgctccatctcaaaatgcataaaagcctgagtcattcagatgggagagacagtgtttctacttcctcttagttggggttcctccagaaggagaccctgagagaggacttgaggttatgtagtttatttgagtgaagatcccggaagtagggagagaaggaagctgacggggaaggcgtgcattatcaagtaagttaccgtcatgtgcacaactggagctgaatcccaccggggaaccccgagagacagagctgacaccccagagttcacccagcaaggcggggagacagctggggtatttattcaccaagtctatcacttatgaaaggctgtttctggaaacaatttctgactggccctgcacacacctgagcatacttcctaagccggggatgtccctgagctgagacaggcgttcgtgacaagcagacttcgagtggaaggcaggcatcagaaccaccctgtgagctggttcagacaaagattgcaggcccttccacccccctggccccgccaagttcctgactccctaggtctggagtggggcccgggaatttgcatttcaaaaaatctcgaggtgatgctggtgcagctgctctgaagtcttgactttgagaaccactcactagtgagagtttccagcccttacctgtctcttattgatggctttcccccctctaatttataattatgctttcacaccacttcatgtcacagatcccagggtccgtgctgtgaatttaaaagtggagaattaataagcatttataactccatgcaaccattgctggcagcttaaatgccatctgccagccataatttatttataatggggtttatacatatttataagtttgcaagcaacaaatgcacagttttaaaactggcacattttatagcagccagaaaaattgcaactttataccaggacttgtgaatgtgaattgcatatgtatatacatatacgcatatacttacattgattaaaaacggatctgcatctctgtacacacgcagattggctctgtgttgtgcaccttgggactcctccctgggctttggttttacagctaagtaggaagtcaaacaaacgtgaagaatttgggaattggcaggctgtggcatcagccatggaggatggtcctggatgctgtaggatgtgagatccagcacaaagagaacaagaacaggacatgaggaccacagggattgggggaacccactgtgggaaatgacagagaagccagtgggggaagacaaagaaagaagaaggtggaggcagaataaaggtgagaagaagggaaggggaggataaaacaagtccagatttagatcttccttcatgcagccatgcatagctgtctgaggccagcagggaaggaggagaaagggaaggtgtggtggaggaggctgtgctcgtgatgtcatgctttcgtgtattcccaggtgcagctgcatatacttggcacagtttcttgggatttctagccagtttcttggcctcatttgtgcattagttaatatgtggctggccctgtactgggatggtgggatagagaagtgaatgtatgaggcctctgcctgagtttataacctagaaagaaataaagacacacacacacaaaggtgttggagtgtgacaagccttaaggtacccgtgtgtccaagtaaagtagaaccagcaagggtggagtgcccaggtcagtctggggactctggaggcttcgcactgcaggcgtcagatactgagtgttagtggcacggagaagagtgtggaaggctcaggatgggggtggacagcctggagttgtcactctcagtagagatgctagaaggggcgggaggtgatcccagcctcccttctttcctcctcctggctgtcacagatgctctgaattgatgaatccttcaggccaaaaacacacaggctccttccctaggtctggaaaaatggttctcgctgaaaaagcaccaggaataaaatctcatacaattttaggtgtctattttgttgtctcaccttgaaatactgcagacagaaaaacatgcacatggggagctgtggtcctgagctttgaggtaatgaattcccactcatgtgatcatttttaccataaccaaagtttctaaccatcaaaatcaagtgacaattaaaacaggcattaatggataaatccgtctttaaatattaatggggttaattttgttaacagctatgtgttggttgcaagtggaatgttctctgttcatttgacttttgaatataacttgttccagaatattgtaaaattaagtatgtgaatgtttctttgtattcagaattaaacatttggtgttaaaatcccaggattaggagacaactccatgtaaatttaatgtgtaataataagataataactttttaaaaagcatttggatggcaaattatacatactgacaaatgaatattatctgaaagttgttttgtttccattaacttttgtgaaacaaaaagaattactgtaacagtctatgtcttggcgtattgccaattcaccactttctactttgtgctggaacagaactggcttttttgacatccctgaggagtggaaatgcaaaacgaatttcaagttctctaatctttgttctatgacaaatgaaaaaacctaagttatctggtgttttggagatttgagaatacagcaggtgaagagaattagcttaaattccctcctcccttttgataaatccacagggattccttcactctgtcaggaaatggtgtggtttccaagcattagcccttcatgatctgtctggtgcatttctgtgctcctgggatcgccaagtgcaggcacggcatcgcatccccaggtgtcatcctgtgacccaggaggggaagatgacacacccaatttaggtaatgctgcacttcttgttataattggttattggaaaatgtgcctttattatcagaacagtggtgtgcgcatttctgattatggagctaacttttggatatctgacttagatactaaaaacatttgggtgttgcagttttgcacttgtagatacaacttaaaagcatgaaactggtgatttaattagatgttttctataaaatgcaccttgttacatttctgtgaaagggtcttaccagcgtggaataactggctcaagggttgagagaaacaaccattttctaaacagttaattgtttaaaggactatacatgtaagtctgcaggcaataaaggctgttgtgaaaagta

SEQ ID NO: 181199 - DNA, 3461 bp, Homo sapiens
  Payload ID: 15684
  Gene Symbol: SHCBP1
  Gene Name: SHC SH2-domain binding protein 1
  Uniprot ID: Q8NEM2
  ENST ID: ENST00000303383
  CDS Start-End: 268-2286
tatctcatttccaggcattgctggttcgtttttttcgaaaatcattccaaattatattccaattcgactttcttcaagttcatcccagaaaagcaaaggccgggcacttgaacaagaacagctgtcagcctggggcgagggggcagtgttggtgggggctggagcggggccggactctaattggtccacggcctcggcccgactatcaaatcagcagagcctgcgtcatcacgtcgttgcctgggctgccgtccgcggaaatttgaaatggctgacgggtcgctgacgggcggcggtctggaggcagcggccatggcgccggagcgcatgggctgggcggtggagcaggagctggcgtctctggagaaaggtttgttccaagatgaagattcatgcagtgattgtagctaccgtgataaaccaggttctagtttacaaagttttatgccagaaggaaaaacctttttcccagaaattttccaaacaaatcaacttttgttctatgagcgattcagagcctatcaagattacattttagctgactgcaaggcctctgaggtacaggaattcacagctgagttcttggagaaggtccttgagccatctggatggcgggcagtctggcacactaatgtgttcaaggtgctggttgagatcacagatgtggactttgcagccttgaaggcagtggtgaggcttgctgaaccatacctctgtgactctcaagtgagcacttttaccatggagtgcatgaaggagctccttgatctgaaggagcatcggttgcccctgcaggagctgtgggtggtgtttgatgattcaggagtgtttgaccagacagcccttgcaattgagcatgtcagatttttctaccaaaacatttggaggagttgggatgaagaagaggaggatgaatacgattattttgtcagatgtgttgaacctcgattaagattgcattatgacattcttgaagaccgagttccatcaggacttattgttgactaccacaatctgttgtctcaatgtgaggagagttacaggaaatttttaaatctgagaagcagtttgtcaaattgtaactctgattccgagcaggaaaatatctccatggtggaagggttaaaattgtattcggagatggaacagttgaaacaaaagctgaaactcattgagaatcctttgttgaggtatgtgtttggttatcagaagaattctaacatccaagcaaagggtgtccgttccagcggtcagaagatcactcatgtggtctcctccaccatgatggctggtctcctgcggtccctgcttacggacaggctttgccaggagcctggtgaggaagaaagagaaattcagttccatagtgatccattgtctgctataaatgcctgcttcgaaggtgacactgttattgtttgtcctggccattatgtggtacatggcactttctccattgctgactccattgagttggaaggatatggcctaccagatgacattgtgatagaaaagaggggcaaaggcgacacttttgtggactgcactggtgctgatattaaaatctcaggcataaaatttgttcagcatgatgctgtagagggaatcttaattgttcaccgtggtaagactacgctggaaaactgtgtgctgcagtgtgagacgaccggagtcacagtgcggacatcagcagagtttctaatgaagaactcggatttatatggcgccaagggtgctggtatagaaatctaccctgggagtcagtgcaccctgagtgacaatgggatccatcactgcaaggaagggatcctcattaaggacttcttagatgaacattatgacattcccaagatatccatggtgaataatataatacataataatgaaggttatggtgttgtcttggtgaaacctacaatcttctctgacctgcaagaaaatgctgaagatggaactgaagaaaataaagcgcttaaaattcagacaagtggagagccagatgtggctgaaagagtggatctagaagagctgattgagtgtgcaactggtaaaatggagctttgtgcaagaactgacccttctgagcaagtcgagggaaattgtgaaattgtaaatgaactaattgctgcctccacacagaaaggccagataaagaagaaaaggttgagtgaactggggatcacgcaagctgatgacaacttaatgtcacaggagatgtttgttgggattgtggggaaccagttcaagtggaatgggaaaggtagttttggcacatttcttttctgactacagtgatgtaagtagatagcaaaatactggattttgcacatgctgccctaagaatcactgctgccattgtagtttgctgtattgtctgtattttatatttgattatttgggcttgagtgaaaggtagatttatttccatttgcaggtgttgcacataaaacactccctctttataagaaaaatcataaatgcatataaaatagaaaatatttggagattgcttatctgaaagtcttgctttcttatacacatggttctctcatattaagcctggtagtaactttttagtgtaattacctttagcacttcaaagacgaggaagtaaggaagggaatgcaagactagtgcataaaaatgcaataggtgtcatatgtacagcattcttcttagagttgccttttcatcccaattacagtgagtctgatttccatcctgtatttgcataatacttgtcttaaaataaaagcttttatgattgggaatttatctgcctaatcagacttattattgagacgtcaatgggacgcatttttctgttgagctatgcagtcgtcaaaacagcgatagacagcataggaggtttgaagcagaaatgaaatgtgttattcagagccaatgttgtacatagagcattttcactattgctgaatgggaatgattaaaaacaaggtatttttcgggccaggcggtggctcacgcttgtaatcgcagcactttgggaggctgaggcaggaggatcacttgagcccaggagttcaagactagcctaggcaacatagtgagaccctgtctctactaaaaataaatttaaaaaaaattagctgagtgtggtggtgcatgcatgtagttccagctactcaggaggctgaggctagaggatccttgagcccaggaggttgaggctgcagtgaggtgtgattgcgccactgcattccagcttgggcgacagagcgagacccagtctcaaaaaaaaaaaaaagtatttttctcttaccgttacagtattctgattatattactgacacagtcaaaatgattaactgtacaacctgtatctgctgggtgttcttgttatcatattgtaaaacagctttaaaaatatttatattttaaaaactgtatgtgacattaatatgcctaatgattaaaattatagtgatgaaataacaaaa

SEQ ID NO: 181200 - DNA, 465 bp, Homo sapiens
  Payload ID: 15684
  Gene Symbol: SHCBP1
  Gene Name: SHC SH2-domain binding protein 1
  ENST ID: ENST00000569702
  CDS Start-End: 1-465
tgattcaggagtgtttgaccagacagcccttgcaattgagcatgtcagatttttctaccaaaacatttggaggagttgggatgaagaagaggaggatgaatacgattattttgtcagatgtgttgaacctcgattaagattgtatgtgtttggttatcagaagaattctaacatccaagcaaagggtgtccgttccagcggtcagaagatcactcatgtggtctcctccaccatgatggctggtctcctgcggtccctgcttacggacaggctttgccaggagcctggtgaggaagaaagagaaattcagttccatagtgatccattgtctgctataaatgcctgcttcgaaggtgacactgttattgtttgtcctggccattatgtggtacatggcactttctccattgctgactccattgagttggaaggatatggcctaccagatgacattgtgatagaaaa

SEQ ID NO: 181201 - DNA, 2317 bp, Homo sapiens
  Payload ID: 15685
  Gene Symbol: SHCBP1L
  Gene Name: SHC SH2-domain binding protein 1-like
  Uniprot ID: Q9BZQ2
  ENST ID: ENST00000367547
  CDS Start-End: 238-2199
agcgccccccagcaccctgaatgcgtccgcaggaccccgcgctctacccgcaggccccgcaccccctagctctgggccgcgcctcacatccctcccagagccgcaacaccccacccggcgggacgccctcgagcagccgctcgttgcgggcctgaagcgcagagcgcctattggccagagcggccgagggcgggaaaagtggccaacggctgcctcggccctcgggctgctgaggagatggcgtcgggctccaaggcctcggtgcccgcggactcattccgcaccatcagcccggacaggcgaggcgagaagtccgcctccgctgtctccggggacacggcggccgcgaccaccctgaagggcaccgcgatcccagtgcggtcggtggtggcctcccctcgcccggtgaaggggaaagcgggccgggagacggccaggctgcggctccagcgcctgcccgcggctcaggccgaggacacgggagaggcggcggcggcggcggcggaggagcccctgctgccagtgcctgaggatgaagaggaggcgcagcccctgcccccagtctgcgtgtcccgtatgagggggatgtggcgggacgagaaggtgtcgctgtattgcgacgaagtgctgcaggactgtaaggcagaagatgctgatgaagttatgggtaaatacctatcagaaaaattaaagttgaaagacaaatggcttggagtctggaagactaatcccagtgtattctttgtgaaatatgaagaagcttctatcccttttgttggtatattggttgaggtaacttgtgaaccataccaagactcatcatctcgtttcaaagttactgtttctgttgctgagcccttttcttccaacattgcaaatattccaagagatttggttgatgagattttggaggaactggaacacagtgtgcctcttttggaagtgtatcctgttgagggacaagatactgatatacatgttattgctttggccttggaagttgtcaggtttttttatgactttctttggagagactgggatgatgaagaaagttgtgagaattatactgcacttattgaagaaagaattaatttgtggtgtgatatacaggatggaacaatacctggtcctatcgcacaacgttttaaaaaaactttggagaaatataaaaacaaacgtgtcgagctcattgagtatcagagcaatattaaagaagatccatctgcagcagaggctgttgaatgctggaaaaaatactatgagatagtcatgctctgtggattactgaaaatgtgggaagatttacgcctccgagttcatggacctttctttccaagaattctgaggcgtaggaaaggaaaaagagaatttggaaagactataacacatattgtagcaaaaatgatgactactgaaatgataaaggatttatcttcagacacacttctccaacagcatggtgatttggatttggctttggataattgttatagtggagatacagtaataatttttccaggagaatatcaagctgcaaatcttgctttgttgacagatgacatcattataaagggagttggaaagagagaggaaattatgattacttctgaaccttctcgtgacagttttgtggtgtccaaagctgacaatgtgaaactaatgcatctatctttgatacaacaagggacggttgatggtatcgtggtggtggagtctggtcacatgactctagaaaactgcatattaaaatgtgaaggaacaggagtgtgtgttcttacaggggctgctttgacaattacagacagtgaaataactggcgcccagggtgctggtgttgaactgtatcctggaagcatagctattttggaaagaaatgaaattcatcactgtaataacctcagaaccagtaacagttcaaaaagcaccttaggtggagttaatatgaaggttcttccagcacccaaattgaagatgactaataatcatatttatagcaacaaaggctatggagtaagcattcttcaaccaatggaacagttttttatcgtagcagaagaagctctcaacaaaagggcttcttcaggagataaaaaagatgataaaatgctcttcaaagtaatgcaaaatctgaatctggaaatgaataataataagatagaagcaaacgtcaagggggatatcagaatagtcacaagttaaagcgtctgaattgatgttaaagttttatatttcacaaatttgtttaatacatgattctcataccccactgaaatggtagtttcaattcaaagcttaattaaaaaatatttaaatatca

SEQ ID NO: 181202 - DNA, 2292 bp, Homo sapiens
  Payload ID: 15685
  Gene Symbol: SHCBP1L
  Gene Name: SHC SH2-domain binding protein 1-like
  ENST ID: ENST00000423786
  CDS Start-End: 1-2175
atgcgtccgcaggaccccgcgctctacccgcaggccccgcaccccctagctctgggccgcgcctcacatccctcccagagccgcaacaccccaccggcgggacgccctcgagcagccgctcgttgcgggcctgaacgcagagcgcctattggccagagcggccgagggcgggaaaagtggccaacggctgcctcggccctcgggctgctgaggagatggcgtcggtccaaggcctcggtgcccgcggactcattccgcaccatcagcccggacaggcgaggcgagaagtccgcctccgctgtctccggggacacggcggccgcgaccaccctgaagggcaccgcgatcccagtgcggtcggtggtggcctcccctcgcccggtgaaggggaaagcgggccgggagacggccaggctgcggctccagcgcctgcccgcggctcaggccgaggacacgggagaggcggcggcggcggcggcggaggagcccctgctgccagtgcctgaggatgaagaggaggcgcagcccctgcccccagtctgcgtgtcccgtatgagggggatgtggcgggacgagaaggtgtcgctgtattgcgacgaagtgctgcaggactgtaaggcagaagatgctgatgaagttatgggtaaatacctatcagaaaaattaaagttgaaagacaaatggcttggagtctggaagactaatcccagtgtattctttgtgaaatatgaagaagcttctatcccttttgttggtatattggttgaggtaacttgtgaaccataccaagactcatcatctcgtttcaaagttactgtttctgttgctgagcccttttcttccaacattgcaaatattccaagagatttggttgatgagattttggaggaactggaacacagtgtgcctcttttggaagtgtatcctgttgagggacaagatactgatatacatgttattgctttggccttggaagttgtcaggtttttttatgactttctttggagagactgggatgatgaagaaagttgtgagaattatactgcacttattgaagaaagaattaatttgtggtgtgatatacaggatggaacaatacctggtcctatcgcacaacgttttaaaaaaactttggagaaatataaaaacaaacgtgtcgagctcattgagtatcagagcaatattaaagaagatccatctgcagcagaggctgttgaatgctggaaaaaatactatgagatagtcatgctctgtggattactgaaaatgtgggaagatttacgcctccgagttcatggacctttctttccaagaattctgaggcgtaggaaaggaaaaagagaatttggaaagactataacacatattgtagcaaaaatgatgactactgaaatgataaaggatttatcttcagacacacttctccaacagcatggtgatttggatttggctttggataattgttatagtggagatacagtaataatttttccaggagaatatcaagctgcaaatcttgctttgttgacagatgacatcattataaagggagttggaaagagagaggaaattatgattacttctgaaccttctcgtgacagttttgtggtgtccaaagctgacaatgtgaaactaatgcatctatctttgatacaacaagggacggttgatggtatcgtggtggtggagtctggtcacatgactctagaaaactgcatattaaaatgtgaaggaacaggagtgtgtgttcttacaggggctgctttgacaattacagacagtgaaataactggcgcccagggtgctggtgttgaactgtatcctggaagcatagctattttggaaagaaatgaaattcatcactgtaataacctcagaaccagtaacagttcaaaaagcaccttaggtggagttaatatgaaggttcttccagcacccaaattgaagatgactaataatcatatttatagcaacaaaggctatggagtaagcattcttcaaccaatggaacagttttttatcgtagcagaagaagctctcaacaaaagggcttcttcaggagataaaaaagatgataaaatgctcttcaaagtaatgcaaaatctgaatctggaaatgaataataataagatagaagcaaacgtcaagggggatatcagaatagtcacaagttaaagcgtctgaattgatgttaaagttttatatttcacaaatttgtttaatacatgattctcataccccactgaaatggtagtttcaattcaaagcttaattaaaaaatatttaaatatc

SEQ ID NO: 181203 - DNA, 2860 bp, Homo sapiens
  Payload ID: 15686
  Gene Symbol: SHISA2
  Gene Name: shisa family member 2
  Uniprot ID: Q6UWI4
  ENST ID: ENST00000319420
  CDS Start-End: 57-944
ctcggagaccgtcctgcgctctctggagacgcgctgtccgcgcccagggtggtgccatgtggggcgctcgccgctcgtccgtctcctcatcctggaacgccgcttcgctcctgcagctgctgctggctgcgctgctggcggcgggggcgagggccagcggcgagtactgccacggctggctggacgcgcagggcgtctggcgcatcggcttccagtgtcccgagcgcttcgacggcggcgacgccaccatctgctgcggcagctgcgcgttgcgctactgctgctccagcgccgaggcgcgcctggaccagggcggctgcgacaatgaccgccagcagggcgctggcgagcctggccgggcggacaaagacggccccgacggctcggcagtgcccatctacgtgccgttcctcattgttggctccgtgtttgtcgcctttatcatcttggggtccctggtggcagcctgttgctgcagatgtctccggcctaagcaggatccccagcagagccgagccccagggggtaaccgcttgatggagaccatccccatgatccccagtgccagcacctcccgggggtcgtcctcacgccagtccagcacagctgccagttccagctccagcgccaactcaggggcccgggcgcccccaacaaggtcacagaccaactgttgcttgccggaagggaccatgaacaacgtgtatgtcaacatgcccacgaatttctctgtgctgaactgtcagcaggccacccagattgtgccacatcaagggcagtatctgcatcccccatacgtggggtacacggtgcagcacgactctgtgcccatgacagctgtgccacctttcatggacggcctgcagcctggctacaggcagattcagtcccccttccctcacaccaacagtgaacagaagatgtacccagcggtgactgtataaccgagagtcactggtgggttcctttactgaagggagacgaaggcaggggtggattctcgaggtggaagtccgcacatgtcggtggtatttatggcacgattcctttggatggcttcatttgcccccagactgtatgaaaacatctccgaattagcatttctggatatgtttcatccagggtatcattgatttatgatggaaaaccggcctcagctggagatgactgtgatgttgctgatgggtgtataacaaatgcttgagtccgaagtgcccttgagatatggttgacgaaagaattttataaactgataaattaaggatttttattatgttgttattattatttcttttttgttgttgactgcacaggatcaaaatgcctgttatctcccttttacctgggactttttttttttttttttttttttttaatcagacagggtcttgctctgttgcccaggctggagtgcagtggtgcgatctcggctcactgcaacttcagcctcctggattcaggcaacactcctgcctcagcctcccacgtggctgggattacaggtgcctgcccccatggctaattttttgtattttttgtagagatggggtttcaccatgttggctgggctggtctcactctcctgacctcaagcaatctgcctgtctcagcctcccaaagtgctgggattacaggcgtgagccaccgcccccagcctgagcctttttttttttctaatgcatccaaggttaaggggaagacgcaaataacaggactattctaaaaggaaacctgtttgaactctgtgagatcagtcatcagtctcagtattccacaggcacaccttaatttcattgtaaaaagatatatatattttgtctatttttgtgcttttgggggcctattttgtgcttttttaccttatgtagagatcttattacaaagtgattttctacattaaaaagagactgaaataaattgtatagttacttaactaatgaagacatttcagaactctgggatgattttaatcttgaagtagtaggtggtatagtcataaaaccattcatccccttcttgattgtatcttaattttctggctttaaggtgacatctgagaggtaatgcattcttttttatattgaaatcataaactatcacccgctgcttctctgagttacttttaattttgccttgtggttatggtttggcgtttccttctgtttggttttcagagccccatgtctatatagtcctgagtgcaagtaattactatacttgtaaatgaagatcagtatttctgcctagatctgataaaaaaattttcttgtcttagttataaaaattcaaagaaatgtgttacaaagatacttagtatagctcctcagccataacctgagacttgggatgaaatttaaaccagatacgatttactttgcagatcataaggctttttatactcttgttatcaaaatggcttatttttcaggcactaaggattgttaagagaaaagcttttcaacgaaggattgcctttcttctcccacactgttcttgatttcctctctctttcaggcctcaacaggcactgtattcattgccaatgttccaaattatcaaattcaagtgaatttatttgtgtgttctttacttatataaaaaaagataactttaaggatgtgcaagtacatttccaactgctagcacaaccagtattttgtaattaaacaaatcgctgtatggtatggtcttctacacatttatgtctatagatatctatcgatcatctttctattctgtttcatgactgaataatgtaaaaccagtgttggcaattggtatcatcaatgatactcattttttaataaccaaaggcaggggaaaatcattttacttattaataaatattttatgatgtgaa

SEQ ID NO: 181204 - DNA, 1971 bp, Homo sapiens
  Payload ID: 15687
  Gene Symbol: SHISA3
  Gene Name: shisa family member 3
  Uniprot ID: A0PJX4
  ENST ID: ENST00000319234
  CDS Start-End: 219-935
cgcgcaccatgctgactcccggcctgcggaactcgtagtgcagcccctgtcgcctccccggcccctgctatcccacgcaggactggcttcggccgccggggccagcagcttgcgacgtgtccctggggaggcggaatcgctgtgcgccctgagcccgggctcagcccttcgctttccagctgcgtcctgctcccggccgcccagggagcccagtggcgatgagggcactgctggcgctttgccttctccttggctggctgcgctggggcccggcgggcgcccagcagtccggagagtactgccacggctgggtggacgtgcagggcaactaccacgagggcttccagtgcccagaggacttcgacacgctggacgctaccatctgctgcggctcctgcgcgctccgctactgttgcgccgcggccgacgccaggctggagcagggcggctgcaccaacgaccgccgcgaactggagcacccaggcatcactgcgcagcctgtctacgtcccctttctcatcgtcggctccatcttcattgcgttcatcatcctgggctctgtagtggctatttattgttgcacctgtttgagacccaaggagccctcgcagcagccaatccgcttctcactccgcagctatcagacagagaccctgcccatgatcctgacctccaccagccccagggcaccctcccggcagtccagcacagccacgagctccagctccacaggcggctccatccgcaggttctcctttgccagggctgagccgggctgcctggtgccctcaccgcccccgccatacaccaccagccactcaatccacctggctcagccatctggtttcctggtgtcaccccagtatttcgcttaccccctccagcaggagcccccactgcctgggaagagctgtccagacttcagttccagttgacacgcccaggccatgaatccacaactcagtcagatggcagacaggtggagccctgctcccattgccacatgcaattctgagaaaatttcccttgtaactgatcagtgtcatggaggagcatgctaggaaaacacagcaccttctaatttgaaagttcctgtctccaatcacagaaaggctaaaccagagaactgttttctggttttgcaaacatgtgatcattacatttcaatctatgctacttttattcaaaatatgcagcagtttgactttaaagttgcaaactggctaaaaacgttttactggacattcagctatattgcttagaaaagggctacatgtttctttttcatataagttgttcattgagttatgataggaatatattcataaataagcaaagaaaaatacctaattgtaattatcaaaggttcacttaaaaaattaactattaggtaaacttaagggggcagtgaaaaatctatttatgatttcgggagtaacctaaccatgaataatattagcataatgagaacatttactttttaaataaataactaaattttgtttacaatatgagtttttccagaatacaaggtttcaataatcacatgaggagtttaaagttttaaatatatactcagacattcattgtaacacagagtgtatgtaaaatcatttcccccactcactggagggagtatttattgcagactttttgttcagcaacatttagtgtttcagtgaaagttggacagttggggcttaaaacatttatttgtaaaatgagctatgttcaaatgtaaatatttgtaatttaatgtatttaccacattgactgtactaattatttagtagtcatactgtaatttttatgttaataataactggagttcaaagtctagctattggtataatcatctaatattatatatatctccagtgcccctgaattttatgtttgatgactatatatttgggcatatatcttgttggattagaataaataaaacactttatattttcatgaactcta

SEQ ID NO: 181205 - DNA, 1341 bp, Homo sapiens
  Payload ID: 15688
  Gene Symbol: SHISA4
  Gene Name: shisa family member 4
  Uniprot ID: Q96DD7
  ENST ID: ENST00000362011
  CDS Start-End: 288-881
ccaccgcggagccggggacagggggagcagggcagtgctctgctgggtgaggggcacccagctccagaggctaggtgggcgtcgctggtgggtggactcctgggcgctgcgcggagccgcgccggctgggttagcgcgggcggggcgcttagtcccacccccagaggaggcggaagaggagcccgagcctggccgcgggctgggccccgccgcagctccagctggccggcttggtcctgcggtcccttctctgggaggcccgaccccggccgcgcccagcccccaccatgccacccgcggggctccgccgggccgcgccgctcaccgcaatcgctctgttggtgctgggggctcccctggtgctggccggcgaggactgcctgtggtacctggaccggaatggctcctggcatccggggtttaactgcgagttcttcaccttctgctgcgggacctgctaccatcggtactgctgcagggacctgaccttgcttatcaccgagaggcagcagaagcactgcctggccttcagccccaagaccatagcaggcatcgcctcagctgtgatcctctttgttgctgtggttgccaccaccatctgctgcttcctctgttcctgttgctacctgtaccgccggcgccagcagctccagagcccatttgaaggccaggagattccaatgacaggcatcccagtgcagccagtatacccatacccccaggaccccaaagctggccctgcacccccacagcctggcttcatatacccacctagtggtcctgctccccaatatccactctacccagctgggcccccagtctacaaccctgcagctcctcctccctatatgccaccacagccctcttacccgggagcctgaggaaccagccatgtctctgctgccccttcagtgatgccaaccttgggagatgccctcatcctgtacctgcatctggtcctgggggtggcaggagtcctccagccaccaggccccagaccaagccaagccctgggccctactggggacagagccccagggaagtggaacaggagctgaactagaactatgaggggttggggggagggcttggaattatgggctatttttactgggggcaagggagggagatgacagcctgggtcacagtgcctgttttcaaatagtccctctgctcccaagatcccagccaggaaggctggggccctactgtttgtcccctctgggctggggtggggggagggaggaggttccgtcagcagctggcagtagccctcctctctggctgccccactggccacatctctggcctgctagattaaagctgtaaagacataactca

SEQ ID NO: 181206 - DNA, 2369 bp, Homo sapiens
  Payload ID: 15689
  Gene Symbol: SHISA5
  Gene Name: shisa family member 5
  Uniprot ID: Q8N114
  ENST ID: ENST00000296444
  CDS Start-End: 338-1060
atgcatccggtgagcagaaggaaactccgtgcgtcgcccggcgcctgtccgagtctgggaaccggtaccaagttttcgcgcagaccccgggcgcgaagctggccccgaggctgggaagtcgtccgcttccttccttcctcctccttccaccttcctccctcctccctcctccctcctcctccctcctcctcctcctgctcccccggacagaggttccgggaaccagccgggccggggcggggcggggcgagggagaggggcggccgcgcggatcactgaggctgtggcggcactgcgcccggcgctcgcgtccgtccgcccgtccgcccgcccagccatgactgcgccggtccccgcgccgcggatcctgttgccgttgctgttgctgctgctgctaacgccgcctccgggtgcacgtggtgaggtgtgtatggcttcccgtggactcagcctcttccccgagtcctgtccagatttctgctgtggtacctgtgatgaccaatactgctgctctgacgtgctgaagaaatttgtgtggagcgaggaaaggtgtgctgtgcctgaggccagcgtgcctgccagtgtagagccggtggagcagctgggctcggcgctgaggtttcgccctggctacaacgaccccatgtcagggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttggagctgctgccccctttcttcctggcctcggctgctggaattggaatcaggctgtactctttccatccatttgggcttct

SEQ ID NO: 181207 - DNA, 1839 bp, Homo sapiens
  Payload ID: 15689
  Gene Symbol: SHISA5
  Gene Name: shisa family member 5
  Uniprot ID: Q8N114
  ENST ID: ENST00000426002
  CDS Start-End: 195-608
gggcggggccatcctgtgtctttaagagggtggaacggggcttcgcgtctgtgcttcctgtggctgacgtcatctggaggagatttgctttctttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgga

SEQ ID NO: 181208 - DNA, 1933 bp, Homo sapiens
  Payload ID: 15689
  Gene Symbol: SHISA5
  Gene Name: shisa family member 5
  Uniprot ID: Q8N114
  ENST ID: ENST00000443308
  CDS Start-End: 36-737
cgctcgcgtccgtccgcccgtccgcccgcccagccatgactgcgccggtccccgcgccgcggatcctgttgccgttgctgttgctgctgctgctaacgccgcctccgggtgcacgtggtgaggtgtgtatggcttcccgtggactcagcctcttccccgagtcctgtccagatttctgctgtggtacctgtgatgaccaatactgctgctctgacgtgctgaagaaatttgtgtggagcgaggaaagcgtgcctgccagtgtagagccggtggagcagctgggctcggcgctgaggtttcgccctggctacaacgaccccatgtcagggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtc

SEQ ID NO: 181209 - DNA, 556 bp, Homo sapiens
  Payload ID: 15689
  Gene Symbol: SHISA5
  Gene Name: shisa family member 5
  ENST ID: ENST00000415268
  CDS Start-End: 61-246
gaggctgtggcggcactgcgcccggcgctcgcgtccgtccgcccgtccgcccgcccagccatgactgcgccggtccccgcgccgcggatcctgttgccgttgctgttgctgctgctgctaacgccgcctccgggtgggctacagatggtgccactgccttggagccctgttgcccaggctggtctcaaactcctggaaggcacagacatttcctggacacctgctgcaggcccagcgcggggctaagtgctttatgaacgctggtatgcacgtggtgaggtgtgtatggcttcccgtggactcagcctcttccccgagtcctgtccagatttctgctgtggtacctgtgatgaccaatactgctgctctgacgtgctgaagaaatttgtgtggagcgaggaaaggtgtgctgtgcctgaggccagcgtgcctgccagtgtagagccggtggagcagctgggctcggcgctgaggtttcgccctggctacaacgaccccatgtcagggttcggagcgaccttggccgttggcctgaccatctttgtgctgtctgtcg

SEQ ID NO: 181210 - DNA, 2306 bp, Homo sapiens
  Payload ID: 15689
  Gene Symbol: SHISA5
  Gene Name: shisa family member 5
  ENST ID: ENST00000417962
  CDS Start-End: 1-142
gttgctgctgctgctaacgccgcctccgggtggtgagccgggggtgggggcggcccgtcctgccctgggaccgggcagacacttccccgcgctgcctctccaacgagccgggcagcaccagccccactatgccccccactgacccctgattgccccgaggccgtcagcgaacccccacgactgcggacccctcctccaccccagcaccctccttgcctgaacaaccctgcctagacaccaggcagctgccacctttgtctgtcctggaacggtggggaggggtctgccctcccgcccatgttccaggggatggagtccccagaggctaggccctagctcagaggctcagattgggctgtgaagaccttgctgcatatgggttcacctgagccaccaggcacgggccatgctgatgataccagctttcagcacgtggtgaggtgtgtatggcttcccgtggactcagcctcttccccgagtcctgtccagatttctgctgtggtacctgtgatgaccaatactgctgctctgacgtgctgaagaaatttgtgtggagcgaggaaaggtgtgctgtgcctgaggccagcgtgcctgccagtgtagagccggtggagcagctgggctcggcgctgaggtttcgccctggctacaacgaccccatgtcagggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgg

SEQ ID NO: 181211 - DNA, 2081 bp, Homo sapiens
  Payload ID: 15689
  Gene Symbol: SHISA5
  Gene Name: shisa family member 5
  Uniprot ID: Q8N114
  ENST ID: ENST00000444115
  CDS Start-End: 215-844
gtgtgccctgggagctgccagtttctagctcagtcctggcccactgcgccagcgctgagcctgccagggctggggctggggatcaccttgggatgatggtgtcagtcccagggggcaggagatcgagtgtcctctgagctggcgactgggcctgtagaagggaaccggcatttgtggagtgtctactgagtgccaagcacgtggtgaggtgtgtatggcttcccgtggactcagcctcttccccgagtcctgtccagatttctgctgtggtacctgtgatgaccaatactgctgctctgacgtgctgaagaaatttgtgtggagcgaggaaaggtgtgctgtgcctgaggccagcgtgcctgccagtgtagagccggtggagcagctgggctcggcgctgaggtttcgccctggctacaacgaccccatgtcagggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttggagctgct

SEQ ID NO: 181212 - DNA, 2250 bp, Homo sapiens
  Payload ID: 15689
  Gene Symbol: SHISA5
  Gene Name: shisa family member 5
  Uniprot ID: Q8N114
  ENST ID: ENST00000442747
  CDS Start-End: 391-1020
agtcctggcccactgcgccagcgctgagcctgccagggctggggctggggatcaccttgggatgatggtgtcagtcccagggggcaggagatcgagtgtcctctgagctggcgactgggcctgtagaagggaaccggcatttgtggagtgtctactgagtgccaaggtctgcgctgggcactgtcctcgcaccgcctcacctagtcctcacgtagccctcgggcaagtgaggatccgccgggactgcggctgggagggatggctgtggctgtcccccagcccacacagtaggcgctcagtgtcagggtgcatattcccggggacgccctccaggcctgagagctgggggccgccgccgccccccatgcatccgcacgtggtgaggtgtgtatggcttcccgtggactcagcctcttccccgagtcctgtccagatttctgctgtggtacctgtgatgaccaatactgctgctctgacgtgctgaagaaatttgtgtggagcgaggaaaggtgtgctgtgcctgaggccagcgtgcctgccagtgtagagccggtggagcagctgggctcggcgctgaggtttcgccctggctacaacgaccccatgtcagggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgg

SEQ ID NO: 181213 - DNA, 575 bp, Homo sapiens
  Payload ID: 15689
  Gene Symbol: SHISA5
  Gene Name: shisa family member 5
  ENST ID: ENST00000417841
  CDS Start-End: 239-575
actgcgcccggcgctcgcgtccgtccgcccgtccgcccgcccagccatgactgcgccggtccccgcgccgcggatcctgttgccgttgctgttgctgctgctgctaacgccgcctccgggtgccctagctcagaggctcagattgggctgtgaagaccttgctgcatatgggttcacctgagccaccaggcacgggccatgctgatgataccagctttcagcacgtggtgaggtgtgtatggcttcccgtggactcagcctcttccccgagtcctgtccagatttctgctgtggtacctgtgatgaccaatactgctgctctgacgtgctgaagaaatttgtgtggagcgaggaaaggtgtgctgtgcctgaggccagcgtgcctgccagtgtagagccggtggagcagctgggctcggcgctgaggtttcgccctggctacaacgaccccatgtcagggttcggagcgaccttggccgttggcctgaccatctttgtgctgtctgtcgtcactatcatcatctgcttcacctgctcctgctgctgcctttacaagacgtgccgccgaccacgtc

SEQ ID NO: 181214 - DNA, 884 bp, Homo sapiens
  Payload ID: 15689
  Gene Symbol: SHISA5
  Gene Name: shisa family member 5
  ENST ID: ENST00000424965
  CDS Start-End: 72-443
cgcggatcactgaggctgtggcggcactgcgcccggcgctcgcgtccgtccgcccgtccgcccgcccagccatgactgcgccggtccccgcgccgcggatcctgttgccgttgctgttgctgctgctgctaacgccgcctccgggtgcacgtggtgaggtgtgtatggcttcccgtggactcagcctcttccccgagtcctgtccagatttctgctgtggtacctgtgatgaccaatactgctgctctgacgtgctgaagaaatttgtgtggagcgaggaaaggtgtgctgtgcctgaggccagcgtgcctgccagtgtagagccggtggagcagctgggctcggcgctgaggtttcgccctggctacaacgaccccatgtcaggatttgagctgggacaacaaggaggagacagtgcggaacaagctcccagaggggcataggaggaggagtggcttcctggggttgtggcagcagggaggtgactggggccagctcagaggcacctctgactccccaaggtgtgcatgtgggacctgttctgttagcccagctgccgccgtggtgtgcatagcactgggcctcgtgtgccgtgtgcttggcgtgccctgctgcctcctgccccaggctattttgcccatgcatcgagaagagcaggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgc

SEQ ID NO: 181215 - DNA, 559 bp, Homo sapiens
  Payload ID: 15689
  Gene Symbol: SHISA5
  Gene Name: shisa family member 5
  ENST ID: ENST00000441507
  CDS Start-End: 47-181
actgcgcccggcgctcgcgtccgtccgcccgtccgcccgcccagccatgactgcgccggtccccgcgccgcggatcctgttgccgttgctgttgctgctgctgctaacgccgcctccgggtgccctagctcagaggctcagattgggctgtgaagaccttgctgcatatgggttcacctgagccaccaggcacgggccatgctgatgataccagctttcagccagatcccctcagcatgacctcgtttattgagacttgtaaggatgtcagtagatcccaactctgtgctgagagtcttgtgatggctccagggctacagatggtgccactgccttggagccctgttgcccaggctggtctcaaactcctggaaggcacagacatttcctggacacctgctgcaggcccagcgcggggctaagtgctttatgaacgctggtatgcacgtggtgaggtgtgtatggcttcccgtggactcagcctcttccccgagtcctgtccagatttctgctgtggtacctgtgatgaccaatactgctgctctgacgtgctgaagaa

SEQ ID NO: 181216 - DNA, 1677 bp, Homo sapiens
  Payload ID: 15689
  Gene Symbol: SHISA5
  Gene Name: shisa family member 5
  ENST ID: ENST00000612611
  CDS Start-End: 304-816
gaggggcatgccttgggaaggtgtggatgctggtctggggaggggcgaggtgccccgggtcacgtctagctctttggcaggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccaggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaggcggccctctgagcattccctggcctctctggctgccacttggttatgttgtgtgtgtgcgtgagtggtgtgcaggcgcggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgg

SEQ ID NO: 181217 - DNA, 2385 bp, Homo sapiens
  Payload ID: 15689
  Gene Symbol: SHISA5
  Gene Name: shisa family member 5
  Uniprot ID: Q8N114
  ENST ID: ENST00000619810
  CDS Start-End: 447-1076
gttgctgctgctgctaacgccgcctccgggtggtgagccgggggtgggggcggcccgtcctgccctgggaccgggcagacacttccccgcgctgcctctccaacgagccgggcagcaccagccccactatgccccccactgacccctgattgccccgaggccgtcagcgaacccccacgactgcggacccctcctccaccccagcaccctccttgcctgaacaaccctgcctagacaccaggcagctgccacctttgtctgtcctggaacggtggggaggggtctgccctcccgcccatgttccaggggatggagtccccagaggctaggccctagctcagaggctcagattgggctgtgaagaccttgctgcatatgggttcacctgagccaccaggcacgggccatgctgatgataccagctttcagcacgtggtgaggtgtgtatggcttcccgtggactcagcctcttccccgagtcctgtccagatttctgctgtggtacctgtgatgaccaatactgctgctctgacgtgctgaagaaatttgtgtggagcgaggaaaggtgtgctgtgcctgaggccagcgtgcctgccagtgtagagccggtggagcagctgggctcggcgctgaggtttcgccctggctacaacgaccccatgtcagggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttggagctgctgccccctttcttcctggcctcggctgctggaattggaatcaggctgtactctttccatccatttgggcttct

SEQ ID NO: 181218 - DNA, 7262 bp, Homo sapiens
  Payload ID: 15690
  Gene Symbol: SHISA6
  Gene Name: shisa family member 6
  Uniprot ID: Q6ZSJ9
  ENST ID: ENST00000409168
  CDS Start-End: 1-1503
atggcgctgcggcgcctcctgctgctgctgctgctctcgctggagtccctggacctgctgcccagcgtccacggagcccgcggccgcgccgccaaccggaccctgagtgcaggcggcgctgccgtcgggggccggagggccgggggcgccctggcacggggcggccgcgagctgaacggcaccgcccgggcgcccggaatcccggaggcgggaagccggcgggggcagcccgcggcggctgtggcggcggcggccagcgcggccgtcacctacgagacgtgctggggctactacgacgtgagcggccagtacgacaaggagttcgagtgtaacaacagcgagagcggctacctgtactgctgcggtacctgctactaccgcttctgctgcaagaagcgccacgagaagctggaccagcgccagtgcaccaactaccagagcccggtgtgggtacagacgcccagcaccaaggtggtgtcgccggggcccgagaacaagtacgacccggagaaggacaagaccaacttcaccgtctacatcacctgcggggtgatcgccttcgtcatcgtggccggcgtcttcgccaaggtctcctacgacaaggcccaccgccctccacgggagatgaacatccacagggctctggctgacatcttaagacaacagggaccaatccccatagcacactgtgaaagagaaactatctcggctatcgatacctctcccaaagagaacacgccggtcagatcgtcctccaaaaaccactacactcctgtgcgtacggccaagcagactccagagaagccacggatgaacaacatcctgacatcagccaccgagccctatgacctctccttctcccgctcgttccagaacttggcccacctgcccccatcctacgagtctgcagtaaagaccaaccccagcaagtattcatctctgaagaggctaaccgacaaggaggctgacgagtattacatgagacggcggcacctgcccgacctggctgcccgcggcaccctccccctcaatgtcatccagatgtcccaacagaagccgttgccaagggaacgaccccgccggcccatccgggccatgtcccaggacagggtcctgtccccggatcggggcctgccagatgagttcagcatgccctacgaccgcatcctgtccgacgagcagctgctctccacggagcgcctgcactcccaggacccgctgctgtccccggagcggacggcctttcccgagcagtcgctgtccagggccatctcgcacacggacgtctttgtgtccacacccgtgctggaccgctaccgcatgagcaagatgcactctcatcccagtgcctccaataactcatacgccaccctgggccagagccagacggcagccaagcgtcatgcctttgcctcacgcagacacaacacggtggagcagctgcactacatcccgggccaccacacctgctacacagccagcaagaccgaagtgaccgtgtgaccggcggggcagggccggggctgctgggcgtggcagagcagagcgggggccgggaggggccaggagcagagcttctagccttgccactctcccttcccttgtcccctctgtaggaagtgggggtgggccacctttgcccaaaaagccatacccccggggacacagccccgatggcctggtccaatacacttagacccaggaccaagagcaatcgctcttgctcctccagaagaatcagtggggagtgaggagggggctaggccccattctcacccccgaccaccttcaccaactccctttccgtcccgcgcctccttctccccatccgggggactcagctgcaggttctgtcagcagagagacccttgcttgactgtggtctgaagctgcctgggtttgaaggggccagcgggtccaatcagtgggctgaccggataggctactcggtctcattcattcatctagaaccgcatcacagaaatctcctagtgcctaaaaactgcctgctcgctctctcagagccagggagctgctgtgtccataagcacaataatgattcttttcttgcctgctggaactctctggtccccactgagtgacccttcctttgctgacccctgagggcccaaccctggccctgtgcccctcccctcaactccaggaccaggaggggttcccttccttcagctgcctccccattggtgggaactccacccccttccagctgactgcccgcccataaggaccctgggcctgtcctttcagcgggctgtgctccttccctggccctgaggatttcacccttgagttttctggggttttggctgtagccttcgcagaggggagtagcaatggggtgctggccctcccagacacccgatcatctccgcactccctccaggcctctagacctgaccatgactgccactcaggctgccttctccacccctgctctgctcccaggaggcacctgcggtggccagagagccagggtggggagggccactgtgatgtgcggggtctcgggctcaacattcgcatcctgcagggctccacctgttcccacatgcacctccggcaggacctagacagaagtttctagagagcagcttttcagcccccagacaaggaggatgagaggtggttgtcctgcatcctctccgctcatccttccttccccatctctgtctacctgctcagttcagagatcactcctactgcctgtgtccccttcccccacatcctccctgcaactttattcctcctagctgatccttcagatccgtgcctcctctggatcaaagggacaaagacctattagcaaaagcaaacaaaggtcctccaggcgactggcctaggggctaactgggcaggtccccacagcatcatccctttgtgcaggcactggggtacctggtagaccatggtcctcagctctgttgggggaccgccactgcccgcccacctcagcctcttccccgcctccagcctgggggttggcatggtgtgacggcctcctggggaggtgacagtgaattcagcagcatccgctcccccaagaccagagagcctggtgggggaaagaaggggttccctcattctcagggccagggcacccgctgggttggggctgggggaatcaactccaggctattgggtgaaggtgtgatcctaaaaacagtcagatccaacagcagtgcccttataaatggggttttacctgccctcagttctgcactcatggccctttaaaaaggcgagtgtagaaggagaatttattggtgtcagccctggagatttttaatctaaccaagtccacaaaccacagagaaagcaatggactgtgtcctttcactgatttcaagagttccaaagctctcatctccttctcccctctgcagggtgtgcctcccaacaggaacaggaaaccatcaccctggatcttagggggatggaggctgggggttgtgaaagccactgtcagaccccacactggggatgcattcctggagtcgtgcggctggaaggccagggactaccctctctgctttcctcccaacagacacataaaccttcttaagggctggtccccaggggtttataagagtttgttccagaaggtgaggctaagagggttggaaaggaagaagtgagtctgaatagagcaggtggctcccagctgggcccctgagcccagcacctttgaatcgtctaatctgtggccatcccttggaaggcaggatgctggtggtgaggggaaaggacctgagtggctgagaatgcccttcccaggtgtctacatgcaggtatacaccaaaccagaaagctgatcccatctccagtgtcaaagcttctcagcaccaagttctccagcccccagggtgacacttttccccaggggtcctccccaagccctgtctctgacagggtttctgtctctctcaggggttgttgatgagttgattccaagacatttctcatcccagccttaccactgtctggctgaaaggctctgatgtcagttgggttggaaaattctactgcaatgcttacttcttttcaaggatttcttctgcttcacctttgggtctagaagcaaggaatgaagggagggagagagggagggagggaggggaggagggaagaaaaaagaagtagagataggtctacagacttgctccaattcagtcccacatttcaaaatccagaaaactatgtcatagctgggacagagaggtatcccatttattcagctgtcccatccatcttcatggaacaagcaaagccacatcaataggcaagttcacgtagcagataaaagaggcttctggggctggaacctagatgccatgatttctagcccaaccaggctggtggcctctaccatacatagaagtaccatccacccttacagtaaaagcctccctcctgctcacaaaggaagcctaaagcccaagatttccctctccttgttttattcatttttgcacatctctgttgctctaacagaaatgaactggaatctgcacaggttctctcctgccctgaaagttctgcctggtttccttggcctctgatggcattgaagctttcacaatccctcctgcatctccaccttccctgtcttgctccaggctcctggctccatgccttcctgtgtcaaaaaggctttgccaagaattacttcacctcctaaccaggcttctgccctcagggctcccccagtgtcttgggagtgtcttgggccacacgactgcctcttagaaagttccaaccttgcccccaattcaaatttctcctcccctctttccactctccctcccagaaactcctgatttccagaaaacctcagatttccaggccaggtcactcattccttcctctcatctccctcttcctccatctaccttcctccattcaccttcctccattcctaatttcttttccctggtcttgctataatctccagctctaaaaatcagagctctcaatgaaaacaatggaagaataagacattctttcggtcttctgtttgcctcactggtgtatccttcatctcctgcccctgtgagttgataccccagtgcacggagccaagggcttttcccctctgagctctgggagggaagggaatggagctctgggtttgagatgtcatggcctgtgatagtcagtttggttcctgccactagcaagtcccctgaagctcccaacccagcctgatgttagcccagaagctcctgctctggccaaagactcctatccttgagggctctcagccactgctccaacacacttgcccccttcctgcttgtgtatgtcacttatcctcctttgtccacaaagacttgagggcctcctgagtctccaagcatggaggaatatccatgccaacatccctgccatcaaactcaatccattttcttcagagataccttgtctgtcaccagcctccaacttcatattccttccacaggcaactgtgcacttgacccaaggtaaaatgaaagggctgccaatcactcggactccagaaggtgcctgccctgagaagagctggcatgttacctcccacatacatttcctgtcatcctgtccgaatctgggaaattttgctctggagtattttcaagaaagcgcattgtgttttaatgaagtatttttcagggttccaatgttattttttataaatgcagcattttaatggcagattcaatatgaaggacatgtcttcctgggctctatatttgattttggaaggcagcatactctaggagaaaaaaagcatagggctgaggctctgaagacacagcttccagccctggctttgtctccgagggggagtcatgttccccactcagtgcctcagtttccccatctgtaaaatgaggggctttgactagatgagctctgaagtttcatccagctcttacactgtagggctttcattccctgccagcacctgctctccccgttcctccccacctccactgagctgcacacatcccacaatgcctgccccacagcgatgtcctcagatgtcctggacagccaccgcactcctcactagagcctggggtgggcctgatgggctcggccacccagggatgccctcgtacctgaagtttaagggcctaaccattcaataggtcaccaactgtgtgccatggaagccctcttgtaaagacacacctaaaccatcctaagtgactgtggaattctggggaattctgagtttggagtttccatttggatacggtccttatagctggagggaggcggttccaatttcagagagggagctggctggagagaaaggtctggaggttggcccataagggcatgaagtttgtacttgagggcagctgggaaattcatttcaagctgcagaggaacgtgttcacaggctgttgtgtggcaatgaatgtcatgataacccactctggaatatgtgtcctgaagaccaagtctggacactgaggctccattccaactggaggaggaggcatctccatctgggctgctaggaaggggcactcatcccatcctagtacctttgtagcccttcgtcatgacactaccgtcctcccggtgaaggcttgtgaagcaagaatggagagtccaagtttgtgatattcaaacccatcttgtaaatcagcaaacacattaaccttccatcagtcagagaaataatgttgtggctgtgtgtttccttaatgctctccctcctgagggaggagaagaccctgctcaactttgctgcccaccctgcagtgacccctgaatgccacaccatgggaggactcattcattggctttgtagtggcaaatattcctctagttctataactcaactagacattttgtagtaaagaattcttgaaattctctaataaaaagcaattcttactgtaatatttttagtttggggacacaatttcctaaggggggattaatgaacatttttatgcattagcccaatttatgaattccatgtttattatatggtagtactgatgaaaagtacctttctatctgtatctttgcagtttcttcgttactcatatgtaagcctcatggtaagcagtgctctagtaactgcttctctgtacaaatctcatcgttctacttacctgtcaaagcacattctacatgtactgtaaacagatacactttagtaagatttagtcttaaggatttttccacttttgtcagtaacagatatttatggattaaaaaataaagccgtttcaacataa

SEQ ID NO: 181219 - DNA, 7518 bp, Homo sapiens
  Payload ID: 15690
  Gene Symbol: SHISA6
  Gene Name: shisa family member 6
  Uniprot ID: Q6ZSJ9
  ENST ID: ENST00000432116
  CDS Start-End: 161-1759
cgccgccactgccgcccgcgcctcgatggcgccatcgccccggagccgctgaccgctcagcgcctccagcccggcccgcgcggcgggtcctccgagcccggcccgccgggggagcggcctgccgcggaagcctccccgcgccctcccgcccggccccgccatggcgctgcggcgcctcctgctgctgctgctgctctcgctggagtccctggacctgctgcccagcgtccacggagcccgcggccgcgccgccaaccggaccctgagtgcaggcggcgctgccgtcgggggccggagggccgggggcgccctggcacggggcggccgcgagctgaacggcaccgcccgggcgcccggaatcccggaggcgggaagccggcgggggcagcccgcggcggctgtggcggcggcggccagcgcggccgtcacctacgagacgtgctggggctactacgacgtgagcggccagtacgacaaggagttcgagtgtaacaacagcgagagcggctacctgtactgctgcggtacctgctactaccgcttctgctgcaagaagcgccacgagaagctggaccagcgccagtgcaccaactaccagagcccggtgtgggtacagacgcccagcaccaaggtggtgtcgccggggcccgagaacaagtacgacccggagaaggacaagaccaacttcaccgtctacatcacctgcggggtgatcgccttcgtcatcgtggccggcgtcttcgccaaggtctcctacgacaaggcccaccgccctccacgggagatgaacatccacagggctctggctgacatcttaagacaacagggaccaatccccatagcacactgtgaaagagaaactatctcggctatcgatacctctcccaaagagaacacgccggtcagatcgtcctccaaaaaccactacactcctgtgcgtacggccaagcagactccagggcattatgggaaggatgcttaccgaagtggaggacctgatctccataacttcatctcatctggatttgtcacattaggaagaggacacaccaaggagaagccacggatgaacaacatcctgacatcagccaccgagccctatgacctctccttctcccgctcgttccagaacttggcccacctgcccccatcctacgagtctgcagtaaagaccaaccccagcaagtattcatctctgaagaggctaaccgacaaggaggctgacgagtattacatgagacggcggcacctgcccgacctggctgcccgcggcaccctccccctcaatgtcatccagatgtcccaacagaagccgttgccaagggaacgaccccgccggcccatccgggccatgtcccaggacagggtcctgtccccggatcggggcctgccagatgagttcagcatgccctacgaccgcatcctgtccgacgagcagctgctctccacggagcgcctgcactcccaggacccgctgctgtccccggagcggacggcctttcccgagcagtcgctgtccagggccatctcgcacacggacgtctttgtgtccacacccgtgctggaccgctaccgcatgagcaagatgcactctcatcccagtgcctccaataactcatacgccaccctgggccagagccagacggcagccaagcgtcatgcctttgcctcacgcagacacaacacggtggagcagctgcactacatcccgggccaccacacctgctacacagccagcaagaccgaagtgaccgtgtgaccggcggggcagggccggggctgctgggcgtggcagagcagagcgggggccgggaggggccaggagcagagcttctagccttgccactctcccttcccttgtcccctctgtaggaagtgggggtgggccacctttgcccaaaaagccatacccccggggacacagccccgatggcctggtccaatacacttagacccaggaccaagagcaatcgctcttgctcctccagaagaatcagtggggagtgaggagggggctaggccccattctcacccccgaccaccttcaccaactccctttccgtcccgcgcctccttctccccatccgggggactcagctgcaggttctgtcagcagagagacccttgcttgactgtggtctgaagctgcctgggtttgaaggggccagcgggtccaatcagtgggctgaccggataggctactcggtctcattcattcatctagaaccgcatcacagaaatctcctagtgcctaaaaactgcctgctcgctctctcagagccagggagctgctgtgtccataagcacaataatgattcttttcttgcctgctggaactctctggtccccactgagtgacccttcctttgctgacccctgagggcccaaccctggccctgtgcccctcccctcaactccaggaccaggaggggttcccttccttcagctgcctccccattggtgggaactccacccccttccagctgactgcccgcccataaggaccctgggcctgtcctttcagcgggctgtgctccttccctggccctgaggatttcacccttgagttttctggggttttggctgtagccttcgcagaggggagtagcaatggggtgctggccctcccagacacccgatcatctccgcactccctccaggcctctagacctgaccatgactgccactcaggctgccttctccacccctgctctgctcccaggaggcacctgcggtggccagagagccagggtggggagggccactgtgatgtgcggggtctcgggctcaacattcgcatcctgcagggctccacctgttcccacatgcacctccggcaggacctagacagaagtttctagagagcagcttttcagcccccagacaaggaggatgagaggtggttgtcctgcatcctctccgctcatccttccttccccatctctgtctacctgctcagttcagagatcactcctactgcctgtgtccccttcccccacatcctccctgcaactttattcctcctagctgatccttcagatccgtgcctcctctggatcaaagggacaaagacctattagcaaaagcaaacaaaggtcctccaggcgactggcctaggggctaactgggcaggtccccacagcatcatccctttgtgcaggcactggggtacctggtagaccatggtcctcagctctgttgggggaccgccactgcccgcccacctcagcctcttccccgcctccagcctgggggttggcatggtgtgacggcctcctggggaggtgacagtgaattcagcagcatccgctcccccaagaccagagagcctggtgggggaaagaaggggttccctcattctcagggccagggcacccgctgggttggggctgggggaatcaactccaggctattgggtgaaggtgtgatcctaaaaacagtcagatccaacagcagtgcccttataaatggggttttacctgccctcagttctgcactcatggccctttaaaaaggcgagtgtagaaggagaatttattggtgtcagccctggagatttttaatctaaccaagtccacaaaccacagagaaagcaatggactgtgtcctttcactgatttcaagagttccaaagctctcatctccttctcccctctgcagggtgtgcctcccaacaggaacaggaaaccatcaccctggatcttagggggatggaggctgggggttgtgaaagccactgtcagaccccacactggggatgcattcctggagtcgtgcggctggaaggccagggactaccctctctgctttcctcccaacagacacataaaccttcttaagggctggtccccaggggtttataagagtttgttccagaaggtgaggctaagagggttggaaaggaagaagtgagtctgaatagagcaggtggctcccagctgggcccctgagcccagcacctttgaatcgtctaatctgtggccatcccttggaaggcaggatgctggtggtgaggggaaaggacctgagtggctgagaatgcccttcccaggtgtctacatgcaggtatacaccaaaccagaaagctgatcccatctccagtgtcaaagcttctcagcaccaagttctccagcccccagggtgacacttttccccaggggtcctccccaagccctgtctctgacagggtttctgtctctctcaggggttgttgatgagttgattccaagacatttctcatcccagccttaccactgtctggctgaaaggctctgatgtcagttgggttggaaaattctactgcaatgcttacttcttttcaaggatttcttctgcttcacctttgggtctagaagcaaggaatgaagggagggagagagggagggagggaggggaggagggaagaaaaaagaagtagagataggtctacagacttgctccaattcagtcccacatttcaaaatccagaaaactatgtcatagctgggacagagaggtatcccatttattcagctgtcccatccatcttcatggaacaagcaaagccacatcaataggcaagttcacgtagcagataaaagaggcttctggggctggaacctagatgccatgatttctagcccaaccaggctggtggcctctaccatacatagaagtaccatccacccttacagtaaaagcctccctcctgctcacaaaggaagcctaaagcccaagatttccctctccttgttttattcatttttgcacatctctgttgctctaacagaaatgaactggaatctgcacaggttctctcctgccctgaaagttctgcctggtttccttggcctctgatggcattgaagctttcacaatccctcctgcatctccaccttccctgtcttgctccaggctcctggctccatgccttcctgtgtcaaaaaggctttgccaagaattacttcacctcctaaccaggcttctgccctcagggctcccccagtgtcttgggagtgtcttgggccacacgactgcctcttagaaagttccaaccttgcccccaattcaaatttctcctcccctctttccactctccctcccagaaactcctgatttccagaaaacctcagatttccaggccaggtcactcattccttcctctcatctccctcttcctccatctaccttcctccattcaccttcctccattcctaatttcttttccctggtcttgctataatctccagctctaaaaatcagagctctcaatgaaaacaatggaagaataagacattctttcggtcttctgtttgcctcactggtgtatccttcatctcctgcccctgtgagttgataccccagtgcacggagccaagggcttttcccctctgagctctgggagggaagggaatggagctctgggtttgagatgtcatggcctgtgatagtcagtttggttcctgccactagcaagtcccctgaagctcccaacccagcctgatgttagcccagaagctcctgctctggccaaagactcctatccttgagggctctcagccactgctccaacacacttgcccccttcctgcttgtgtatgtcacttatcctcctttgtccacaaagacttgagggcctcctgagtctccaagcatggaggaatatccatgccaacatccctgccatcaaactcaatccattttcttcagagataccttgtctgtcaccagcctccaacttcatattccttccacaggcaactgtgcacttgacccaaggtaaaatgaaagggctgccaatcactcggactccagaaggtgcctgccctgagaagagctggcatgttacctcccacatacatttcctgtcatcctgtccgaatctgggaaattttgctctggagtattttcaagaaagcgcattgtgttttaatgaagtatttttcagggttccaatgttattttttataaatgcagcattttaatggcagattcaatatgaaggacatgtcttcctgggctctatatttgattttggaaggcagcatactctaggagaaaaaaagcatagggctgaggctctgaagacacagcttccagccctggctttgtctccgagggggagtcatgttccccactcagtgcctcagtttccccatctgtaaaatgaggggctttgactagatgagctctgaagtttcatccagctcttacactgtagggctttcattccctgccagcacctgctctccccgttcctccccacctccactgagctgcacacatcccacaatgcctgccccacagcgatgtcctcagatgtcctggacagccaccgcactcctcactagagcctggggtgggcctgatgggctcggccacccagggatgccctcgtacctgaagtttaagggcctaaccattcaataggtcaccaactgtgtgccatggaagccctcttgtaaagacacacctaaaccatcctaagtgactgtggaattctggggaattctgagtttggagtttccatttggatacggtccttatagctggagggaggcggttccaatttcagagagggagctggctggagagaaaggtctggaggttggcccataagggcatgaagtttgtacttgagggcagctgggaaattcatttcaagctgcagaggaacgtgttcacaggctgttgtgtggcaatgaatgtcatgataacccactctggaatatgtgtcctgaagaccaagtctggacactgaggctccattccaactggaggaggaggcatctccatctgggctgctaggaaggggcactcatcccatcctagtacctttgtagcccttcgtcatgacactaccgtcctcccggtgaaggcttgtgaagcaagaatggagagtccaagtttgtgatattcaaacccatcttgtaaatcagcaaacacattaaccttccatcagtcagagaaataatgttgtggctgtgtgtttccttaatgctctccctcctgagggaggagaagaccctgctcaactttgctgcccaccctgcagtgacccctgaatgccacaccatgggaggactcattcattggctttgtagtggcaaatattcctctagttctataactcaactagacattttgtagtaaagaattcttgaaattctctaataaaaagcaattcttactgtaatatttttagtttggggacacaatttcctaaggggggattaatgaacatttttatgcattagcccaatttatgaattccatgtttattatatggtagtactgatgaaaagtacctttctatctgtatctttgcagtttcttcgttactcatatgtaagcctcatggtaagcagtgctctagtaactgcttctctgtacaaatctcatcgttctacttacctgtcaaagcacattctacatgtactgtaaacagatacactttagtaagatttagtcttaaggatttttccacttttgtcagtaacagatatttatggattaaaaaataaagccgtttcaacataa

SEQ ID NO: 181220 - DNA, 7575 bp, Homo sapiens
  Payload ID: 15690
  Gene Symbol: SHISA6
  Gene Name: shisa family member 6
  Uniprot ID: Q6ZSJ9
  ENST ID: ENST00000441885
  CDS Start-End: 161-1816
cgccgccactgccgcccgcgcctcgatggcgccatcgccccggagccgctgaccgctcagcgcctccagcccggcccgcgcggcgggtcctccgagcccggcccgccgggggagcggcctgccgcggaagcctccccgcgccctcccgcccggccccgccatggcgctgcggcgcctcctgctgctgctgctgctctcgctggagtccctggacctgctgcccagcgtccacggagcccgcggccgcgccgccaaccggaccctgagtgcaggcggcgctgccgtcgggggccggagggccgggggcgccctggcacggggcggccgcgagctgaacggcaccgcccgggcgcccggaatcccggaggcgggaagccggcgggggcagcccgcggcggctgtggcggcggcggccagcgcggccgtcacctacgagacgtgctggggctactacgacgtgagcggccagtacgacaaggagttcgagtgtaacaacagcgagagcggctacctgtactgctgcggtacctgctactaccgcttctgctgcaagaagcgccacgagaagctggaccagcgccagtgcaccaactaccagagcccggtgtgggtacagacgcccagcaccaaggtggtgtcgccggggcccgagaacaagtacgacccggagaaggacaagaccaacttcaccgtctacatcacctgcggggtgatcgccttcgtcatcgtggccggcgtcttcgccaaggtctcctacgacaaggcccaccgccctccacgggagatgaacatccacagggctctggctgacatcttaagacaacagggaccaatccccatagcacactgtgaaagagaaactatctcggctatcgatacctctcccaaagagaacacgccggtcagatcgtcctccaaaaaccactacactcctgtgcgtacggccaagcagactccagggcattatgggaaggatgcttaccgaagtggaggacctgatctccataacttcatctcatctggatttgtcacattaggaagaggacacaccaagggtgatcatcaatataaccatccgattttgagcagtgttacccagatcccgccacatgagaagccacggatgaacaacatcctgacatcagccaccgagccctatgacctctccttctcccgctcgttccagaacttggcccacctgcccccatcctacgagtctgcagtaaagaccaaccccagcaagtattcatctctgaagaggctaaccgacaaggaggctgacgagtattacatgagacggcggcacctgcccgacctggctgcccgcggcaccctccccctcaatgtcatccagatgtcccaacagaagccgttgccaagggaacgaccccgccggcccatccgggccatgtcccaggacagggtcctgtccccggatcggggcctgccagatgagttcagcatgccctacgaccgcatcctgtccgacgagcagctgctctccacggagcgcctgcactcccaggacccgctgctgtccccggagcggacggcctttcccgagcagtcgctgtccagggccatctcgcacacggacgtctttgtgtccacacccgtgctggaccgctaccgcatgagcaagatgcactctcatcccagtgcctccaataactcatacgccaccctgggccagagccagacggcagccaagcgtcatgcctttgcctcacgcagacacaacacggtggagcagctgcactacatcccgggccaccacacctgctacacagccagcaagaccgaagtgaccgtgtgaccggcggggcagggccggggctgctgggcgtggcagagcagagcgggggccgggaggggccaggagcagagcttctagccttgccactctcccttcccttgtcccctctgtaggaagtgggggtgggccacctttgcccaaaaagccatacccccggggacacagccccgatggcctggtccaatacacttagacccaggaccaagagcaatcgctcttgctcctccagaagaatcagtggggagtgaggagggggctaggccccattctcacccccgaccaccttcaccaactccctttccgtcccgcgcctccttctccccatccgggggactcagctgcaggttctgtcagcagagagacccttgcttgactgtggtctgaagctgcctgggtttgaaggggccagcgggtccaatcagtgggctgaccggataggctactcggtctcattcattcatctagaaccgcatcacagaaatctcctagtgcctaaaaactgcctgctcgctctctcagagccagggagctgctgtgtccataagcacaataatgattcttttcttgcctgctggaactctctggtccccactgagtgacccttcctttgctgacccctgagggcccaaccctggccctgtgcccctcccctcaactccaggaccaggaggggttcccttccttcagctgcctccccattggtgggaactccacccccttccagctgactgcccgcccataaggaccctgggcctgtcctttcagcgggctgtgctccttccctggccctgaggatttcacccttgagttttctggggttttggctgtagccttcgcagaggggagtagcaatggggtgctggccctcccagacacccgatcatctccgcactccctccaggcctctagacctgaccatgactgccactcaggctgccttctccacccctgctctgctcccaggaggcacctgcggtggccagagagccagggtggggagggccactgtgatgtgcggggtctcgggctcaacattcgcatcctgcagggctccacctgttcccacatgcacctccggcaggacctagacagaagtttctagagagcagcttttcagcccccagacaaggaggatgagaggtggttgtcctgcatcctctccgctcatccttccttccccatctctgtctacctgctcagttcagagatcactcctactgcctgtgtccccttcccccacatcctccctgcaactttattcctcctagctgatccttcagatccgtgcctcctctggatcaaagggacaaagacctattagcaaaagcaaacaaaggtcctccaggcgactggcctaggggctaactgggcaggtccccacagcatcatccctttgtgcaggcactggggtacctggtagaccatggtcctcagctctgttgggggaccgccactgcccgcccacctcagcctcttccccgcctccagcctgggggttggcatggtgtgacggcctcctggggaggtgacagtgaattcagcagcatccgctcccccaagaccagagagcctggtgggggaaagaaggggttccctcattctcagggccagggcacccgctgggttggggctgggggaatcaactccaggctattgggtgaaggtgtgatcctaaaaacagtcagatccaacagcagtgcccttataaatggggttttacctgccctcagttctgcactcatggccctttaaaaaggcgagtgtagaaggagaatttattggtgtcagccctggagatttttaatctaaccaagtccacaaaccacagagaaagcaatggactgtgtcctttcactgatttcaagagttccaaagctctcatctccttctcccctctgcagggtgtgcctcccaacaggaacaggaaaccatcaccctggatcttagggggatggaggctgggggttgtgaaagccactgtcagaccccacactggggatgcattcctggagtcgtgcggctggaaggccagggactaccctctctgctttcctcccaacagacacataaaccttcttaagggctggtccccaggggtttataagagtttgttccagaaggtgaggctaagagggttggaaaggaagaagtgagtctgaatagagcaggtggctcccagctgggcccctgagcccagcacctttgaatcgtctaatctgtggccatcccttggaaggcaggatgctggtggtgaggggaaaggacctgagtggctgagaatgcccttcccaggtgtctacatgcaggtatacaccaaaccagaaagctgatcccatctccagtgtcaaagcttctcagcaccaagttctccagcccccagggtgacacttttccccaggggtcctccccaagccctgtctctgacagggtttctgtctctctcaggggttgttgatgagttgattccaagacatttctcatcccagccttaccactgtctggctgaaaggctctgatgtcagttgggttggaaaattctactgcaatgcttacttcttttcaaggatttcttctgcttcacctttgggtctagaagcaaggaatgaagggagggagagagggagggagggaggggaggagggaagaaaaaagaagtagagataggtctacagacttgctccaattcagtcccacatttcaaaatccagaaaactatgtcatagctgggacagagaggtatcccatttattcagctgtcccatccatcttcatggaacaagcaaagccacatcaataggcaagttcacgtagcagataaaagaggcttctggggctggaacctagatgccatgatttctagcccaaccaggctggtggcctctaccatacatagaagtaccatccacccttacagtaaaagcctccctcctgctcacaaaggaagcctaaagcccaagatttccctctccttgttttattcatttttgcacatctctgttgctctaacagaaatgaactggaatctgcacaggttctctcctgccctgaaagttctgcctggtttccttggcctctgatggcattgaagctttcacaatccctcctgcatctccaccttccctgtcttgctccaggctcctggctccatgccttcctgtgtcaaaaaggctttgccaagaattacttcacctcctaaccaggcttctgccctcagggctcccccagtgtcttgggagtgtcttgggccacacgactgcctcttagaaagttccaaccttgcccccaattcaaatttctcctcccctctttccactctccctcccagaaactcctgatttccagaaaacctcagatttccaggccaggtcactcattccttcctctcatctccctcttcctccatctaccttcctccattcaccttcctccattcctaatttcttttccctggtcttgctataatctccagctctaaaaatcagagctctcaatgaaaacaatggaagaataagacattctttcggtcttctgtttgcctcactggtgtatccttcatctcctgcccctgtgagttgataccccagtgcacggagccaagggcttttcccctctgagctctgggagggaagggaatggagctctgggtttgagatgtcatggcctgtgatagtcagtttggttcctgccactagcaagtcccctgaagctcccaacccagcctgatgttagcccagaagctcctgctctggccaaagactcctatccttgagggctctcagccactgctccaacacacttgcccccttcctgcttgtgtatgtcacttatcctcctttgtccacaaagacttgagggcctcctgagtctccaagcatggaggaatatccatgccaacatccctgccatcaaactcaatccattttcttcagagataccttgtctgtcaccagcctccaacttcatattccttccacaggcaactgtgcacttgacccaaggtaaaatgaaagggctgccaatcactcggactccagaaggtgcctgccctgagaagagctggcatgttacctcccacatacatttcctgtcatcctgtccgaatctgggaaattttgctctggagtattttcaagaaagcgcattgtgttttaatgaagtatttttcagggttccaatgttattttttataaatgcagcattttaatggcagattcaatatgaaggacatgtcttcctgggctctatatttgattttggaaggcagcatactctaggagaaaaaaagcatagggctgaggctctgaagacacagcttccagccctggctttgtctccgagggggagtcatgttccccactcagtgcctcagtttccccatctgtaaaatgaggggctttgactagatgagctctgaagtttcatccagctcttacactgtagggctttcattccctgccagcacctgctctccccgttcctccccacctccactgagctgcacacatcccacaatgcctgccccacagcgatgtcctcagatgtcctggacagccaccgcactcctcactagagcctggggtgggcctgatgggctcggccacccagggatgccctcgtacctgaagtttaagggcctaaccattcaataggtcaccaactgtgtgccatggaagccctcttgtaaagacacacctaaaccatcctaagtgactgtggaattctggggaattctgagtttggagtttccatttggatacggtccttatagctggagggaggcggttccaatttcagagagggagctggctggagagaaaggtctggaggttggcccataagggcatgaagtttgtacttgagggcagctgggaaattcatttcaagctgcagaggaacgtgttcacaggctgttgtgtggcaatgaatgtcatgataacccactctggaatatgtgtcctgaagaccaagtctggacactgaggctccattccaactggaggaggaggcatctccatctgggctgctaggaaggggcactcatcccatcctagtacctttgtagcccttcgtcatgacactaccgtcctcccggtgaaggcttgtgaagcaagaatggagagtccaagtttgtgatattcaaacccatcttgtaaatcagcaaacacattaaccttccatcagtcagagaaataatgttgtggctgtgtgtttccttaatgctctccctcctgagggaggagaagaccctgctcaactttgctgcccaccctgcagtgacccctgaatgccacaccatgggaggactcattcattggctttgtagtggcaaatattcctctagttctataactcaactagacattttgtagtaaagaattcttgaaattctctaataaaaagcaattcttactgtaatatttttagtttggggacacaatttcctaaggggggattaatgaacatttttatgcattagcccaatttatgaattccatgtttattatatggtagtactgatgaaaagtacctttctatctgtatctttgcagtttcttcgttactcatatgtaagcctcatggtaagcagtgctctagtaactgcttctctgtacaaatctcatcgttctacttacctgtcaaagcacattctacatgtactgtaaacagatacactttagtaagatttagtcttaaggatttttccacttttgtcagtaacagatatttatggattaaaaaataaagccgtttcaacataa

SEQ ID NO: 181221 - DNA, 1329 bp, Homo sapiens
  Payload ID: 15690
  Gene Symbol: SHISA6
  Gene Name: shisa family member 6
  ENST ID: ENST00000343478
  CDS Start-End: 1-403
gaccaacttcaccgtctacatcacctgcggggtgatcgccttcgtcatcgtggccggcgtcttcgccaaggtctcctacgacaaggcccaccgccctccacgggagatgaacatccacagggctctggctgacatcttaagacaacagggaccaatccccatagcacactgtgaaagagaaactatctcggctatcgatacctctcccaaagagaacacgccggtcagatcgtcctccaaaaaccactacactcctgtgcgtacggccaagcagactccagggcattatgggaaggatgcttaccgaagtggaggacctgatctccataacttcatctcatctggatttgtcacattaggaagaggacacaccaagggtacagtggaaaccattttttactaaaatacagaggttgcctagggaacgccatctgaaatgagaagatggtgtggaggccagaggcttgtctgggacaggaataagtggggtggttccatggcagcttgtcctggtgacatgcgtggcttctgacaggagttactggaggtcacaggtgtgactttagagggcgatagacttccaagagacacccatcccactccacccatggcggggacacagatgccggcggctccttgtgggaagggaccacagggagtgtggtggaaaactgccggtggatgtagcagcatttgcaatgtgtgtgttcgcctcttggctattattccttttccttttgaaagctacattttataaaccaatgtcaatgttctgtactgtggtatctaagccggtgtgcatgtggagagtttcagcatcctaagtgtgtctccataaacactctatgatgtggacacaaaggtagaaggttatgcagaccttcaagcctcaagatgaaagctaacctagagtttctgctgagctgctttacaacctagctgacagcttgcagagcatctgtgcagggggcatggactcctcctcaattctgtcttttgtttaaacaaggtcctacgagtgttgtgagcattctgtcacatcaagagtcactggatccctaactcctttaattaccgtcccaacacctgtgtgctgttatagatcaaatgtgaattctgttgtaggggtagtgtatccctgtcttcccctgagatacgtgtcttgtgtgagtaaacaaggaactgtgcaatattttcttacattccatgcacctactttttaaattccttatgtgatgtttgttcatcctatagagaaaaaaaaatctgtatctgtgtatgtattttctgttgtgtctatttgtgtctaaataaagtttatcgaggata

SEQ ID NO: 181222 - DNA, 6033 bp, Homo sapiens
  Payload ID: 15691
  Gene Symbol: SHISA7
  Gene Name: shisa family member 7
  Uniprot ID: A6NL88
  ENST ID: ENST00000376325
  CDS Start-End: 1-1617
atgccggccctcctgctcctcgtactcctggcctctagcgccggccaggccagggcgcgcccgtccaacgccacgagcgccgagcccgcgggcccgctgcccgccctgctggcgcacctgcggcgcctgaccggggcgctgacgggcggcgggggcgcggcgagcccaggcgccaacggcaccaggaccggccccgcgggcggggcgggcgcggcggcccgggcgccccctcccgccgagctctgccacggctactacgatgtcatgggccagtacgacgccaccttcaactgcagcaccggctcctaccgcttctgctgtggcacctgccactaccgcttctgctgtgagcaccgtcacatgcgcctggcgcaggcctcctgctccaactacgacacgccgcgctgggccaccacgccgccgccgctagctgggggcgccgggggcgctgggggtgcgggcggggggccagggcccggccaggccgggtggttggaagggggccggactgggggtgccgggggccgcgggggcgagggccccgggggcagcacagcctacgtcgtgtgcggggtcatcagcttcgccctggccgtgggcgtcggcgccaaagtggccttcagcaaggcgtcccgtgcgccccgggcgcaccgggatatcaacgtgcccagagctctggtggacattctgagacatcaggcggggcctgggacccgcccggaccgggcccgaagcagctccctgaccccggggatcggcggtcccgacagcatgccccccaggacgcccaagaacctctacaacaccgtgaagacccccaacctcgactggcgagccttgccgccgcccagcccctccttgcactactccacgctgtcctgctctcggtccttccacaacctctcgcatctgcccccgtcctacgaggctgccgtgaaatccgagctgaaccgctactcttccctcaagaggctggccgagaaggatctggacgaggcctacctgaagcgccggcccctggaattgccccgcggcacgctgcccctgcacgcgctgcggcggccgggcacggggggcggctatcgcatggaggcctggggcggcccagaggagctgggcctggcgcccgcgcccaacccccggcgggtcatgtcccaggagcacctgctgggcgatggtggccgttcgcgctacgagttcacgctgccgcgcgcgcgcctggtgtcgcaggagcacctgctgctgtcctcgcccgaggccctgcgccagagtcgcgagcacctgctgtcgcccccgcgcagccccgcgctgccccccgaccccaccgcccgggccagcctggccgcctcgcactccaacctgctgctggggcccggggggcccccaacaccgctgcgcgggctgccgccaccgtccagcctgcacgcccaccaccaccacgccctgcacggctcgccgcagccggcctggatgtccgacgccggcgggggcgggggcacactggcccgcaggccgcccttccagcgccagggcacgctggagcagctgcagttcatcccgggccaccacctgccccagcacctgcgcacggccagcaagaacgaggtgactgtctgaggccagggccgggtctggggggctgcggcctcccgggccccccgtcccagcctggatcccccgacacaggcgcacacatgccaggggcctggggcccagatcggcccttggacaggagtgaaagcctccttctgggatgtcctggcagacaagattcctcctcctattacttcactgcttgagccaaggcctccttcccatgatgtcatcccagaggaagaggccggctcatgaggtcatcactagcaaaaatgtctgtgttctgtgatgtcatcacagggacaaagcctcgttcccatgaggtcatcacagaggaagaggccggcccgtgaggtcagcgctggaggccatgtccatgttctatggtgtcctcagaggcttccttcttgtggtataataacagagacgacgccttgttccatgacattccttcctgtggtgtcactgcagagacaatctcacctggatgatgtcatctctaactccaaggcctcttttggcatcatcgccatggggaagatattttctccctgtgtctttgcagcagagaagatgcctctgtcctatgatgtcatcattacagacaaagccatcttcctgggacacgtcgcaggggaaaatgcctcaccgattgtgtcctcactagacataaggtccccttttcacaacatcatcacagggaccctgcctccttcctgtgatgccatcaccagagaaggtgccttgccctatgacgtcatcagagggaccgtgcctcttcctgtgatgtcatcaccagagatgaccacccactctgggacctctccaggaggaggtcccttctgtgatgtcgcccagatgctatgtgctctgagatggcacaaagagatgcctccactgctgccaccatgttgtagaaggcagggcaggcccagagtccaggaccaccccagggaagatgccagagagcagagaggggccctgtcctgagatgttgtctgaaggaagcatcgctggggagccgcccatgtggagggcctcctccagagatgatggtctgtgtaggctgttggcagtgacacccctacccccaatgctgtgatggcatcaccagagcttcctcctcagaggcactgcccactctggaaggccatcggtattggtggtgtcaccagagttactgccttgtcccaccatgacttagcttggttgctccctccccagactccagggacatgtccagcaggatctctgccagaccctctgaggggaaatggggccttggatcccacatctgtgccatgactcctgggagacaggacctccagatggccttctgctcccaggaggccactctggatcaccaggatcctggagttctggcactcataggtgtcccatagcctggcctcacttttctttctgccatatctagagacaatcacctctgtcaacaaagtcctagccttctactggggggaggtgcttggggtacacctactcttgccctcactgacactgtcagcatcacacaacacccgccactcatgatggcaccacacccggggtcaagtgttacccatgtctgaggatggaatccttccccaggattacctatgacccacaactatggtatcatcttcttccaggatttaccatgactaatggtgtcaccatctgccaagactccccatagccaatggtgtcaccatcctccatgattcctcacaaccatggtgtcatcatctttcaggagccaccacagctgacggtgtcatcatctcctagattccaccatgaccagtgatgacattaccttccagaatccactacacctgacagagacatcctctactgaaatccactaggactgatgattccaccatttcccataatccctcatgattttggtgtcatcacctcccaagacccatgatgcccaatagtgtcatcatcatttgcagggatgcatggtgtcatcatctccagggatccacttcaaccatgtgccaccacctcccaggatttcattcaaacatgtgccactacctcccagtatccacttcaactatggtgttatcacctgccaggatccacgagagccaatgctgtcaccatccactaggatccaccataaccctggtgtcatcatctcctgtgatccatgaggtccagtgctgtcaccatccactaggatccaccatgaccctggtgtcatcatctcctgtgatccatgaggtccagtgctgtcaccatccactaggatccaccataaccctggtgtcatcatctcccaggatccatgaggtccagtgctgtctgtcaccatccactagtatccaccataaccctggtgtcatcttctcccaggatccatgaggtccagtgctgtcaccatccactaggatccgccataaccctggtgtcatcatccgtgatccatgaggtccagtgctgtcaccatccactaggatccaccataaccctggtgtcatcatctcccaggatccatgaggtccagtgttgtcaccatctactaggatccaccatgaccctggtgttatcatctcccaggatccatgaggtccagtgttgtcaccatctattaggatccaccatgaccctggtgttatcatctcccaggatccatgaggtccagtgctgtcaccacccactaggatccaccataaccctggtgtcatcccagagtccactgcaaccatgtgccatcatcccccaagagccatcatcttaggagccaagtaccgtgacgggctgtatttcagttgtcctctggggccgcatggtacttacagttgttcacttaaggggaaccagcacaacaggccatattcccgtttccactaaaaggacaggggtggggccagctgtccccctctgaagacttcacccctactctggccctccttatgtcactgcctcactcctgaccgaggatgatgcctgcatcaatcccaccacagatgtggcctcagccaacctcaccttaccccccggtgaggcacccaggcccctcctgacagcagcgctgtccctcacccagccatctgattggtgacagggtcaacccagcaacctctcattatcaccagagaggaagcatttcaaccctcaggtgacgccactgccccctgcccaatccctgtcacttgggcccctaccaggatcagcactccactggccccggccaaattctcctcagagatccctgacccccgcgggataggtcaaagctggtgaccgactggggccttcagtgctgtcttctgctggcctcatcctgcagcagggacactggagagcaatggtccctgccagcacatctgcgggaccaggggtgctccttcacctccctccctaacaccttaacacccggggagcctccgggggtggcaggaagtccccagcacccaatgcacaatcttccctcaattctctttgtacatagccatgttgcgggggcggccattcccccactcttaaagggctacacgcccctcccccagcccctagggcgaggtggggggggcctcttcttcctcccctgggccgtccccctccctcttatgtctccccgcaaacactggcacctcacactccttcttgtcaggagcttggggcagacaactggcccttggttcccaccacactgaggaaatgggggttacccaaatccacctgggccctggtgccagtttttcaaccccacggcttctagctgctctgaggggctcctcccatcccttccagggcctccccagccccgcactgctcaggccaactgtgacttccccagaaaggagccagcttgagcacccaccccctcccagccccctcccctctgctcaacacctccgcggaacactcagctttctccagctgccgggatttgggggtctgggcctttcagcttttttatcccccctccactagctctagcccagcctggattccagggatcccacccctagccctgtccctattcagttggcacaggctgcctgaccctggggccttgatttgatctcaaataagccatagaggagagaggtcttgaggggtgggagcaggtgtgtactgacaattcccctccacatgtcttgagctgggacctcgtcatctgagacttccccatgccccaacaaatgcaaatgcacacaaacccatgcatacacaagcacacacacacaggcatctccccgtctggttgggggagcatgggagggggcacttcacagggagaagataaatagttccacacctgaagaccctccaacagcttctgcctccctcctcatcacttcctctctccaccccctctccaacactggccccttcccctaattaattccctggtgaggacagccagaggagctgcgacttggtattttttggaataaatagacattttcctga

SEQ ID NO: 181223 - DNA, 2321 bp, Homo sapiens
  Payload ID: 15691
  Gene Symbol: SHISA7
  Gene Name: shisa family member 7
  ENST ID: ENST00000416792
  CDS Start-End: 1-461
gcgggggcgagggccccgggggcagcacagcctacgtcgtgtgcggggtcatcagcttcgccctggccgtgggcgtcggcgccaaagtggccttcagcaaggcgtcccgtgcgccccgggcgcaccgggatatcaacgtgcccagagctctggtggacattctgagacatcaggcggggcctgggacccgcccggaccgggcccgaagcagctccctgaccccggggatcggcggtcccgacagcatgccccccaggacgcccaagaacctctacaacaccgtgaagacccccaacctcgctacctgcacctcaacgtcaacagccccaagcaccacgccgccacactggactggcgagccttgccgccgcccagcccctccttgcactactccacgctgtcctgctctcggtccttccacaacctctcgcatctgcccccgtcctacgaggctgccgtgaaatccgagctgaaccgctactcttccctcaagaggctggccgagaaggatctggacgaggcctacctgaagcgccggcccctggaattgccccgcggcacgctgcccctgcacgcgctgcggcggccgggcacggggggcggctatcgcatggaggcctggggcggcccagaggagctgggcctggcgcccgcgcccaacccccggcgggtcatgtcccaggagcacctgctgggcgatggtggccgttcgcgctacgagttcacgctgccgcgcgcgcgcctggtgtcgcaggagcacctgctgctgtcctcgcccgaggccctgcgccagagtcgcgagcacctgctgtcgcccccgcgcagccccgcgctgccccccgaccccaccgcccgggccagcctggccgcctcgcactccaacctgctgctggggcccggggggcccccaacaccgctgcgcgggctgccgccaccgtccagcctgcacgcccaccaccaccacgccctgcacggctcgccgcagccggcctggatgtccgacgccggcgggggcgggggcacactggcccgcaggccgcccttccagcgccagggcacgctggagcagctgcagttcatcccgggccaccacctgccccagcacctgcgcacggccagcaagaacgaggtgactgtctgaggccagggccgggtctggggggctgcggcctcccgggccccccgtcccagcctggatcccccgacacaggcgcacacatgccaggggcctggggcccagatcggcccttggacaggagtgaaagcctccttctgggatgtcctggcagacaagattcctcctcctattacttcactgcttgagccaaggcctccttcccatgatgtcatcccagaggaagaggccggctcatgaggtcatcactagcaaaaatgtctgtgttctgtgatgtcatcacagggacaaagcctcgttcccatgaggtcatcacagaggaagaggccggcccgtgaggtcagcgctggaggccatgtccatgttctatggtgtcctcagaggcttccttcttgtggtataataacagagacgacgccttgttccatgacattccttcctgtggtgtcactgcagagacaatctcacctggatgatgtcatctctaactccaaggcctcttttggcatcatcgccatggggaagatattttctccctgtgtctttgcagcagagaagatgcctctgtcctatgatgtcatcattacagacaaagccatcttcctgggacacgtcgcaggggaaaatgcctcaccgattgtgtcctcactagacataaggtccccttttcacaacatcatcacagggaccctgcctccttcctgtgatgccatcaccagagaaggtgccttgccctatgacgtcatcagagggaccgtgcctcttcctgtgatgtcatcaccagagatgaccacccactctgggacctctccaggaggaggtcccttctgtgatgtcgcccagatgctatgtgctctgagatggcacaaagagatgcctccactgctgccaccatgttgtagaaggcagggcaggcccagagtccaggaccaccccagggaagatgccagagagcagagaggggccctgtcctgagatgttgtctgaaggaagcatcgctggggagccgcccatgtggagggcctcctccagagatgatggtctgtgtaggctgttggcagtgacacccctacccccaatgctgtgatggcatcaccagagcttcctcctcagaggcactgcccactctggaaggccatcggtattggtggtgtcaccagagttactgccttgtcccaccatgact

SEQ ID NO: 181224 - DNA, 486 bp, Homo sapiens
  Payload ID: 15692
  Gene Symbol: SHISA8
  Gene Name: shisa family member 8
  Uniprot ID: B8ZZ34
  ENST ID: ENST00000457093
  CDS Start-End: 1-486
gtcgggccgcgcgggagcccccgaggcgcagggtcccgcggcgcccggcacgacagccccggaggggggcgaccgctgccgcggctactacgacgtgatgggccagtgggacccgcccttcaactgcagctccggagcctacagcttctgctgcggcacgtgcggctaccgcttctgctgccacgacgggccgcggcgcctcgaccagagccgctgttccaactacgacacgccggcctgggtccagacaggccggccgcccgcccgcgcccgcgacaccgcagcgccccgggaccccggccgcgagcgcagccatacggccgtctacgctgtgtgcggcgtcgcagcgctgctggtgctggccggcatcggggcgcgcctgggactggagagggcgcacagcccgcgcgcgcggcgcacagtgaccagggcgctgacagagcttctgaagcagccgggcccccaggagccactgcctcccaccct

SEQ ID NO: 181225 - DNA, 1405 bp, Homo sapiens
  Payload ID: 15692
  Gene Symbol: SHISA8
  Gene Name: shisa family member 8
  ENST ID: ENST00000621082
  CDS Start-End: 1-1194
atggcgcgggccggggcgcggggactgctcggcggccgccgtcctcccggcctccggctcgcgctcgcgcttcggctcgcgttgctgctggcgcggccgccgtcgggccgcgcgggagcccccgaggcgcagggtcccgcggcgcccggcacgacagccccggaggggggcgaccgctgccgcggctactacgacgtgatgggccagtgggacccgcccttcaactgcagctccggagcctacagcttctgctgcggcacgtgcggctaccgcttctgctgccacgacgggccgcggcgcctcgaccagagccgctgttccaactacgacacgccggcctgggtccagacaggccggccgcccgcccgcgcccgcgacaccgcagcgccccgggaccccggccgcgagcgcagccatacggccgtctacgctgtgtgcggcgtcgcagcgctgctggtgctggccggcatcggggcgcgcctgggactggagagggcgcacagcccgcgcgcgcggcgcacagtgaccagggcgctgacagagcttctgaagcagccgggcccccaggagccactgcctcccaccctgggcccacccctgggtggctgtgtccaggtgcagatgggggacggcctcccccggggctccccccacaacagcgcagacaagaagcgcctcaacaacgcgccccgggggtcggccgccccggggcccccgcgcggcccgcggctgcagggcggcggcagcctgacgctgcagccagactacgccaagtacgccacgttcaaggccgccgcgctcaaggccgcagaggccgccccgcgggacttctgtcagcgtttccccgccctcgagccgtccccgcggcaacccccggcgcgggctccgcgaccatccccggacttgcctgcgccgctggacgcctgcccctgggccccgccggtctacgcgccccctgccgcgccgggcccctatgccgcctggacctccagtcgcccggcccggcccgccccgctcagccacccgacggctcgggccttccaggtaccccggcgacccgggcacgcggcccggcgccagttcagtgtgaagatgcctgagaccttcaacccgcagctccccggcctttacggcagcgcgggccgcgggtcccggtacctaaggaccaatagcaagaccgaggtcaccgtgtgaagcggggccgcggtgccctcgaggcatgggctggggtcctgtctgcccgtcggagcctcaggccacagggagaggagcgcctgccgtaaggccagctcttctgtctgcctcaacggcagtggtgtcttggagcctgcaggccgcgggttcgtcttgtaaataagcccttttatgtggttcctgcccctgagaataaagaagccccagcgtg

SEQ ID NO: 181226 - DNA, 4043 bp, Homo sapiens
  Payload ID: 15693
  Gene Symbol: SHISA9
  Gene Name: shisa family member 9
  Uniprot ID: B4DS77
  ENST ID: ENST00000423335
  CDS Start-End: 309-974
gtggccggccggacctgcaccccgcgcttgaccccgctcatcctccccccgcccggccgggcgcgctcctccccggccggcccctcggcgcgcggcgcgctggaggcgaacgcgggctgaggcgaacgcgggctgagccgagcgcagtggccgccgaccaccgagcgccccgcgccgctccctgcatgtgcggcccgcggcggctcgcagctcccggcagcagcctcggcagcttcggccgcgcctcgagaggcggccgcagaggctccagcggcggccgagcggccgagcccgggctgggagacaccatgcgccgcgtccttcggctgctcctcggttgcttcctcaccgagctgtgcgcccgcgtgtgccgggcgcaggagcgagcgggacacgggcagctggcgcaactgggcggcgtgttgctgctggcggggggcaaccgctccggggccgcctccggagaggccagcgagggcgctgaggcatcggacgcgcccccgacccgggcgcccacgccggacttctgccggggctacttcgatgtcatgggccagtgggacccgccgttcaactgcagctcgggcgacttcatcttctgctgcgggacttgtggcttccggttctgctgcacgtttaagaagcggcgactgaaccaaagcacctgcaccaactacgacacgccgctctggctcaacaccggcaagccccccgcccgcaaggacgaccccttgcacgaccccaccaaggacaagaccaacctgatcgtctacatcatctgcggggtggtggccgtcatggtgctcgtgggcatcttcaccaagctggggctggagaaagcgcaccggccccaaagggagcacatgtccaggctctatgacaatctgctgtttatggaggcacagatttctttccaagaggacgaacctgcccctggagagtggagtgtcggacttcaaacctggacagtctgagtgcacggatccttggccgctaggctgcactgcgtttgagtgcaaacctgcaggaattccagacttctcagatcacagagaagtacgcgatgccctgcaaacaacagctcatgcatcggggccagttcaagaagctaccgtaagatgaagtctaggaatgctttctatatcggccccggcaggcccagacgtcttggtggaggcgttggtgagaaatgaccttggggacagaagcacatatgtgaagctctctacacttgaagccagtagggaacacatgtcattattttgtccaccttcaaacagaattggaaatccaagtggcaaatggcagataagggtcctgtgtgtttttaaaacatgcttcagaagaactggcaccccttggaaagaaatagcaacaaataatgataaatgcacctcctcctcttgccttttgccttccagtttctctcctgcctctcatctttctatgcatttgtggttatcctaaggctttgaccagcttcccaggctggagaagtccatgtgtgcatgcatctactgttggccacagaaaagtcttaatttatttttctttgcagggtatgttgacttctctttgggcactgagtccttgcattttaaaaatcaacttcattgaagtataatttacacaataaaatgcacacattgtaagtgtgtagtttgatgagcttggacaaatgtctatacctgtgtaatcattactctagaaagctcactcatgcccattgcccttgcatttttgaaaaataattgatgcttcttgtgcaagaagaagtgctcaggaactctattcaagtgtttaaaagtcaacacatagattggacattgggatacctggaggctttgaagcaagataccgggactctgagttctgtttggaaatattggtgtcatatatttgtcattgtaattggaaagaaaagagatgcaccattttcttcttgttctttggataagctaagctcattcccatcttggagctgttgcactggcccttgtgtggctggtccctcctcatcaccagggtcccagctccaatgtcatcttctctgagaagccgtccctgaccaggcttagttgcttcccaccccagcctgacacactccagcccatcacccagtcagtgttatttgcttcatttttacattatggtctaaaattaacttgctagtttactggtttactagtttattatctgtctccttccattatccctctccttccctccttcccttccccttccttccttccttccttccttccttcgagacacagtcgtactctgtcaccccggctggagtgcagtggtgtgatcttgcctcactacaacccctgcctcctgggttttagcgattcttctgcctcagcctcccgagtagctgggactacaggcacccaccatgatgccaggctaatttttgtatttttattggagacagggtttcaccatgttggccaggctggtctcgaactcttgacctcaagtgatccacctgtctcggcctcccaaagtgctgggattacaggcatgagccactgcacctggcccttttattattcatagtaagacacacagggaccacaattgtctcttctactcagtagttggattctgagtgcctagttcagtatttggcaagtaagagttctgcatttgatatcctggtttacctggcacaacaaagtatctccaaattcattcattcattctttcattcattcgataggtatttactgaacatctaacttatgcccaacactgtgctgagagatatgagataaccatgaatagtacaaaagcaatccctgcccttgaagagcaaacagccaaatatcaggagacaggtaacacacaaggaaatgtacaagaaagttgagccagcacttttataagtactggttctagtactagctttcataagaaagtactggttctagtactagctttcagtactctcttgtgaaattttcaatattcagtcatttcaacctcaaaaatggcaacataattatgtttcaacataattgttgttttaaacaaacaattttgtttcaacataattctcctgaactgggtggaaggctatcaagaaaaagcttagcttcttcttcaggtaactgcaagagacagggttctctagagaaacagaacaaatatacaaagagattcattataaggaattggaagtccaaaatctccagagcctctgtacttgtacaagtctgaaggccgacaggcaggagaattctctctttttggggcaaaggtcagtgttttgttctatccaggctttcagatgattggttgaggctcactcacattagaagggcaatctgtcttactgccattagaatgcaacctgttttacttagcttactgatttcaatgttaatctatttcaagagcaccctcacagaaacacccagaataatgtttgatgaaatatctgggcaccctgtgacccagtcaagttgacacatgacactaaccatcacagtacgcttagggtcttgtcactcggagtgtggcctgtgaaccagcagcatttttatcttctgggagcttgggcacgatctcaggccccacctcctgcttattgattcagaatctgcattttaacaagatccccaggtgatctggatgcaccgtaacatctgagaagcactcaaactatgtgccgcaaacaaacgccaaattcttaggcatttgtgtggcttggagcacatagttggttctttctactgtctaattcattacattttttcagcacattcctgtctataaaatgtttttttgtatgcaccccaatatatgcacatttataagcatatgcatgaacccacgaacaatgattaggtacattatgaagcatacgtaaggacagaaatttcaaaccaagcttgagggtgaaataaatattatttgaaaacctgttgctaattgtgatgacttcatactatcattagttactatctcaatgcataatgtacagtgacgggtgaagtttatcattaataaaaaaaatctggattttaaccatt

SEQ ID NO: 181227 - DNA, 6724 bp, Homo sapiens
  Payload ID: 15693
  Gene Symbol: SHISA9
  Gene Name: shisa family member 9
  Uniprot ID: B4DS77
  ENST ID: ENST00000558583
  CDS Start-End: 446-1720
ctcttcagcgcacttggcgagctggtgaggtgagagggatactgcgagagggctaggggcggccagtccggggctgccggccaaggctaggcgctgccagcccgattctcctctgctctccacccccgcctcacccagtggccggccggacctgcaccccgcgcttgaccccgctcatcctccccccgcccggccgggcgcgctcctccccggccggcccctcggcgcgcggcgcgctggaggcgaacgcgggctgaggcgaacgcgggctgagccgagcgcagtggccgccgaccaccgagcgccccgcgccgctccctgcatgtgcggcccgcggcggctcgcagctcccggcagcagcctcggcagcttcggccgcgcctcgagaggcggccgcagaggctccagcggcggccgagcggccgagcccgggctgggagacaccatgcgccgcgtccttcggctgctcctcggttgcttcctcaccgagctgtgcgcccgcgtgtgccgggcgcaggagcgagcgggacacgggcagctggcgcaactgggcggcgtgttgctgctggcggggggcaaccgctccggggccgcctccggagaggccagcgagggcgctgaggcatcggacgcgcccccgacccgggcgcccacgccggacttctgccggggctacttcgatgtcatgggccagtgggacccgccgttcaactgcagctcgggcgacttcatcttctgctgcgggacttgtggcttccggttctgctgcacgtttaagaagcggcgactgaaccaaagcacctgcaccaactacgacacgccgctctggctcaacaccggcaagccccccgcccgcaaggacgaccccttgcacgaccccaccaaggacaagaccaacctgatcgtctacatcatctgcggggtggtggccgtcatggtgctcgtgggcatcttcaccaagctggggctggagaaagcgcaccggccccaaagggagcacatgtccagggcccttgcggatgtcatgagaccacagggccactgcaacactgatcacatggagagagacctaaacatcgttgtccacgtccagcattatgagaacatggacacgagaacccccataaataatcttcatgccacccagatgaacaacgcagtgcccacctctcctctgctccagcagatgggccatccacattcgtacccgaacctgggccagatctccaacccctatgaacagcagccaccaggaaaagagctcaacaagtacgcctccttaaaggcagtcggaagttctgatggtgactgggcagtatcgacacttaagtcaccaaaagctgacaaggtcaatgacgacttctacaccaagcgacggcacctggctgagctggctgccaaggggaacttacctctgcaccccgtaagagtggaggacgagccccgggccttcagccctgagcacggtcctgccaagcagaatggacagaagtcccgcaccaacaagatgcccccacatcccctggcctacacctctaccaccaactttaagggctgggaccccaacgagcagtccctccggcggcaggcttacagcaacaagggcaagcttggcacggccgagacaggctccagcgaccccttgggaactcgcccccagcactacccacccccacagccatacttcatcaccaacagcaaaacagaagtgactgtctgagctttcaccacagggagcaccctggagaccacactcaactgagagaggcaaaaaacaaccccgcccacaccctccccatcctcccctaatacatgcgtccacacactcactctcaacaagaaccaactctaaacctactggggacacagagtcgcgcttttcctaggtcatgcctgtaacgtgtcggcgggcagctgagaaagaccgaagcgtggacattcagcaatacagcaaaggggaaaatgaggcacactctttccacttcaggcccaagatggccaactcacatgcccaaaccgtggggctgagttttcttttcctcctaacttgaaactgaaatccatggtgacaaaatataaaagtagcacaatttagagaaattgtccatttgagcacatacactacttgccacgtgctgtctgtttctaggttcgaaagccagggtggaaatgggggtagagaatgagggaggacacaagagaagagtgtattctggaagaggagttgttctgggaggaatttgcccacattagaagcatttttctaattccaagaagtggtgacgtggacgtaaaattttgacgagcatgaaacagtaactggaccccaaccattctatttatagtacttttcatatcatccatgttgaaagcaaaaaacaacacaccctcaaactcacagaaagtaaatagaccctgaacccaccgacaatgatgggaaggaaaaaacaaaaaacaaaaaacattttagagaactcccataaggaccatgaccgtggaaatgggagggatgggcttttacggagagggtccggagagtatcaaataactttttaaaaagaggattaaaatgtaagcccactacaaaacagataaaaacggcaaattaggtgttttttttttttcaaaaatcttgaagacttgttgacattaacaacaacaaatccacagttggaaaagtccacaggagatcagatgaggatccagaagcctctgatttctgggttttgcctccaagacctgaaacagccacagaaacaagtcctctataaactgtatgtccctgacatccctttcccttcagcgcgttgccgccgccgctgccaaacttcaactgctttggactgaaaatgtcataagcgtgggtggtgccttcaatgtgttactgttgtttaatgacagtcttgtttcccaagtgcaacctgtgttcttttagccttccttcctcttctttttctgcagtagtagaagatgtttccatccttcctttgtaggtgagcccaccccataacaccctctgaggggctgctacaatgtcaggggtacccaagaacgaagacctccctactctctacactatcaaaattagtccttccattttctagccctctcaaacctgtcagatgtttcttggtcccgtaattcccatggtccctccaaattacctccccacatacttcatgtgttcatctcccatccagaatgtcctgaggttgtttttctggttggttctcataatccatagtccttggggtcccagcaaagtcagttttcctacaagttgtgtttgttttgtggaagcccaaagaagtggattgagagagaagagatttttatctaaggtggaaggtttttcaactagcccctaaaggtctttggtagttaattaacattcaacagacccacagcaactctggtgtcagaagctataaatggtctggccaaacaagactcagagtattttctgaaatcctgagctgcaaggttctgcctcacctgtctctccactctgacatcacgaaatcagcaaaaccagatatttattctcctcactcccagcagatacgaggacaccaacaatgcagttgatccctctgggcctgagtctcccatctgaaacatggggaattggggtaggtcaagctttttgaaactgcaaaacctctacctgtttttaaaaatgagatcttttgaccaggcacagtggctcacacctaaaatcccagcactttgggaggctgaagcaggtggatcatctgaggtcaggagtttgagatcagcctggtcaacatggtgaaaccccgtctctactaaaaatacaaacattagctgggcatggtggtgggtgcctgtaatcccaactactcgagaggctgaggcaggagaatcgcttaaacttgggaggttgcagtgagctgagaccacaccactgccctctagcctgggtgacggagtgagactatctcaaaaaaaaaaaaaaaaagaaaaaaaaagagatctttcaaagaacgcataataggagatctccatgtataaaaaggtaccatgctgtacaaagctggggtcagagatttagtgcccaccttctcagcctccttgggaagaccccagagcttcccagagtcaagtaaataccactgggcatggtcagagtttccttgacgttaatgagctatgtacctgcaacacactttggcatctctgtatatcaccttcacaatatttgtatctaaattgattcattttaatgcattttgtttttaaaatgaaaacttcctgtcttcatcacaaatttaaaaaaaatcatcagttgccataaatagaaagcaaacataaaaataagtacaaaggaaacaagcagcgatgattaaattccagctggagtctgttgtctgtgagtctgaactaaagcctggggttctttctttctctctccatctctctgtttctgtttctctctctctcttaaaatgatatcatcaggtattaaataattgttaaaaataccagcacccaatgaagactttctctttgtactaataagatggaccaaaaagtaaatgaaaggggaatcatttcctatgcaagtcagtgttgaacaatgctgtagctatgtactgcctatgatcattgtgcatacactaggggtgcatagcccacacttcagaaaaccctgggttgacttatctgtgaggctctttccagctcaaagtttccataattcttatctcccttttacctcgtggttgctctttgcccccagtccacttcgtcccacccttatctcaactctgattaagagtctttcttggcctctaaatctgtagtattgtattccttctgcatgctccttctcctctgaataaacttcatcaattgaactgggctccttggggtctgcagttgtaattttggcagcaaaggtgcagactggtcattaagatgtagccacaatgatggcccaagaaggacacgtactttccaagtagtcctgtctaggatggaaagctcaggaagtgcttcatagtttattatcttccagttggttttgggagatgaactgaagagggaagtttggatagggaaggtctttttattcttttttttttaatgtatccatggagtatttattattattattattattattattattattattatactttaagttttagggtacatgtgcacaatgtgcaggttagttacatatgtatacacgtgtcatgctggtgtgctgcacccattaactcgtcatttagcattagctatatctcctaatgctatccctcccccctccccccaccccacaacagtccccagagtgtgatgttccccttcttgtgtccatgtgttctcattgttcaattcccatctatgagtgagaacatgcagtgtttggtttttttgtccttgcgatagtttactgagaatgatgatttccaatttcatccatgtccctacaaaggacatgaactcatcattttttatggctgcatagtattccatggtgtatatgtgccacattttcttaatccagtctatccttgttggacttttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccagcagtgtaaaagtgttcctatttctccacatcctctccagcacctgttgtttcctgactttttaatgattgccattctaactggcgtgagatggtatctcattgtggttttgatttgcatttctctgatggccagtgatgatgagcattttttcatgtgtcttttgactgcataaatgtcttttgagaagtgtctgttcatatccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttcctcttgggagggtagacagacctcacaatatggaaagacgggacaacctatggaactatctgtgacttccatgtaccaagacaaggacgctatagctagggtagtgagacctagaagagagaaaccagaacaaagcagacaggctgtcctcttcctaattccatgccctgacatcagcccctattttttgcctttagctgtcccccagtttccaacccaatgggaccagagtctgacttccctttgccctttcacagtgtctcagcctccatctgccttgggctccgcctggcctccccatctaactcttcccagttttttgtgtaaatggagcatattttatgtgcgaatattttagtaaccgtatgttctgcaagtaaacctgtgttaatacttgtcaacaactgcagagtttatgatacgaataattcttcctacaatgaagaaaaaaacacatttgtttgttttctaagaatgtttatttgtaaacatatgtattcactatattaatatgaatttcttacctggcaataaaactgattatatg

SEQ ID NO: 181228 - DNA, 3691 bp, Homo sapiens
  Payload ID: 15694
  Gene Symbol: SHOC2
  Gene Name: SHOC2 leucine-rich repeat scaffold protein
  Uniprot ID: Q9UQ13
  ENST ID: ENST00000265277
  CDS Start-End: 235-1845
gaactctaatgaatcattgattgaccagcactattttaccagttggaatgaatgatcagaaatgggcatagtgcttttagatccaacatgtaacagatggatgttactccatgctgattacttcttcaagccagtacttttttgattgtgtaggatctttgtctcttcatctttgaattcaattactggaaaataaaaggagttcatgtagtttttgtccaggcttgagtcaccatgagtagtagtttaggaaaagaaaaagactctaaagaaaaagatcccaaagtaccatcagccaaggaaagagaaaaggaggcaaaagcctctggaggttttgggaaagagagcaaagaaaaagaacctaagaccaaagggaaagatgccaaagatggaaagaaggactccagtgctgcccaaccaggggtggcattttcagttgacaatacgatcaaacggccaaacccagcacctgggactagaaaaaaatccagcaatgcagaggtgattaaagagctcaacaaatgccgggaagagaattcaatgcgtttggacttatccaagagatctatacacatattgccatcatcaatcaaagagttgactcaattaacagaactttatttatacagtaacaaattgcagtccctcccagcagaggtgggatgtttagtaaatctcatgacactggctctaagtgaaaattcacttaccagtttgcctgactctcttgataacttgaagaagctgcggatgcttgatttacggcataataaactgagagaaattccttcagtggtgtataggctggattctctcaccactctttaccttcgctttaatcgtataactactgtggaaaaggacatcaaaaacttgtcaaaactcagcatgcttagcattcgagagaacaaaattaaacaactacctgctgaaattggaaacctgtccagtttaagtcgtcttggtctgagatataacagactgtcagcaatacccagatcattagcaaaatgcagtgcacttgaagaattaaatttagagaacaataacatttctactttaccagagagtcttttatcaagtcttgtgaaactgaatagtttgaccttagctagaaattgcttccagttgtatccagtgggtggtccatctcagttttctaccatctattccctcaacatggaacacaatcgaatcaacaaaattccatttggaattttctccagagcaaaagtattaagtaagctgaatatgaaggacaatcagttaacatcacttcccttggattttggaacttggaccagtatggtagaattgaatttagccactaatcagctcacaaagatccctgaggatgtgtctggtctcgtttctcttgaggttcttatcttatcaaacaatcttctaaagaagcttccccatggtcttggaaaccttaggaagttaagagagttggatctagaagagaacaaattggaatccttgccaaatgaaattgcatatcttaaggatttacagaaattagtcttgacaaacaaccagttgaccactcttcccagaggcattggtcaccttactaatctcacacatctgggccttggagagaacctacttactcaccttcctgaagaaattggtacactggagaacctagaagaactgtatttgaatgacaaccccaacctgcatagccttccctttgagctggcactctgcagcaagctttcaatcatgagtattgagaactgtccactcagtcaccttccacctcagattgttgctggggggccttctttcatcattcagttcttaaagatgcagggtccatatcgtgccatggtctgatataaatctgctggtcccacacactgttcaaaaatagactgccattaatgtttcttatctatatctgtatctatttatgtagatattggtatatggcagatttataaaaattgcattatgtgtttctgctaatagaggaatcatagccatttagaattttttttaaattctgtacaaaaggcttatataagttttctttgctgaatttgatggatgtttttctgttgtgtaatctgatatgccagtttgcttaaaacatttgccaacacattatgaagttattaaatttaagggacagaggtagtatagttagatatactttctcttaggaaaaataatgggcaaaaatttttgttgcaacttttcatatatattttccccttaccaattgttttatccttatagtattgtaggccctgaaagtagaatttttctttaacttattttgagatttgagatttaaattttatgtattgtttacagtcagagtaaatcactggatttcttttgtttgttttgatttgctctgttttattcagtcaaatctagagtttgaatcctctgctaaagaatttgcatccactggtgtaaacagtgaaaggtatttgcttgttgaaaaaaaaaactggcaaagtgaaaagatacagtcaaaaatctagaatttctttaattttgcttctctgacgagttgtgaagcaaaatacctgaagtgagtctttgggtaggggaagggtattgagaccttttctagtatgaatattttttaagtttgggggaagagaaacttgcagtgaaaaggagttttttcattcctgaaagttgcagatccacaaaactaacaggataattgggcaaataaattacatataaacacacacaatctatatatgtatatacaatgctatatagatatgtatttattatatcataaactacagtaggtaactttaaggatttcttcctatccttgtacaatgacatgaatgtctttctttgaaaactgcaatgtatgtatgtttcaaggttatttaacagtgtactatggttttatatcttgacttgccttgtacatctttcaattctggaatatctgtgtctaagcacaatatcttcacactgtgctgtattgctgctgaactaaatgcacttttccccacatatggggcactggcttcaaacaattcagttcagtatcattacttttaatctcatctttcctttcttggtagttgttaatacagttatggaaaagaggcacattgcatagaagccattggggagttcagtggaagttctgtaagatgtgcatgtactatttgatgcgttttctttgcttcactgcttttaatacttagcagtattgttggtctaagtcaatttgattattgaggagtctcagagcaaggtgcgttctagatgtcatcctaaaaaacacttcatatataattaatcactattttgtataattacatattgctgcttgtgtgtttttttttttttccatttagttgggcgttgtgttttacacaaaaccatttttgaattaaggctatgatattaagatagaaatttggactgttgttctgcttttcctggcactcaaattcatgactagttttgaggtcaaacctatgttcgtaatgagagattttataaggatcaactaagaaatggaaggcaggtgaagatataaaaccctagaatgcttaaatgtgctgtaaaactattgtagatgtcactggattttaccaagtaatatcctttcttttttttttccccccatctgctgtggcttttcagttaaaattttgtttataaaaggaatttgtttattacagctctacct

SEQ ID NO: 181229 - DNA, 3943 bp, Homo sapiens
  Payload ID: 15694
  Gene Symbol: SHOC2
  Gene Name: SHOC2 leucine-rich repeat scaffold protein
  Uniprot ID: Q9UQ13
  ENST ID: ENST00000369452
  CDS Start-End: 346-2094
gggggaggggcgggcggggggcggcggttgggcagcgtcgcttcttaggaggaggaggaagaggaggaaggagggcgagcgaggaggatggcggagtcggggctcctgacggaactctaatgaatcattgattgaccagcactattttaccagttggaatgaatgatcagaaatgggcatagtgcttttagatccaacatgtaacagatggatgttactccatgctgattacttcttcaagccagtacttttttgattgtgtaggatctttgtctcttcatctttgaattcaattactggaaaataaaaggagttcatgtagtttttgtccaggcttgagtcaccatgagtagtagtttaggaaaagaaaaagactctaaagaaaaagatcccaaagtaccatcagccaaggaaagagaaaaggaggcaaaagcctctggaggttttgggaaagagagcaaagaaaaagaacctaagaccaaagggaaagatgccaaagatggaaagaaggactccagtgctgcccaaccaggggtggcattttcagttgacaatacgatcaaacggccaaacccagcacctgggactagaaaaaaatccagcaatgcagaggtgattaaagagctcaacaaatgccgggaagagaattcaatgcgtttggacttatccaagagatctatacacatattgccatcatcaatcaaagagttgactcaattaacagaactttatttatacagtaacaaattgcagtccctcccagcagaggtgggatgtttagtaaatctcatgacactggctctaagtgaaaattcacttaccagtttgcctgactctcttgataacttgaagaagctgcggatgcttgatttacggcataataaactgagagaaattccttcagtggtgtataggctggattctctcaccactctttaccttcgctttaatcgtataactactgtggaaaaggacatcaaaaacttgtcaaaactcagcatgcttagcattcgagagaacaaaattaaacaactacctgctgaaattggtgaattatgtaacctcattacgctggatgtagctcacaatcaacttgaacaccttccaaaggagattggaaactgtacacagataaccaaccttgacttgcagcacaatgaactgctagacctcccagatactataggaaacctgtccagtttaagtcgtcttggtctgagatataacagactgtcagcaatacccagatcattagcaaaatgcagtgcacttgaagaattaaatttagagaacaataacatttctactttaccagagagtcttttatcaagtcttgtgaaactgaatagtttgaccttagctagaaattgcttccagttgtatccagtgggtggtccatctcagttttctaccatctattccctcaacatggaacacaatcgaatcaacaaaattccatttggaattttctccagagcaaaagtattaagtaagctgaatatgaaggacaatcagttaacatcacttcccttggattttggaacttggaccagtatggtagaattgaatttagccactaatcagctcacaaagatccctgaggatgtgtctggtctcgtttctcttgaggttcttatcttatcaaacaatcttctaaagaagcttccccatggtcttggaaaccttaggaagttaagagagttggatctagaagagaacaaattggaatccttgccaaatgaaattgcatatcttaaggatttacagaaattagtcttgacaaacaaccagttgaccactcttcccagaggcattggtcaccttactaatctcacacatctgggccttggagagaacctacttactcaccttcctgaagaaattggtacactggagaacctagaagaactgtatttgaatgacaaccccaacctgcatagccttccctttgagctggcactctgcagcaagctttcaatcatgagtattgagaactgtccactcagtcaccttccacctcagattgttgctggggggccttctttcatcattcagttcttaaagatgcagggtccatatcgtgccatggtctgatataaatctgctggtcccacacactgttcaaaaatagactgccattaatgtttcttatctatatctgtatctatttatgtagatattggtatatggcagatttataaaaattgcattatgtgtttctgctaatagaggaatcatagccatttagaattttttttaaattctgtacaaaaggcttatataagttttctttgctgaatttgatggatgtttttctgttgtgtaatctgatatgccagtttgcttaaaacatttgccaacacattatgaagttattaaatttaagggacagaggtagtatagttagatatactttctcttaggaaaaataatgggcaaaaatttttgttgcaacttttcatatatattttccccttaccaattgttttatccttatagtattgtaggccctgaaagtagaatttttctttaacttattttgagatttgagatttaaattttatgtattgtttacagtcagagtaaatcactggatttcttttgtttgttttgatttgctctgttttattcagtcaaatctagagtttgaatcctctgctaaagaatttgcatccactggtgtaaacagtgaaaggtatttgcttgttgaaaaaaaaaactggcaaagtgaaaagatacagtcaaaaatctagaatttctttaattttgcttctctgacgagttgtgaagcaaaatacctgaagtgagtctttgggtaggggaagggtattgagaccttttctagtatgaatattttttaagtttgggggaagagaaacttgcagtgaaaaggagttttttcattcctgaaagttgcagatccacaaaactaacaggataattgggcaaataaattacatataaacacacacaatctatatatgtatatacaatgctatatagatatgtatttattatatcataaactacagtaggtaactttaaggatttcttcctatccttgtacaatgacatgaatgtctttctttgaaaactgcaatgtatgtatgtttcaaggttatttaacagtgtactatggttttatatcttgacttgccttgtacatctttcaattctggaatatctgtgtctaagcacaatatcttcacactgtgctgtattgctgctgaactaaatgcacttttccccacatatggggcactggcttcaaacaattcagttcagtatcattacttttaatctcatctttcctttcttggtagttgttaatacagttatggaaaagaggcacattgcatagaagccattggggagttcagtggaagttctgtaagatgtgcatgtactatttgatgcgttttctttgcttcactgcttttaatacttagcagtattgttggtctaagtcaatttgattattgaggagtctcagagcaaggtgcgttctagatgtcatcctaaaaaacacttcatatataattaatcactattttgtataattacatattgctgcttgtgtgtttttttttttttccatttagttgggcgttgtgttttacacaaaaccatttttgaattaaggctatgatattaagatagaaatttggactgttgttctgcttttcctggcactcaaattcatgactagttttgaggtcaaacctatgttcgtaatgagagattttataaggatcaactaagaaatggaaggcaggtgaagatataaaaccctagaatgcttaaatgtgctgtaaaactattgtagatgtcactggattttaccaagtaatatcctttcttttttttttccccccatctgctgtggcttttcagttaaaattttgtttataaaaggaatttgtttattacagctctacctaga

SEQ ID NO: 181230 - DNA, 2967 bp, Homo sapiens
  Payload ID: 15694
  Gene Symbol: SHOC2
  Gene Name: SHOC2 leucine-rich repeat scaffold protein
  ENST ID: ENST00000451838
  CDS Start-End: 1-1119
cttgataacttgaagaagctgcggatgcttgatttacggcataataaactgagagaaattccttcagtggtgtataggctggattctctcaccactctttaccttcgctttaatcgtataactactgtggaaaaggacatcaaaaacttgtcaaaactcagcatgcttagcattcgagagaacaaaattaaacaactacctgctgaaattggaaacctgtccagtttaagtcgtcttggtctgagatataacagactgtcagcaatacccagatcattagcaaaatgcagtgcacttgaagaattaaatttagagaacaataacatttctactttaccagagagtcttttatcaagtcttgtgaaactgaatagtttgaccttagctagaaattgcttccagttgtatccagtgggtggtccatctcagttttctaccatctattccctcaacatggaacacaatcgaatcaacaaaattccatttggaattttctccagagcaaaagtattaagtaagctgaatatgaaggacaatcagttaacatcacttcccttggattttggaacttggaccagtatggtagaattgaatttagccactaatcagctcacaaagatccctgaggatgtgtctggtctcgtttctcttgaggttcttatcttatcaaacaatcttctaaagaagcttccccatggtcttggaaaccttaggaagttaagagagttggatctagaagagaacaaattggaatccttgccaaatgaaattgcatatcttaaggatttacagaaattagtcttgacaaacaaccagttgaccactcttcccagaggcattggtcaccttactaatctcacacatctgggccttggagagaacctacttactcaccttcctgaagaaattggtacactggagaacctagaagaactgtatttgaatgacaaccccaacctgcatagccttccctttgagctggcactctgcagcaagctttcaatcatgagtattgagaactgtccactcagtcaccttccacctcagattgttgctggggggccttctttcatcattcagttcttaaagatgcagggtccatatcgtgccatggtctgatataaatctgctggtcccacacactgttcaaaaatagactgccattaatgtttcttatctatatctgtatctatttatgtagatattggtatatggcagatttataaaaattgcattatgtgtttctgctaatagaggaatcatagccatttagaattttttttaaattctgtacaaaaggcttatataagttttctttgctgaatttgatggatgtttttctgttgtgtaatctgatatgccagtttgcttaaaacatttgccaacacattatgaagttattaaatttaagggacagaggtagtatagttagatatactttctcttaggaaaaataatgggcaaaaatttttgttgcaacttttcatatatattttccccttaccaattgttttatccttatagtattgtaggccctgaaagtagaatttttctttaacttattttgagatttgagatttaaattttatgtattgtttacagtcagagtaaatcactggatttcttttgtttgttttgatttgctctgttttattcagtcaaatctagagtttgaatcctctgctaaagaatttgcatccactggtgtaaacagtgaaaggtatttgcttgttgaaaaaaaaaactggcaaagtgaaaagatacagtcaaaaatctagaatttctttaattttgcttctctgacgagttgtgaagcaaaatacctgaagtgagtctttgggtaggggaagggtattgagaccttttctagtatgaatattttttaagtttgggggaagagaaacttgcagtgaaaaggagttttttcattcctgaaagttgcagatccacaaaactaacaggataattgggcaaataaattacatataaacacacacaatctatatatgtatatacaatgctatatagatatgtatttattatatcataaactacagtaggtaactttaaggatttcttcctatccttgtacaatgacatgaatgtctttctttgaaaactgcaatgtatgtatgtttcaaggttatttaacagtgtactatggttttatatcttgacttgccttgtacatctttcaattctggaatatctgtgtctaagcacaatatcttcacactgtgctgtattgctgctgaactaaatgcacttttccccacatatggggcactggcttcaaacaattcagttcagtatcattacttttaatctcatctttcctttcttggtagttgttaatacagttatggaaaagaggcacattgcatagaagccattggggagttcagtggaagttctgtaagatgtgcatgtactatttgatgcgttttctttgcttcactgcttttaatacttagcagtattgttggtctaagtcaatttgattattgaggagtctcagagcaaggtgcgttctagatgtcatcctaaaaaacacttcatatataattaatcactattttgtataattacatattgctgcttgtgtgtttttttttttttccatttagttgggcgttgtgttttacacaaaaccatttttgaattaaggctatgatattaagatagaaatttggactgttgttctgcttttcctggcactcaaattcatgactagttttgaggtcaaacctatgttcgtaatgagagattttataaggatcaactaagaaatggaaggcaggtgaagatataaaaccctagaatgcttaaatgtgctgtaaaactattgtagatgtcactggattttaccaagtaatatcctttcttttttttttccccccatctgctgtggcttttcagttaaaattttgtttataaaaggaatttgtttattacagctctacctag

SEQ ID NO: 181231 - DNA, 5308 bp, Homo sapiens
  Payload ID: 15695
  Gene Symbol: SHTN1
  Gene Name: shootin 1
  Uniprot ID: A0MZ66
  ENST ID: ENST00000260777
  CDS Start-End: 626-2341
attgcgtcccgctctacctctgtggttctttgggagcgacccccgggaagcgtccaaagtggagttcccacacacgctgcgaacccacagccggttttctctgaactcgcgtccctgagtccgggaggtggaggcggagaaaagggtgcggagcgaccccacgcagggccgccccccctcccaccagcgcgtcctgccgcgccggcagccacaggctggcatagcggctgccgacccgccctcgttcctccaccccctgaacgggactgctgggcccgccccgccccgcctgcaggtgaagcggccgcagccgccgagtaggtgcgtggggatgatctcactcgcgcgctccgcgccaggaggaggaggagcgggagcggatccaacttccgggtagtggagccgcaagccaccggcatcttgctttttcttccccctcctcctgtgtgccccgcgccgctccctctttcccttttattcccggccccacccgccaaaatgaacagctcggacgaagagaagcagctgcagctcattaccagtctgaaggagcaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcagcctcccagtagcattggatgcaggaaaaaatacattgacggtgaaaaacaagccgaaccagttgtagttttagatcctgtttctacacatgaaccccaaaccaaagaccaggttgctgaaaaagatccaactcaacacaaggaggatgaaggcgaaattcaaccagaaaacaaagaagacagcattgaaaacgtgagagagacagacagctccaactgctgatccataaaccagaagcctgacatgtttggaagtccttttcaataagcacatgattagtgttgttatattggcaagggctgtagacattctgctctggtcactgtattcagaatacaggttcttttctggtgtcacttttgtaagtagcaactataaacataagtaagctgtttagcaaaacacacattcctagtaggttttggttttttgatctttataaagatgaggtttttttcctagttactgtattaagtatgacttcttttagaaggttacaaaaaaattcagatgttgatacctttttaggaaatgtgcataccactcatcaaatggaatgctgaaagtttgaggtgcttgtatataatcggataaacaaaactgatcaacccaatgtgattttaaaagcccccaaagaagcttctgttttgggtctgatcctcttgatggagaaactgcagcagcatggaaattgttgggtactgtggcatacaagttattttctacagtagactgagataaactgaaaactcaggagctggcatcaaactcgtagtcccatagtcagtgttaattacacacattgttaactattggatgaaaaatacatgctattgattgtgtccaaagcctcccgaggacctccgtggggatgctctggtagcctgaatacagaactgaggtgaaagtccaaaccttgaattttacagtagtaagttggtaaaccatgtgctctgtgctatgagttaattatgttttcccaaatactaatgtggcacaagtaccatattttatcagagttcttatgtacagtatggtgaagataagtgacaagcacacatttttcttgcttcactgctgttctatattacacaggtttgttgttgttttttttaaaaaagaaattaagcagtagttagtctctaaaaatacaatgtttcaggctaccacagtgaataaatagaaatgtaatcagggattaaaaaaaaaacttatgcagcttttcaaagttgattgtttcaaaattggtgtttatttaaaataagtggtaatgtacttgaatgcactttttatgacaatgattcagtaatggtaattttactattaaagaaagtgaaaggtttagttttgttagcatggctcagcatgtagctgtcaggtgtttttcacctaagggcaaaagaaaatgatagtaataattgcagtagttgtattgtattgtatttttgcacgtgtggtaagcataggcttgaagaggtgggtaggcaggtacatgtacttcctaaatttggagataattatctttctgtaagttcgttatgcttgactgtttccatgttctcccaataatgattttatagttacttatcactttactcatggagaattaaaacgtaatgtttttcaactgtatctttctttaactggataatactgctatatgatatgcttactacagactgcattaattcacgaaacgaattctgttatgctgtaatttgaactctcctcaccacaacttattaaaaaggcaccaatagtttcccattaagggtcagttgtggttattattaacgtttctggtttagttccccaagcttgacattctttaatagaaaattgtatatgatttgacaactttagtaatttttaatagtccctaagatggtttattgagttttctttcatgtttctttgtgctgtcttccttcttgcatctgtgatctgtctgccagcatgcaactcacacacatttaggaatataaaaatatgtacactgtctttccatatttcatcacaccatcacagaataatatggttatcaaaataccctcctttctagagtaagaagttgccctttgggtgaaatgtgttagctggactagggaacaattagtaacaggtattttgaaagtattcctgccttttttaagctgcttactttctctcactgtgattacaaagcattttaaattaatttgacatgaaggtatttgatggaagatattcactcacctttttctgcctacagtttttcccttttcactttggttttgagggggttttgcccctggctggggtgacactgtcaaccaaagcaagggatcccaaataggaagacataggagaaccgtgcttatatctgcaaggtatgttcatagctattgcacacacaaaacttacatacgtcctgcttacacaattttaagttggaaaagactgcatctttatgtttttgatttctctaaaaggttatttatgcttccttctgtttgggaaagataaattaagtcttgtgcgctatagaggattttttttctttaagaaaaacgaatgttgatgcattttatagcccgagtgaggaacagagatagaggtactttgtgccattgctattaaagaaaaagaaaatgtctctttttttttctggaagaataagattttaattaaagcacttgcacccttttgtatgtgagctggtctcaaacaaagtcctcacccacagcagtttcagcagctgaacagtcccatggaagttctgactggcaggcatcaacagggctattagcacccagcatagtttgccctgagtacggaggatggatgctttggctctaactactcaccaataattgctccttccttaccttctttgttaatggtaaactgctggaaatggagtagtacaggtaacaattatttttaattgtctttccagaccagtttttggttgtgtgttcagtaaatgatagtctgtatcacagccttcaagtctggattatttttctaaatgcatactctacctgttcagttacactcgttgtggaacaacattagcttatataccagtaagttgtcgagaatggataaccatctgtcattatcactgaccttcaaagactcatcaagcagtccctgcataaggattggagtggtttgaagtttctcttccaagcactaacatgtccc

SEQ ID NO: 181232 - DNA, 5361 bp, Homo sapiens
  Payload ID: 15695
  Gene Symbol: SHTN1
  Gene Name: shootin 1
  Uniprot ID: A0MZ66
  ENST ID: ENST00000355371
  CDS Start-End: 499-2394
attgcgtcccgctctacctctgtggttctttgggagcgacccccgggaagcgtccaaagtggagttcccacacacgctgcgaacccacagccggttttctctgaactcgcgtccctgagtccgggaggtggaggcggagaaaagggtgcggagcgaccccacgcagggccgccccccctcccaccagcgcgtcctgccgcgccggcagccacaggctggcatagcggctgccgacccgccctcgttcctccaccccctgaacgggactgctgggcccgccccgccccgcctgcaggtgaagcggccgcagccgccgagtaggtgcgtggggatgatctcactcgcgcgctccgcgccaggaggaggaggagcgggagcggatccaacttccgggtagtggagccgcaagccaccggcatcttgctttttcttccccctcctcctgtgtgccccgcgccgctccctctttcccttttattcccggccccacccgccaaaatgaacagctcggacgaagagaagcagctgcagctcattaccagtctgaaggagcaagcaataggcgaatatgaagaccttagagcagagaaccagaaaacaaaggagaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcagcctcccagtagcattggatgcaggaaaaaatacattgacggtgaaaaacaagccgaaccagttgtagttttagatcctgtttctacacatgaaccccaaaccaaagaccaggttgctgaaaaagatccaactcaacacaaggaggatgaaggcgaaattcaaccagaaaacaaagaagacagcattgaaaacgtgagagagacagacagctccaactgctgatccataaaccagaagcctgacatgtttggaagtccttttcaataagcacatgattagtgttgttatattggcaagggctgtagacattctgctctggtcactgtattcagaatacaggttcttttctggtgtcacttttgtaagtagcaactataaacataagtaagctgtttagcaaaacacacattcctagtaggttttggttttttgatctttataaagatgaggtttttttcctagttactgtattaagtatgacttcttttagaaggttacaaaaaaattcagatgttgatacctttttaggaaatgtgcataccactcatcaaatggaatgctgaaagtttgaggtgcttgtatataatcggataaacaaaactgatcaacccaatgtgattttaaaagcccccaaagaagcttctgttttgggtctgatcctcttgatggagaaactgcagcagcatggaaattgttgggtactgtggcatacaagttattttctacagtagactgagataaactgaaaactcaggagctggcatcaaactcgtagtcccatagtcagtgttaattacacacattgttaactattggatgaaaaatacatgctattgattgtgtccaaagcctcccgaggacctccgtggggatgctctggtagcctgaatacagaactgaggtgaaagtccaaaccttgaattttacagtagtaagttggtaaaccatgtgctctgtgctatgagttaattatgttttcccaaatactaatgtggcacaagtaccatattttatcagagttcttatgtacagtatggtgaagataagtgacaagcacacatttttcttgcttcactgctgttctatattacacaggtttgttgttgttttttttaaaaaagaaattaagcagtagttagtctctaaaaatacaatgtttcaggctaccacagtgaataaatagaaatgtaatcagggattaaaaaaaaaacttatgcagcttttcaaagttgattgtttcaaaattggtgtttatttaaaataagtggtaatgtacttgaatgcactttttatgacaatgattcagtaatggtaattttactattaaagaaagtgaaaggtttagttttgttagcatggctcagcatgtagctgtcaggtgtttttcacctaagggcaaaagaaaatgatagtaataattgcagtagttgtattgtattgtatttttgcacgtgtggtaagcataggcttgaagaggtgggtaggcaggtacatgtacttcctaaatttggagataattatctttctgtaagttcgttatgcttgactgtttccatgttctcccaataatgattttatagttacttatcactttactcatggagaattaaaacgtaatgtttttcaactgtatctttctttaactggataatactgctatatgatatgcttactacagactgcattaattcacgaaacgaattctgttatgctgtaatttgaactctcctcaccacaacttattaaaaaggcaccaatagtttcccattaagggtcagttgtggttattattaacgtttctggtttagttccccaagcttgacattctttaatagaaaattgtatatgatttgacaactttagtaatttttaatagtccctaagatggtttattgagttttctttcatgtttctttgtgctgtcttccttcttgcatctgtgatctgtctgccagcatgcaactcacacacatttaggaatataaaaatatgtacactgtctttccatatttcatcacaccatcacagaataatatggttatcaaaataccctcctttctagagtaagaagttgccctttgggtgaaatgtgttagctggactagggaacaattagtaacaggtattttgaaagtattcctgccttttttaagctgcttactttctctcactgtgattacaaagcattttaaattaatttgacatgaaggtatttgatggaagatattcactcacctttttctgcctacagtttttcccttttcactttggttttgagggggttttgcccctggctggggtgacactgtcaaccaaagcaagggatcccaaataggaagacataggagaaccgtgcttatatctgcaaggtatgttcatagctattgcacacacaaaacttacatacgtcctgcttacacaattttaagttggaaaagactgcatctttatgtttttgatttctctaaaaggttatttatgcttccttctgtttgggaaagataaattaagtcttgtgcgctatagaggattttttttctttaagaaaaacgaatgttgatgcattttatagcccgagtgaggaacagagatagaggtactttgtgccattgctattaaagaaaaagaaaatgtctctttttttttctggaagaataagattttaattaaagcacttgcacccttttgtatgtgagctggtctcaaacaaagtcctcacccacagcagtttcagcagctgaacagtcccatggaagttctgactggcaggcatcaacagggctattagcacccagcatagtttgccctgagtacggaggatggatgctttggctctaactactcaccaataattgctccttccttaccttctttgttaatggtaaactgctggaaatggagtagtacaggtaacaattatttttaattgtctttccagaccagtttttggttgtgtgttcagtaaatgatagtctgtatcacagccttcaagtctggattatttttctaaatgcatactctacctgttcagttacactcgttgtggaacaacattagcttatataccagtaagttgtcgagaatggataaccatctgtcattatcactgaccttcaaagactcatcaagcagtccctgcataaggattggagtggtttgaagtttctcttccaagcactaacatgtccc

SEQ ID NO: 181233 - DNA, 2190 bp, Homo sapiens
  Payload ID: 15695
  Gene Symbol: SHTN1
  Gene Name: shootin 1
  Uniprot ID: A0MZ66
  ENST ID: ENST00000392901
  CDS Start-End: 469-1965
gcgtgctaggaggcgaggcgaggggcatgcgtgctaggaggcgaggcgaggggcatgcgtgctaggaggcgaggcgaggggcatgcgtgctaggaggcgaggcgaggggcatgcgtgctaggaggcgaggcgagggccaggtgctagggctagaaaggaggcagggctggcgctctagggactcctggagctctcctcctgtgagcctggacccggcacctcacgcagcccatctcccacagcttccgtcgacggaggccggggcctcaccaggaaagtggtttgccctccaatcagtggtctgccttcattttccagattgatgaagtctgcctcagagaaggggcaataggcgaatatgaagaccttagagcagagaaccagaaaacaaaggagaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcaataatctgaatcagaaaatactgcaactccttcctccttttgtctgccttttgttctccaaaagtaagtggaaattacatttccaagaaaggaaatgaaataattgcaggcccaaggtctgcaaaatatgtgttgaattgacagtgaaaaggatccatgtgttgacagacacagttgttagatgccataaaggcagatgtgaagctcaatttatttctcatcttgcttg

SEQ ID NO: 181234 - DNA, 2400 bp, Homo sapiens
  Payload ID: 15695
  Gene Symbol: SHTN1
  Gene Name: shootin 1
  Uniprot ID: A0MZ66
  ENST ID: ENST00000392903
  CDS Start-End: 499-2175
attgcgtcccgctctacctctgtggttctttgggagcgacccccgggaagcgtccaaagtggagttcccacacacgctgcgaacccacagccggttttctctgaactcgcgtccctgagtccgggaggtggaggcggagaaaagggtgcggagcgaccccacgcagggccgccccccctcccaccagcgcgtcctgccgcgccggcagccacaggctggcatagcggctgccgacccgccctcgttcctccaccccctgaacgggactgctgggcccgccccgccccgcctgcaggtgaagcggccgcagccgccgagtaggtgcgtggggatgatctcactcgcgcgctccgcgccaggaggaggaggagcgggagcggatccaacttccgggtagtggagccgcaagccaccggcatcttgctttttcttccccctcctcctgtgtgccccgcgccgctccctctttcccttttattcccggccccacccgccaaaatgaacagctcggacgaagagaagcagctgcagctcattaccagtctgaaggagcaagcaataggcgaatatgaagaccttagagcagagaaccagaaaacaaaggagaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcaataatctgaatcagaaaatactgcaactccttcctccttttgtctgccttttgttctccaaaagtaagtggaaattacatttccaagaaaggaaatgaaataattgcaggcccaaggtctgcaaaatatgtgttgaattgacagtgaaaaggatccatgtgttgacagacacagttgttagatgccataaaggcagatgtgaagctcaatttatttctcatcttgcttg

SEQ ID NO: 181235 - DNA, 6730 bp, Homo sapiens
  Payload ID: 15695
  Gene Symbol: SHTN1
  Gene Name: shootin 1
  Uniprot ID: A0MZ66
  ENST ID: ENST00000615301
  CDS Start-End: 287-1657
aggctggcatagcggctgccgacccgccctcgttcctccaccccctgaacgggactgctgggcccgccccgccccgcctgcaggtgaagcggccgcagccgccgagtaggtgcgtggggatgatctcactcgcgcgctccgcgccaggaggaggaggagcgggagcggatccaacttccgggtagtggagccgcaagccaccggcatcttgctttttcttccccctcctcctgtgtgccccgcgccgctccctctttcccttttattcccggccccacccgccaaaatgaacagctcggacgaagagaagcagctgcagctcattaccagtctgaaggagcaagcaataggcgaatatgaagaccttagagcagagaaccagaaaacaaaggagaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggcctcccagtagcattggatgcaggaaaaaatacattgacggtgaaaaacaagccgaaccagttgtagttttagatcctgtttctacacatgaaccccaaaccaaagaccaggttgctgaaaaagatccaactcaacacaaggaggatgaaggcgaaattcaaccagaaaacaaagaagacagcattgaaaacgtgagagagacagacagctccaactgctgatccataaaccagaagcctgacatgtttggaagtccttttcaataagcacatgattagtgttgttatattggcaagggctgtagacattctgctctggtcactgtattcagaatacaggttcttttctggtgtcacttttgtaagtagcaactataaacataagtaagctgtttagcaaaacacacattcctagtaggttttggttttttgatctttataaagatgaggtttttttcctagttactgtattaagtatgacttcttttagaaggttacaaaaaaattcagatgttgatacctttttaggaaatgtgcataccactcatcaaatggaatgctgaaagtttgaggtgcttgtatataatcggataaacaaaactgatcaacccaatgtgattttaaaagcccccaaagaagcttctgttttgggtctgatcctcttgatggagaaactgcagcagcatggaaattgttgggtactgtggcatacaagttattttctacagtagactgagataaactgaaaactcaggagctggcatcaaactcgtagtcccatagtcagtgttaattacacacattgttaactattggatgaaaaatacatgctattgattgtgtccaaagcctcccgaggacctccgtggggatgctctggtagcctgaatacagaactgaggtgaaagtccaaaccttgaattttacagtagtaagttggtaaaccatgtgctctgtgctatgagttaattatgttttcccaaatactaatgtggcacaagtaccatattttatcagagttcttatgtacagtatggtgaagataagtgacaagcacacatttttcttgcttcactgctgttctatattacacaggtttgttgttgttttttttaaaaaagaaattaagcagtagttagtctctaaaaatacaatgtttcaggctaccacagtgaataaatagaaatgtaatcagggattaaaaaaaaaacttatgcagcttttcaaagttgattgtttcaaaattggtgtttatttaaaataagtggtaatgtacttgaatgcactttttatgacaatgattcagtaatggtaattttactattaaagaaagtgaaaggtttagttttgttagcatggctcagcatgtagctgtcaggtgtttttcacctaagggcaaaagaaaatgatagtaataattgcagtagttgtattgtattgtatttttgcacgtgtggtaagcataggcttgaagaggtgggtaggcaggtacatgtacttcctaaatttggagataattatctttctgtaagttcgttatgcttgactgtttccatgttctcccaataatgattttatagttacttatcactttactcatggagaattaaaacgtaatgtttttcaactgtatctttctttaactggataatactgctatatgatatgcttactacagactgcattaattcacgaaacgaattctgttatgctgtaatttgaactctcctcaccacaacttattaaaaaggcaccaatagtttcccattaagggtcagttgtggttattattaacgtttctggtttagttccccaagcttgacattctttaatagaaaattgtatatgatttgacaactttagtaatttttaatagtccctaagatggtttattgagttttctttcatgtttctttgtgctgtcttccttcttgcatctgtgatctgtctgccagcatgcaactcacacacatttaggaatataaaaatatgtacactgtctttccatatttcatcacaccatcacagaataatatggttatcaaaataccctcctttctagagtaagaagttgccctttgggtgaaatgtgttagctggactagggaacaattagtaacaggtattttgaaagtattcctgccttttttaagctgcttactttctctcactgtgattacaaagcattttaaattaatttgacatgaaggtatttgatggaagatattcactcacctttttctgcctacagtttttcccttttcactttggttttgagggggttttgcccctggctggggtgacactgtcaaccaaagcaagggatcccaaataggaagacataggagaaccgtgcttatatctgcaaggtatgttcatagctattgcacacacaaaacttacatacgtcctgcttacacaattttaagttggaaaagactgcatctttatgtttttgatttctctaaaaggttatttatgcttccttctgtttgggaaagataaattaagtcttgtgcgctatagaggattttttttctttaagaaaaacgaatgttgatgcattttatagcccgagtgaggaacagagatagaggtactttgtgccattgctattaaagaaaaagaaaatgtctctttttttttctggaagaataagattttaattaaagcacttgcacccttttgtatgtgagctggtctcaaacaaagtcctcacccacagcagtttcagcagctgaacagtcccatggaagttctgactggcaggcatcaacagggctattagcacccagcatagtttgccctgagtacggaggatggatgctttggctctaactactcaccaataattgctccttccttaccttctttgttaatggtaaactgctggaaatggagtagtacaggtaacaattatttttaattgtctttccagaccagtttttggttgtgtgttcagtaaatgatagtctgtatcacagccttcaagtctggattatttttctaaatgcatactctacctgttcagttacactcgttgtggaacaacattagcttatataccagtaagttgtcgagaatggataaccatctgtcattatcactgaccttcaaagactcatcaagcagtccctgcataaggattggagtggtttgaagtttctcttccaagcactaacatgtccctatcccacagtcattttaatttggtatgtgactgtttctttcatttctttcacagataatattatatatacagttatataaatatatttcatattaaatgttatataacacaagagagagaaagtataagtagaaagagtgcctagcaccctaagaaatttaaattaaaatgctaattatccattggtgagtgcagtctcgaggataggtgagtaaactgctctgtgttgaagtcacactgctgacctggttattgtaataaatcacctctttggttaatttaatttagttattttgttattcattgtacatttttgctctggttttagtaatttaattataatttatatcactgttccagggcatagtctcatgatgtgtgtgtgtgtgtgtgtgtgtgtgtgtgtatttttcaaagggtatgtgaacacccagtcatgtttgttctgcctttcaaatgaattttccttccagtttctcctacccgttgcttgttgctaagcatcaggagaggcagtagcagccacaaactgtgacacagttcttccaacttagagtgataccaaccaagtctcctgcatgctctgagagagtctgcgcctgagccagtttcaaatcatagctttgagaataaagagttggctctgttatgaggaaattaaggtcccttgttagtactctttaaaaggagaggtcctcagtgtgcttaataaaaattatagaatttgtcagaagtctaaacttagccaactcccctacaggtcagtacatagcaatttatataatttttaggagaagcaaatggtaaccattttaacgagaccctaaatcatataaagtggttggatattattatatctatatgtttgtgtctgaatatatttatttctgctactcctctgctataatcccaacactggcttacaaaagagcaattcaggcaatggatatgtcacatcattttttttttttttttttatcacttgcggattgctttttaaatgctgtggtatgaataactgggcatttaataaccttgagaatattaattcatttactgatgtgcttattcatttatactcattcttactccaaaaaggatctaagaagactcgcaaagataaaaataatacaagaaaaactaaaatttaaaaaggagagggaattaggaaaaaaggaatcaagggtaggaaagtgagatgaaattggctcttacaaaaaatggtgatgctctcacacttctacgtgaggttggttacaaaaatgtgtcagtgcttttcagcacagacatgtagaataaacacagaagatggacatctgttcccagcacagagagcttctagggtcattaggtttttgttctcagagatattctgattggtaaaggatggggtgtttgactgagtgtggagttggcaacaaaaatattggcctcttttactggagcgtgtccctgaaaaatggacaggagagctaatagacaaacaaaatccacatggaagtgtggtggctgcaaaacgaagttcacagaatttcaggcaaaaacatcatatatgtaatttaccaaacagtggaattagaagaataaaaaccacaagagttggtgaagttgaagaggaaactccatgtggagacacggcgccgtacttcagacctcccggtctactaatactgatggtgtggctggaacctggggtgtgtacagccctatccagaggatgctcctgtttcggctgattcctctacaccttgtgtggggaaggtgggcaccagcggctccctagccgcagcagcctcaagtgcctccgcagccttttcagcttcctcattaaagtaaaaaaaagtgtgttcttctttgaaacctatttaaagtaacaataaagtttactgtctaa

SEQ ID NO: 181236 - DNA, 1840 bp, Homo sapiens
  Payload ID: 15696
  Gene Symbol: SDR16C5
  Gene Name: short chain dehydrogenase/reductase family 16C, member 5
  Uniprot ID: Q8N3Y7
  ENST ID: ENST00000303749
  CDS Start-End: 639-1568
gccgcacccactcctgcccctgcctgcaccccacccacttcccggggacttccgagcccacgcccacatcctttacctccaaggggcaaggaagctgttgacttaagatcccatgtggagcagtcagatgctgctggagaactccccgcactgcaggctccagacacacgacctggcccctcccccgtggacgcctatactgctctgttctctaattccagggttcccaacctcggggttgtgccttgcaaatacctgggaaacttttctagctaatgcctaggcccctaccaacccagaaattcccatctaataatctagggtacagcctaggcattgaaacgttaagcctaagagaaatccggcgcacgcatccagtttccaccaccgaatttccagcttcttaaatctgcaggtccagaaaaagaagatgggagtgctgcccacgtcgcgcactggggctacggccggccccacccctggcgctgccgcggcagtcccgcccttggacttgggcggcgcctggataaacacctgaacctgactgagctccgagccagggactcgggtgcctggggcagacgaggccggcttctccgcggacagctagggagagtgtcctgggtgtcagccagaacatgtctttcaacctgcaatcatcaaagaaactgttcattttcttaggaaaatcactgtttagtcttctggaggctatgatttttgccttactcccaaagccacggaagaacgttgctggtgaaatagtcctcatcacaggtgctggaagtggactcggaaggctcttagccttgcagtttgcccggctgggatctgttcttgttctctgggatatcaataaggaggggaatgaggaaacatgtaagatggctcgggaagctggagccacaagagtgcacgcctatacctgcgattgcagccaaaaggaaggagtgtatagagtagccgaccaggttaaaaaagaagtcggcgatgtttccatcctaatcaacaatgccggaatcgtaacaggcaaaaagttccttgactgtccagatgagcttatggaaaagtcatttgatgtgaatttcaaagcacatttatggacttataaagcctttctacctgctatgattgctaatgaccatggacatttggtttgcatttcaagttcagctggattaagtggagtaaatgggctggcagattactgtgcaagtaaatttgcagcctttgggtttgctgaatctgtatttgtagaaacatttgtccaaaaacaaaaggggatcaaaaccacgattgtgtgccccttttttataaaaactggaatgtttgaaggttgtactacaggctgtccttctctgttgccaattctggaaccaaaatatgcagttgaaaaaatagtagaagctattctacaagaaaaaatgtacttgtatatgccaaagttgttatacttcatgatgtttcttaaaagctttttgcccctcaagacaggactgcttatagctgactatttgggcatccttcatgcaatggatggctttgttgaccaaaagaagaagctctaaagaccaactctatggctaaggtcatctgatacacagtgttacataatgcgtacttcaatgaagaaaagtatttttgtctgacagtggaatatatctggagaccacaagtaccactcctattctgttatctggactagaattttcaatcaatgtgtttgaaaataatgttgctatcacctatttggttgagttttggttttttctttttctttttttttccaaaaataaagacagcccatttttgtcatttccattaccacagatgtaagaaa

SEQ ID NO: 181237 - DNA, 2399 bp, Homo sapiens
  Payload ID: 15696
  Gene Symbol: SDR16C5
  Gene Name: short chain dehydrogenase/reductase family 16C, member 5
  Uniprot ID: Q8N3Y7
  ENST ID: ENST00000396721
  CDS Start-End: 132-929
ggacttgggcggcgcctggataaacacctgaacctgactgagctccgagccagggactcgggtgcctggggcagacgaggccggcttctccgcggacagctagggagagtgtcctgggtgtcagccagaacatgtctttcaacctgcaatcatcaaagaaactgttcattttcttaggaaaatcactgtttagtcttctggaggctatgatttttgccttactcccaaagccacggaagaacgttgctggtgaaatagtcctcatcacaggtgctggaagtggactcggaaggctcttagccttgcagtttgcccggctgggatctgttcttgttctctgggatatcaataaggaggggaatgaggaaacatgtaagatggctcgggaagctggagccacaagagtgcacgcctatacctgcgattgcagccaaaaggaaggagtgtatagagtagccgaccagacttataaagcctttctacctgctatgattgctaatgaccatggacatttggtttgcatttcaagttcagctggattaagtggagtaaatgggctggcagattactgtgcaagtaaatttgcagcctttgggtttgctgaatctgtatttgtagaaacatttgtccaaaaacaaaaggggatcaaaaccacgattgtgtgccccttttttataaaaactggaatgtttgaaggttgtactacaggctgtccttctctgttgccaattctggaaccaaaatatgcagttgaaaaaatagtagaagctattctacaagaaaaaatgtacttgtatatgccaaagttgttatacttcatgatgtttcttaaaagctttttgcccctcaagacaggactgcttatagctgactatttgggcatccttcatgcaatggatggctttgttgaccaaaagaagaagctctaaagaccaactctatggctaaggtcatctgatacacagtgttacataatgcgtacttcaatgaagaaaagtatttttgtctgacagtggaatatatctggagaccacaagtaccactcctattctgttatctggactagaattttcaatcaatgtgtttgaaaataatgttgctatcacctatttggttgagttttggttttttctttttctttttttttccaaaaataaagacagcccatttttgtcatttccattaccacagatgtaagaaagtgataagccatggccatgagctgccctgagctttggtcgttggggaggtggctcaaatggagccagcggctgtggttgacctgccttggggagcagggctgaggggcgaagaggacatgtggatatccagccagaatgccctctctccagaggacacacagctctggatttctacccccttgctatcctctctggccattttgaacctgtaccacctaatgtagaaaaggcccgcctccagtgcccttctttccaaaacagctacacaaatgcttctgaatgccctggatacgcagaccgagtggcagtctggctaaaggcccatccagcactattgtgcccaagagccttaccgggcattccctgaagccccctcataggcagtgatcctagaccaaactcttaaatagaatcacttttgtttcctagaagagatcaaagagtggttgcttcttactttgaagatgaaattataccaagttaggttttttgctatctattgatccaaaaaatatattcgtgcaattaaagttaagtgttcaacttagtatttcaagttgggattcaggttgaggcattttcctgcagaatgggcaattttatgcatttatattcatcagtgctgccctcactttggatctattgtattcttacagtttaatcaactggcaaagtgctttcatgctttggagattaactataaaagcaagattaagaaaaatatgttaattaccatatccctggaactccttctcaggctggtgggggcagccttgcaagagaaacagcagcctttgtctcttccctcttgtggggagcaaggaggggatgagcggtaccttgggagacccggtaaaagtctaaagaattgagaatttgactatcttgggggtaaaatgctgtcataggggcagcagtctcagggggtgtaaactctggaatccactatggtttaccttgagtggcctgcacgaacatgacagccctgatctgtatttcctttccattcagaaaaccttaaaaaaaaaaaacttgttttatgataatattataacaatcataactaacatttactgtgcccggcagcaaattaagtatttgacaaacattatttcattaaacgagactgtcaatcattactcaaagaatgatgaaggtatttggtgtatgccaaagaataaaggcgttttatttcac

SEQ ID NO: 181238 - DNA, 1988 bp, Homo sapiens
  Payload ID: 15696
  Gene Symbol: SDR16C5
  Gene Name: short chain dehydrogenase/reductase family 16C, member 5
  ENST ID: ENST00000522671
  CDS Start-End: 733-1689
agagtgcctggtgactcttacgctagcctcatttctcggcttcatcttgttagaacaaatttcctcgccctcttctcctaggccgcctgccagcgccgcacccactcctgcccctgcctgcaccccacccacttcccggggacttccgagcccacgcccacatcctttacctccaaggggcaaggaagctgttgacttaagatcccatgtggagcagtcagatgctgctggagaactccccgcactgcaggctccagacacacgacctggcccctcccccgtggacgcctatactgctctgttctctaattccagggttcccaacctcggggttgtgccttgcaaatacctgggaaacttttctagctaatgcctaggcccctaccaacccagaaattcccatctaataatctagggtacagcctaggcattgaaacgttaagcctaagagaaatccggcgcacgcatccagtttccaccaccgaatttccagcttcttaaatctgcaggtccagaaaaagaagatgggagtgctgcccacgtcgcgcactggggctacggccggccccacccctggcgctgccgcggcagtcccgcccttggacttgggcggcgcctggataaacacctgaacctgactgagctccgagccagggactcgggtgcctggggcagacgaggccggcttctccgcggacagctagggagagtgtcctgggtgtcagccagaacatgtctttcaacctgcaatcatcaaagaaactgttcattttcttaggaaaatcactgtttagtcttctggaggctatgatttttgccttactcccaaagccacggaagaacgttgctggtgaaatagtcctcatcacaggtgctggaagtggactcggaaggctcttagccttgcagtttgcccggctgggatctgttcttgttctctgggatatcaataaggaggggaatgaggaaacatgtaagatggctcgggaagctggagccacaagagtgcacgcctatacctgcgattgcagccaaaaggaaggagtgtatagagtagccgaccaggttaaaaaagaagtcggcgatgtttccatcctaatcaacaatgccggaatcgtaacaggcaaaaagttccttgactgtccagatgagcttatggaaaagtcatttgatgtgaatttcaaagcacatttatggacttataaagcctttctacctgctatgattgctaatgaccatggacatttggtttgcatttcaagttcagctggattaagtggagtaaatgggctggcagattactgtgcaagtaaatttgcagcctttgggtttgctgaatctgtatttgtagaaacatttgtccaaaaacaaaaggggatcaaaaccacgattgtgtgccccttttttataaaaactggaatgtttgaaggttgtactacaggctgtccttctctgttgccaattctggaaccaaaatatgcagttgaaaaaatagtagaagctattctacaagaaaaaatgtacttgtatatgccaaagttgttatacttcatgatgtttcttaaaaggcttcatctggcacaggatgggtcagaatgcctgactgaggctatgtgggacagagcaaaggatcctggacaagcaattcgaaattcaggcttacgatcccactattcactaagtctgtgactctgagcgtgccctttattctccagctttttgcccctcaagacaggactgcttatagctgactatttgggcatccttcatgcaatggatggctttgttgaccaaaagaagaagctctaaagaccaactctatggctaaggtcatctgatacacagtgttacataatgcgtacttcaatgaagaaaagtatttttgtctgacagtggaatatatctggagaccacaagtaccactcctattctgttatctggactagaattttcaatcaatgtgtttgaaaataatgttgctatcacct

SEQ ID NO: 181239 - DNA, 1504 bp, Homo sapiens
  Payload ID: 15697
  Gene Symbol: SDR39U1
  Gene Name: short chain dehydrogenase/reductase family 39U, member 1
  Uniprot ID: Q9NRG7
  ENST ID: ENST00000399390
  CDS Start-End: 230-1189
agtcgctatgcgtgtgcttgtgggtgagggagggcagaaagggagagtgctgggcgggcttagtcggagattgaggactgggaatccgcttccgggagggcactgtctagtgcacaggcaacctggccttggcctcctagcccgagaagccgaatctccctaatccctgtgacctgtgtcacctctgcatcgcgaggagggggataagtggggagaagcctggtgtcagatgggatggcgccggaagagggtgccacagcggggacggaaggcgcccccaccccaactccacgggaatataaacaatttgtattttccgatcaggtggcgggacaggcttcattgggacagccctaacccagctgctgaatgccagaggcacgaagtgacgttggtctcccgaaagcccgggcccggccggatcacgtgggatgagctcgctgcatcggggctgccgagctgcgatgccgccgtcaacctggccggagagaacatcctcaaccctctccgaagatggaatgaaaccttccaaaaagaggtaatcggcagccgcctagagaccacccaattgctggctaaagccatcaccaaagccccacaaccccccaaggcctgggtcttagtcacaggtgtagcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttgggtgctgccctgggccgccgagccttcatccctctccccagcgctgtggtgcaagctgtctttgggcgacagcgtgccatcatgctgctggagggccagaaggtgatcccacagcgaacactggccactggctaccagtattccttcccagagctaggggctgccttaaaggaaattgtagcctaagtaggtcgtggcaagggcctgaggcctgttcctcacaggcttccaggttaggcactgtgaataggctcagctcctctagagagctgaagccatctggttcttagattcctctcccagtcctctttcccattgttctgttgctccaccttattgtctcaaggccgtaatctcatcaggttgggacattaatcttttcaactccttgtaagatttcccagtttggtttctctacatgtcctgcagctgccccacttctcctttacgctgtgtagagaatgctctgcagtttaggcaataaaaataaattgtctcact

SEQ ID NO: 181240 - DNA, 1233 bp, Homo sapiens
  Payload ID: 15697
  Gene Symbol: SDR39U1
  Gene Name: short chain dehydrogenase/reductase family 39U, member 1
  Uniprot ID: Q9NRG7
  ENST ID: ENST00000399395
  CDS Start-End: 35-916
aaactttacgcaggcgcgttaggtcctagtcgctatgcgtgtgcttgtgggtggcgggacaggcttcattgggacagccctaacccagctgctgaatgccagaggccacgaagtgacgttggtctcccgaaagcccgggcccggccggatcacgtgggatgagctcgctgcatcggggctgccgagctgcgatgccgccgtcaacctggccggagagaacatcctcaaccctctccgaagatggaatgaaaccttccaaaaagaggtaatcggcagccgcctagagaccacccaattgctggctaaagccatcaccaaagccccacaaccccccaaggcctgggtcttagtcacaggtgtagcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttgggtgctgccctgggccgccgagccttcatccctctccccagcgctgtggtgcaagctgtctttgggcgacagcgtgccatcatgctgctggagggccagaaggtgatcccacagcgaacactggccactggctaccagtattccttcccagagctaggggctgccttaaaggaaattgtagcctaagtaggtcgtggcaagggcctgaggcctgttcctcacaggcttccaggttaggcactgtgaataggctcagctcctctagagagctgaagccatctggttcttagattcctctcccagtcctctttcccattgttctgttgctccaccttattgtctcaaggccgtaatctcatcaggttgggacattaatcttttcaactccttgtaagatttcccagtttggtttctctacatgtcctgcagctgccccacttctcctttacgctgtgtagagaatgctctgcagtttaggcaataaaaataaattgtctcactaa

SEQ ID NO: 181241 - DNA, 1041 bp, Homo sapiens
  Payload ID: 15697
  Gene Symbol: SDR39U1
  Gene Name: short chain dehydrogenase/reductase family 39U, member 1
  ENST ID: ENST00000538105
  CDS Start-End: 105-740
cgggacaggcttcattgggacagccctaacccagctgctgaatgccagaggccacgaagtgacgttggtctcccgaaagcccgggcccggccggatcacgtgggatgagctcgctgcatcggggctgccgagctgcgatgccgccgtcaacctggccggagagaacatcctcaaccctctccgaagcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttgggtgctgccctgggccgccgagccttcatccctctccccagcgctgtggtgcaagctgtctttgggcgacagcgtgccatcatgctgctggagggccagaaggtgatcccacagcgaacactggccactggctaccagtattccttcccagagctaggggctgccttaaaggaaattgtagcctaagtaggtcgtggcaagggcctgaggcctgttcctcacaggcttccaggttaggcactgtgaataggctcagctcctctagagagctgaagccatctggttcttagattcctctcccagtcctctttcccattgttctgttgctccaccttattgtctcaaggccgtaatctcatcaggttgggacattaatcttttcaactccttgtaagatttcccagtttggtttctctacatgtcctgcagctgccccacttctcctttacgctgtgtagagaatgctctgcagtttaggcaataaaaa

SEQ ID NO: 181242 - DNA, 556 bp, Homo sapiens
  Payload ID: 15697
  Gene Symbol: SDR39U1
  Gene Name: short chain dehydrogenase/reductase family 39U, member 1
  ENST ID: ENST00000556249
  CDS Start-End: 1-556
ggcttcattgggacagccctaacccagctgctgaatgccagaggccacgaagtgacgttggtctcccgaaagcccgggcccggccggatcacgtggcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttgggtgctgccctgggccgccgagccttcatccctctccccagcgctgtggtgcaagctgtctttgggcgacagcgtgccatcatgctgctgga

SEQ ID NO: 181243 - DNA, 934 bp, Homo sapiens
  Payload ID: 15697
  Gene Symbol: SDR39U1
  Gene Name: short chain dehydrogenase/reductase family 39U, member 1
  ENST ID: ENST00000555355
  CDS Start-End: 549-934
cgacaggatgagctcgctgcatcggggctgccgagctgcgatgccgccgtcaacctggccggagagaacatcctcaaccctctccgaagatggaatgaaaccttccaaaaagaggtaatcggcagccgcctagagaccacccaattgctggctaaagccatcaccaaagccccacaaccccccaaggcctgggtcttagtcacaggtgtagcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggtgagaaacgggcctgggtatcagacagggttggaatgtcttctctgggctggggaagtgatgggattaggagagctgagattacaattacagagtgagaggatgccaccacttctagccaacctgcagatgagaaggtgtgaggtcttaaagacagccatactgctcacttctgttacagagccaagtcagcatggggagagtgaggaaggggaaacagaaaccaggaggagcagtgggctccttcaaggctgagaggacccctgtaccttccctctttcctgctctaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttgggtgctgccctgggccgccgagccttcatccctctccccagcgctgtggtgcaagctgtctttgg

SEQ ID NO: 181244 - DNA, 735 bp, Homo sapiens
  Payload ID: 15697
  Gene Symbol: SDR39U1
  Gene Name: short chain dehydrogenase/reductase family 39U, member 1
  ENST ID: ENST00000556523
  CDS Start-End: 536-735
tcattgggacagccctaacccagctgctgaatgccagaggccacgaagtgacgttggtctcccgaaagcccgggcccggccggatcacgtgggatgagctcgctgcatcggggctgccgagctgcgatgccgccgtcaacctggccggagagaacatcctcaaccctctccgaaggtcagcccgggccctaaagctgatacccactagagcacagggaggacagtgccccactgatgagaacctatggaatgaaaccttccaaaaagaggtaatcggcagccgcctagagaccacccaattgctggctaaagccatcaccaaagccccacaaccccccaaggcctgggtcttagtcacaggtcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttgggtgc

SEQ ID NO: 181245 - DNA, 769 bp, Homo sapiens
  Payload ID: 15697
  Gene Symbol: SDR39U1
  Gene Name: short chain dehydrogenase/reductase family 39U, member 1
  ENST ID: ENST00000555225
  CDS Start-End: 483-769
ggtggcgggacaggcttcattgggacagccctaacccagctgctgaatgccagaggccacgaagtgacgttggtctcccgaaagcccgggcccggccggatcacgtgggatgagctcgctgcatcggggctgccgagctgcgatgccgccgtcaacctggccggagagaacatcctcaaccctctccgaagatggaatgaaaccttccaaaaagaggtaatcggcagccgcctagagaccacccaattgctggctaaagccatcaccaaagccccacaaccccccaaggcctgggtcttagtcacaggtcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttgggtgctgccctgggccgccgagccttcatccctctccccagcgctgtggtgcaagctgtctttgggcgacagcgtgccatcatgctgctgga

SEQ ID NO: 181246 - DNA, 976 bp, Homo sapiens
  Payload ID: 15697
  Gene Symbol: SDR39U1
  Gene Name: short chain dehydrogenase/reductase family 39U, member 1
  ENST ID: ENST00000555365
  CDS Start-End: 415-795
gtgtgcttgtgggtggcgggacaggcttcattgggacagccctaacccagctgctgaatgccagaggccacgaagtgacgttggtctcccgaaagcccgggcccggccggatcacgtggatggaatgaaaccttccaaaaagaggtaatcggcagccgcctagagaccacccaattgctggctaaagccatcaccaaagccccacaaccccccaaggcctgggtcttagtcacaggtgtagcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttgggtgctgccctgggccgccgagccttcatccctctccccagcgctgtggtgcaagctgtctttgggcgacagcgtgccatcatgctgctggagggccagaaggtgatcccacagcgaacactggccactggctaccagtattccttcccagagctaggggctgccttaaaggaaattgtagcctaagtaggtcgtggcaagggcctgaggcctgttcctcacaggcttccaggttaggcactgtgaataggctcagctcctctagagagctgaagccatctggttcttagattcctctcccagtcctctttcccattgttctgttgctccaccttattgtctcaaggccgtaatctcatcaggttgg

SEQ ID NO: 181247 - DNA, 681 bp, Homo sapiens
  Payload ID: 15697
  Gene Symbol: SDR39U1
  Gene Name: short chain dehydrogenase/reductase family 39U, member 1
  ENST ID: ENST00000553343
  CDS Start-End: 173-681
cgaaagcccgggcccggccggatcacgtgggatgagctcgctgcatcggggctgccgagctgcgatgccgccgtcaacctggccggagagaacatcctcaaccctctccgaaggtcagcccgggccctaaagctgatacccactagagcacagggaggacagtgccccactgatgagaacctcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttgggtgctgccctgggccgccgagccttcatccctctccccagcgctgtggtgcaagctgtctttgggcgacagcgtgccatcatgctgctggagggccagaaggtgatcccacagcgaacactggccactgg

SEQ ID NO: 181248 - DNA, 1364 bp, Homo sapiens
  Payload ID: 15697
  Gene Symbol: SDR39U1
  Gene Name: short chain dehydrogenase/reductase family 39U, member 1
  ENST ID: ENST00000554698
  CDS Start-End: 509-1066
aatccgcttccgggagggcactgtctagtgcacaggcaacctggccttggcctcctagcccgagaagccgaatctccctaatccctgtgacctgtgtcacctctgcatcgcgaggagggggataagtggggagaagcctggtgtcagatgggatggcgccggaagagggtgccacagcggggacggaaggcgcccccaccccaactccacgggaatataaacaatttgtattttccgatcaggtggcgggacaggcttcattgggacagccctaacccagctgctgaatgccagaggccacgaagtgacgttggtctcccgaaagcccgggcccggccggatcacgtgggatgagctcgctgcatcggggctgccgagctgcgatgccgccgtcaacctggccggagagaacatcctcaaccctctccgaaggtcagcccgggccctaaagctgatacccactagagcacagggaggacagtgccccactgatgagaacctgtgagctatggcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttgggtgctgccctgggccgccgagccttcatccctctccccagcgctgtggtgcaagctgtctttgggcgacagcgtgccatcatgctgctggagggccagaaggtgatcccacagcgaacactggccactggctaccagtattccttcccagagctaggggctgccttaaaggaaattgtagcctaagtaggtcgtggcaagggcctgaggcctgttcctcacaggcttccaggttaggcactgtgaataggctcagctcctctagagagctgaagccatctggttcttagattcctctcccagtcctctttcccattgttctgttgctccaccttattgtctcaaggccgtaatctcatcaggttgggacattaatcttttcaactccttgtaagatttcccagtttggtttctctacatgtcctgcagctgccccacttctcctttacgctgtgtagagaatgctctgcagtttaggcaataa

SEQ ID NO: 181249 - DNA, 1325 bp, Homo sapiens
  Payload ID: 15697
  Gene Symbol: SDR39U1
  Gene Name: short chain dehydrogenase/reductase family 39U, member 1
  ENST ID: ENST00000553930
  CDS Start-End: 515-1021
ccgaaaggggcatgcgcagagaggtcgtagtcgcgtctgaggtgaggtggcgggacaggcttcattgggacagccctaacccagctgctgaatgccagaggccacgaagtgacgttggtctcccgaaagcccgggcccggccggatcacgtgggatgagctcgctgcatcggggctgccgagctgcgatgccgccgtcaacctggccggagagaacatcctcaaccctctccgaagatggaatgaaaccttccaaaaagaggtaatcggcagccgcctagagaccacccaattgctggctaaagccatcaccaaagccccacaaccccccaaggcctgggtcttagtcacaggtgtagcttactaccagcccagtctgactgcggagtatgatgaagacagcccaggaggggactttgactttttctccaacctcgtaaccaaatgggaagctgcagccaggcttcctggagattctacacgccaggtggtggtgcgctcagagccaagtcagcatggggagagtgaggaaggggaaacagaaaccaggaggagcagtgggctccttcaaggctgagaggacccctgtaccttccctctttcctgctctaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttgggtgctgccctgggccgccgagccttcatccctctccccagcgctgtggtgcaagctgtctttgggcgacagcgtgccatcatgctgctggagggccagaaggtgatcccacagcgaacactggccactggctaccagtattccttcccagagctaggggctgccttaaaggaaattgtagcctaagtaggtcgtggcaagggcctgaggcctgttcctcacaggcttccaggttaggcactgtgaataggctcagctcctctagagagctgaagccatctggttcttagattcctctcccagtcctctttcccattgttctgttgctccaccttattgtctcaaggccgtaatctcatcaggttgggacattaatcttttcaactccttgtaagatttcccagtttggtttctctacatgtcctgcagctgccccacttctcctttacgctgtgtagagaatgctctgcagtttaggcaataaaaataa

SEQ ID NO: 181250 - DNA, 11566 bp, Homo sapiens
  Payload ID: 15698
  Gene Symbol: SDR42E1
  Gene Name: short chain dehydrogenase/reductase family 42E, member 1
  Uniprot ID: Q8WUS8
  ENST ID: ENST00000328945
  CDS Start-End: 129-1310
aggtccgacggcttcggcgccccagctgtggtgatgggtagctaggaggcctgggcctctctgcctgctgtagccgtctgccgcgcccttgttcctgcagctgtccagttatcttttgactgccacatatggaccccaaaagatctcaaaaggaaagtgtcctcattacaggaggaagtggctattttggttttcgcctgggctgtgccctgaaccaaaatggagtccatgtgattctgtttgacatcagcagccctgctcaaaccattccagaaggaatcaagtttatacaaggagacatccgccacctgtctgacgtagagaaagccttccaggatgcagacgtcacttgtgtgttccatattgcctcttatggtatgtcagggcgggagcaactcaatcgaaacctgatcaaagaagtcaacgtcaggggcacagacaacatcctccaggtttgccaaaggagaagggtgcccaggttagtttacaccagcactttcaatgtcatctttggaggtcaagttatcagaaatggggatgaatctctgccctacctgcctcttcacctccaccctgatcactactctcggacaaagtcaattgcagagcagaaggtgctggaggcgaatgctacacccctggacagaggcgacggtgtcttaagaacctgcgctctgaggccagctggcatctatgggcctggagaacaaagacaccttcccaggatagtcagctacatcgagaagggtctgttcaagtttgtctacggggaccccaggagcctggttgagtttgtccacgtggataacttggtgcaggctcacattctggcctcagaagccctgagagctgacaagggccatattgcctctgggcagccctacttcatctcagatggcagacccgtgaacaactttgagttcttccggcctctggttgagggcctgggctacacattcccgtctacccgcctgccattgaccttggtctactgctttgcttttctaacagagatggttcacttcattttgggtcgactctacaacttccagcccttcctcactcgcactgaagtttacaaaactggtgtcacacattattttagcttagagaaagccaagaaagagctaggttataaggctcagccatttgacctccaggaagcagtggaatggtttaaagcccatggtcatggcagaagttctggaagtcgtgactcggagtgttttgtttgggatgggctattggtcttcctcctgattatagcagttctcatgtggctgccttcttctgtgattctgtcactgtgaaggaggggccagaaataaggtgatcacagttggctgagatggttctcaagaaacatgggttttaaaatgtgtacagtgatatctggtgccaaacattggctcttcaaattgctacttaagaataggttcttggattgaatctttatgtcttatttccttgcactaatccagatgggaatgaaaaagcagaagcagagattagtttgaaatttgatttgttatgtgcttctgttttaggtgggtacaatagaagtcagtttggagccatagaagtaggcttagttgagttggagatgcccatcttgaatttctgagagggcaagatatacttatttccattttatgcagtctgcatctacctaaaacctctgactgatgtgggaatggcgaaacactatcaggcttgaatgcgtgtgaaaaacaccaaattggcccagatccctaacagagcaatcctcgaggggatggtggctattgctggagaggcattagctattcacagggtacgttttaggtgttaacttttgccctttatgatatcagggcattatgcctatgtgaacacatggtaatgtttgatgtttaggcctttattctacctcataggattcttttgaggattaaattcaagcatacaaagcgctcctcaacacacatagccattctttttatcagaattgtcatggtacattccttatgagggctttcttcctcagtgttctctttagagggctattgctactggactttctgcaatgtctttgggtgtgccctcagagcctgcaacaagtgtatttggatatactctatttgtaaagtttaggcctctaagaaggccacaatgaagcaactaaaaatctgatgattaagggagtcaatcaagctgatgccatttttagtttaaaaatgaagcagagctctaaactcatagatgggttttcttactgggaagaagattggctctctgaagacagcttccaatgaggaatgtattgaacaatggcagcactgtctggccacccacaaactgttacagatgatccagttacactgttgcataggaacccaagtggaaagaagacagagtccatgtctgtccatggctccagctacagaaaggatagtatgggaacattacaagggggatacattactgtggaaagttctgctagagttagtcttgagagtatctgtaaaatacaaatagatgagcaatccctgtggaatgctgcctggatattttcagaaaagctctgaacttgatgtcataataccaacaccgtgaatatcgtgtgtggccttaaccaaggaacagaagccctttagaacttagcttcctcacttgggagctgggactgactgcatttgccctttgtataaacccacccaccccatagggttcactgggagcataaagcaagatgtggtgaaagtacttctaatataaattgcaacatcagtatgaggtgatggtagtgattgtttttaggaaaacgtgtttggagtcttttctgtcataaagaagcttttgcattagcctggggttaacgcatatgagcacctgccatgtattgttctagaactgcttgaatatcctcatccccagagcaggtcatccaagacagcagggtggaagctgcattgtcctttatgacttggcctcaaatgtcacagtgtcattccacagtatattggttatgcaggtcaatcctattcagtaggggaaggaaatacacaaaggtatttccgtattataccagaagagggagatggtcaaaggcgatcttggaggctgagctcttggcccgatgtgagtcatccttccttttccatgaaacgttgcccacatttccagctacaaagctttttctgcctgcttcttgccagaaggattttaggggcccaacggctgtgttaacattttgcactatatccctttccattcaagctggcagtggtactgggaacattattttgaatgcgtcacctgagtcttattgcagttcactcacaaaagccacacccacaaatctctgaggtaagttctccactgtgagcttctgctcagactgccaagggacaatacgctgtgcttcttagaagccttactgtctgaacagctctctggggtgccacatcaggcctttctgagatcttaaaaagattttatactcacagccacagccatgcactgtcgtttccacagtctcgggtgtttacacaggttagccgtattcagtgtgggaggagactacacaaggatatgaataccaggaggtggtgtcattggaggccaacgtggaacctggctaccacattcctgcttccatatctccccaattctgttactgtctcccactccagcttgaaatggtagattttctcagtgctcattccttggccctgttctaataccatactttctccctaggtgagctcacctaagcccatggcctccattttcatctcccagcccaaatatgtactactagatgtacagttccagaccactcctgggctccagactcatatctaagtacttctgcaactccacatggatgtcccacatgcacctgtcagccagtgtagccaaagtggaattcataatcctctcccaccccaaattcttacagggctcccttccttagtaaatatctccactacctgctgaatttcccatcccagagatctgggataatccctgacccctgccctctcccagacttgacacacctaacccatgtttaagccagttgatttttacttgtaatcatgccttaaaactgcccaaggtataggtgtaccttctctcccatagattccactagtagcccatttgctcttccacccatatccacaccctccttccttcagtccattctccacatgcctagccaagagactctataaaggtgcaaatcttttgtcacttctctgctgaaaactttccttaggttgagaatctttaacgtgatcaagaggctttgtctgaactggccccttgcctgtctctctaacttcatctcacattattctgccttctctgccccaattacactgaccttttttaggttcctgggctccaagcttctcaggctccctgctcctccttttggcctgaataatgtttatttcgtgtctcttgttaagtctctttctagaggccttcactgatcccagcaatttaagattggtgctcctgctacaaatgatgctacaggcctgtcatagcttcctgcctttcttttatagcattgctcataactgtaaacatttgtacggttatttgtttaatgcctgttagctctatgagggtgggaactttgtcttgcttacagctgtactcctaatgcccggcacagtgcaggagttcaataagtatttgtccaatgaatgctgttttcccatctgctatggatgaacactcttttctagcacacagataactcactgtttctaatcttttggagactggggaaaatagccaacctacactagaactgtcgtaactaagtcaagattagatgaggtctagtgagtaagggaagtcattgtctatatgatctggtggagtattaatgctataaggaggtcagggaatggggaaggaatgtgggccaagtgatttgtgctccctccacatctcagctgaaaactcaccactttaaaagacttagtctatttcctgaaagggagctccccttcctttctatggtcaggagacgctgcagttaagaaattctattagttctagggttcccagctgccctcaccttgcctcaaccttagattgaatcactcaaccctgcctaacaataaaattatgctcacacttgtgcacttggggatgctctcagaggtctgggcagaagccacccagcactgctacctcacccatggcttctgaggagtgtgtgggaggttatccatatgattgatggagggtcgcaatgaaggaaggatgtgtgagcaacaaggagccctgtattggaacctaaaggtaatgcccaaactgctcccacctgcaaaaagggaagagcggtctggaaagcctgttggaaatacttcttggatgtcctcagtgccgtttctggtgacaggggcagacagtgccacattacaagcagtaacagttagtggagggtcaaataactcattctggcaccaaattacctatgctgtggtgtttctcaaacctagggaataggcctagggattcttttcaagaaaatgttttattttcctcaaccatctaacatggtgtataaaagaggcaagtgttgctttgtcgtagattgttggggctgcttctaccttgtattgctttccaaatctccggttcgcccagccttacaaagggtagaagttgcctgcagaatgccacgccccagctctgacccaattagacatcattatagggccactggtgcccctgctggctggccttggaagccagcaccagcaatgttattaaaatcttcaccagcatctcttgcttagagatggcacaccaggttgtgtgctgttcaccagcatatctcactttagagaatgataccccatgctcctttttggtgacaaaaagtccctcccagccctttcgtggggctgacctccacatgcaggcctgaccgctcacaggacttccatccttcggccgcagtcattgggccacgatgggccagtcagcgtcatcctttcagcctttctcccagagcaggtttagagaaaccctttcagctaggattgcttctctggggaggacaggcgcttggtgcagctcctcttcagggtcctcctacctgaaggagaggaccgagtgctgatgatgtttgggctgctgggtccagctatgtgttaagaagagccaaaaaatggagagggaggaggtcctggtgactacactggggttccgtaacgctgcctgcgggacgctcatcattccagatcgtcctctcacgtgagtcttcagttcactttcttttctgcttaaggtcctttaagttcgatttttctccaggaatcgcagcatgtcctggtgtgccatgtccacagtccactcctgggtacaggtgatcctaccccgtggtttccaaaggcagcctctccactcacctctgtgccctctttctttcaaacgggggtcgtcttttggtccctgggtaatttaacatttgctggagtttttcttaaaaaatgagattgatttccttttctagaatcatgtttatttgaattacgtttattcaaatcatgtatatttggcaccaacatacctttaagcagagtagttcaaactcttgttttatatggaaattgtttgatgaagtgatttgctccccagaacataaacgccccatgagagcaggaaccatgtctgttttttctacttctgtacccttcatatgcccaataaatgcttgttgacggggtgaatgcacttatcagccaggtggtcccttatctgaaattacagctgattccccagttattgcttcttttacacctgagactcccagcctgaggcaataagaacattcaaggcctaaattaaaaatgcagactccagaagggtgacatcatgtaaaacggcagagtaggaagctctggaatcggtcctttcactgtaacaaccagaaaagcacgggggcaggggaatgatcagaaccaatgatttcaggaactccttacatctattttacctcgatatacagactccagactcttccctgatgcttctgattgagaaagtctgtgttggttggtaatctgcactctaggtgtttcttatctttcaacaaggaggtgagcactggtgccagatactaaacactggctcccttgcaagatgctgagaggctcctgacttctgcttggctcttccctttgcagtgctttgctacagcaggtgctcagtacaactttgctgaatgaatgaagggggagatgggactcgccaaagggccttggattcgagtgaccccccacctgctcctttatgcagggcccagttctttgttgacacagacaagcactgctacgtcccagtgctgacttttccagccaacctagagcctctttttcttgagccaaagggattctttggcaacacatcttgttgtgcctggttacctgatcttttagtgtaaaacagccttttgctattgaaaatcaaaccagaaatagagtcaaccagtccctggtatctctaagttgtgcaaattcataccatgttacccttctgtattttagaacctgggcacaccaggaactcattgaactcaagttgcgttcataattacttgagttcattgaactcaagtaattatgaccgaggccaaatctagttcactacaaagaaattgcatgtagcaaagtgatccaggcaagtgtctttcaaccaacaggggatttatcagcagtaattcgcaatgtttatttttaacagctggttaaagcatgcaagtaattaaaaaattcttcattactaatatgcaagattttaatcttggcaagtattctacatatcttttgctctagcctcccagtggagccatatttcagatccaagagtaaaatactgtcttacccatatatatattttaacatatgtatatatgttataagaatgagtcgtcttttgctcttaacagtcactaggagttagtgtcctgaatagataataataagtctgaaatgttgcccaggttttaaggggaattatttgcacattgctgggcaattacaacacccccactccactgatttatagtcctgtgcctttcataggggatttagcttctgggaatgttcaacatgaagctaatgatcaatattaacctgtcaccctagttaactaaattactcaaagatgaacattgttaatagttaattgctactatttgttgagagtttactcaggataaggctttctaatttttttttcttttttttgagatggagttttgctcttgttgcccaggctggagtgcaatggcgtgatctcagctcactgcaacctccacctcctgggttcaagcgattcttctgcctcagcctcctgagtcaataggattacaggcgcccaccaccacaaccggctaatttttgtttaattagcggtgatttggggtttcgccatgttggccaggctggtctcaaactcctgacttcaggtgatccacctgaggctttctttatttcttaggcttatttagctttcttaatgtctttaagaaacagatcaatttattatctccagtttacatgggaggaaactgaggcttagggagatgcagtaccttgcccaagggtacccagcgtcaccagctaggaagtggcaaaacttaaatttgagccaggtttacttgaatccaagaccaaatttttttttttttttttttgatagagtctcgtctgtcacccaggctagagtacagtggcacagtcatggctcactgttggctcgaactcctgggctcaaatgattgtcctacctcagcctcccaagtaactgggactacaggtgcatgccaccacatccagcttttattttctgtagagacggtgtttcactatgttacctgggctggtcttgaattccttgccccaagcaatcctcttgcctcggcctcccaaagtgctgggattacaggtatgagccaccgagcctggcccaaactcttaccttgttggaggtggttttatcacgttagcatgacattattcaaggctaagtgttactcgaacttcatttgcaattaaagtaaactatttgttacaaaaaatgagtaactgtaaatagtgacttctgctacacaaactaagttacagaagcaaaccattattttgtcatgtgagtatgtattacgtagagctgaggtgtgtgggcggggggtgctgttaatctactggaattccatgtattttgtgaggagcatggatgttagagccatacttaatagcccagaggacatcctccaggaagacttgtttgtgtacctaatcaaatactgatattggtcacattgcacatgtcctagtctctcctctaaatcagtatcttgagagcagagcccaagtattattcgctgctgatggctctttgcctcccctgcagtcttacactattctgggcgtggagcacagacctaataaaaatctttcgaagtaatgaaaatgcaaagtccagcctgtagaggtgcccttagatgtttaaattctcccaaagaagggtgaactttttacaaagcacttcacagtggaagtgtctctgagcacagcaaataccttaagtttgggcccaagtggaaaagaaatatttggtagtgggtgattatagcccttcagtgctcaagggactcatgcatttgcttgcacttccttatgcctgtcctggagccatctcttatttgcaatgtgactttgagcaaatgcctctcatctgtaaagtggagataaaacattccctgcttatctcttgggggaacttgtatggatttaatggcacagaggccttttgtaacctgtacaagaactatgcacatggatccttaattaatagtgtttctgctgggaaagatggaagggtttggaggggaagctggtgtctacaggaagagatgcaagacatgctagtggagtttgagacgttcaaatggaatgttcagtaactaattagcaacataagactgtagtttgaaaaaaacaactgcatatgcgggtagagatggttcagtgaaaatgtttcattgatttcctgccatataacaggtattagtttatttaccgtggcttttctttttttcttttgagacatggtgtcactctgtcgaccaggctgaagtgtagcactgtggacacagctcactgctgcagtgccctcctgggctcaggtgatcctcctaagtagctagaaccacaggtgcaccagcacacctagctaatttttctgtcgtcttttgtagagacagggtctcaccgttttgcccaggctggtctcaaactcctggccttaggtgatcctccttcctcagtctcccaaagtggtgagattacaggaatgagccaccgtgcccagcctaccatgttttttttgtttgtttgtctgtttcagacggagttttggtcttgtggcccaggctggagtgcagtggcacaatcttggctcactgcaacctccgcctcccaggttcgagtaattctcctgcctcagcctcccaagtaggtgggattacaggtgcccgccaccacgctcagctaatttttgtatttttagtagagatggggtttcaccatgtcagccgtgatggtatcgaactcctgagctcaggtgatccacccacctcggcctcccaaagtgctgggattacaggcttgataccatggttttcaattactcaattcagtcacgttttgagctctaaactgaaaatgagtttttcttttcttgagattgcagagtcaattacaccatgctagagaacaagtaggcatctatgcctctctgctctaaattttgatgtctataaacacccatagcggtgtgtgttggttttaaattgtggggctagaaagccaacccaaaatcatcaagcttttatttctacacattcagagtgcttctgtgtaacttagatttaaaagtaactatacaaataatgcatagatgtatttttcttatataatgttaaaatattacggataaggccaaagaccccttttactaatgtccccaaatttcatatatgtatatatttgtatagaaaacagggctgtggtgttcatgtctttccccatactactgtctcccacctcacagttccttctgctactacggtttctcactcaatagtacagcatggtgatctattgatattagtatatattctttatttgctgacataggaggtcaccgggtatataaagatgataagcatatgtcctagttggcctaagacagttctggtttcatgcctgtagtcccaccttaatttttaatagtgcttcctttcactctcaggtatgtcccattttgtataataaattgtacgatcaccctatatataagacacatagttatatgaagaattaagcatttttcataacagatgtattagaagttattgtgaactgattttgaggggaaaaaatctcattttgtactagaatagaatatagtagaaaatcctgaattctgggtatgtagcagtattctaccaacattgaaatattaataaaaaattacctaaagaaaa

SEQ ID NO: 181251 - DNA, 832 bp, Homo sapiens
  Payload ID: 15698
  Gene Symbol: SDR42E1
  Gene Name: short chain dehydrogenase/reductase family 42E, member 1
  ENST ID: ENST00000532128
  CDS Start-End: 248-832
acggcttcggcgccccagctgtggtgatgggtagctaggaggcctgggcctctctgcctgctgtagccgtctgccgcgcccttgttcctgcagctgtccagttatcttttgactgccacatatggaccccaaaagatctcaaaaggaaagtgtcctcattacaggaggaagtggctattttggttttcgtagatgagaggattctcacttttgaaaatttgaagaagcgaggcttgcaccaaggaacatgcatagtgaggggctcaggatgagccaagaagacttggatcagccccaccttgattgcctgggctgtgccctgaaccaaaatggagtccatgtgattctgtttgacatcagcagccctgctcaaaccattccagaaggaatcaagtttatacaaggagacatccgccacctgtctgacgtagagaaagccttccaggatgcagacgtcacttgtgtgttccatattgcctcttatggtatgtcagggcgggagcaactcaatcgaaacctgatcaaagaagtcaacgtcaggggcacagacaacatcctccaggtttgccaaaggagaagggtgcccaggttagtttacaccagcactttcaatgtcatctttggaggtcaagttatcagaaatggggatgaatctctgccctacctgcctcttcacctccaccctgatcactactctcggacaaagtcaattgcagagcagaaggtgctggaggcgaatgctacacccctggacagaggcgacggtgtcttaagaacctgcgctctgaggccagctggcatctatgggcctggagaacaaagacaccttccc

SEQ ID NO: 181252 - DNA, 2630 bp, Homo sapiens
  Payload ID: 15699
  Gene Symbol: SDR42E2
  Gene Name: short chain dehydrogenase/reductase family 42E, member 2
  Uniprot ID: A6NKP2
  ENST ID: ENST00000602312
  CDS Start-End: 1-1269
atgaagtccaaccccccacgctcctccctagaggcctgcaaagctgcaggccaggcgccgcagcagaagactcaagccaaacctacaaaggctgccaggcagaaggttctagtgactggaggaggaggctacctgggcttcagcctgggatcccacctagccaagagcggcacttccgtcattctgcttgaccgccgcagaccccagtgggaactgtccccggaaaccaagttcatccaggctgatgtccgagatgaagaagccctgtaccgtgccttcgaaggggtggactgtgtcttccacgtggcttcctatggaatgtccggggctgagaagctgcagaaagagcagattgagtctataaatgttggaggcaccaaactagtgattgatgtctgtgttcgccggcgggttccaaggctcatctataccagcactgtcaatgttgcatttggagggaagcccatagagcagggcgatgaggactctgtgccatatttcccattggacgagcacgtagaccactactcccgaaccaaagccatcgccgaccaattgaccctcatggccaatgggatgcctctcccaggaggaggcactcttcggacgtgtgtgctccggcctccagggatctacggccctgaagagcagaggcacctgccccgtgtggcgggccacatcaagaagaggctgttcatgttccgatttggggaccacaaggcacggatgaactgggtccacgtacacaatctggtgcaggcacacgtgctggcggccgaggccctcaccacggccaagggctacgtggctagtgggcaggcgtactacatcaacgatggggagagcgtcaacctctttgagtggatggccccactgtttgagaagctggggtacagccagccctggatccaggtgcctacttcctgggtttacctgacagcagcagttatggagcgcctccatctggccctgagacccatctgcagcctcccaccgctgctcactcgtagtgaggtgcgcagcgtggccgtgacgcacaccttccagatagccaaggcccgcgcccagctcggctacgcgccggataagtttaggttcgccgacgccgtggagctatacgtgcagtccacgacccggcggccccgcggctccacggcgcggaccctcctgcgcctgctgctcaggctgctgctgttcctcggcttgctcgccctggccctgcacttcctaggcctgcagcctctgcacgccgccgtggagcgcctgtgaccgtccgccgtccgccgcccgctagggtcggccccgctgcaccctcgcccacgcccggctccctgggcttgtaccagcccctgccccgccttctgggtttgagcgcgcctccgctccgccccttgaatcctggtcacgcccccgagccgctctccagacctagcccggaccgccgacttctggccacgcccctatctactcccagaccttgccttgcgcccttcctgtgttttggccccgcccctgtcctgtcccgccccgccctccgaagtgggcacgctcctgctccgccccctgaatcctggccacgtccctggtcggcccagacgcgtagccccgagtctctttccatgttttgaccacgcccttgacccgcccttcaaattgggcacgccttcttccccgctcactgatttcctggcctagcccctgagcagacctccagacctagccccgcccccgttttataaccccgcccctgcttcacggcttgggcacgcctcttccccgccccctgacttcagagcctagtcctgagccgctctccaggcctaaccccgccttcatgtcatagccacgccccttcccgcccttccatgtttgggcacgccttctgagtcctggtcacgcctctgtcccgccccctgaatctttcctacgtccatgaccctccctccaggccctggccctgccccttttttcctccctccggcctgtccggtttctgatatgggccaaggctcacagcttcctccgccttctggaccttctcctagtccctgcccagtcccggcccacccccagattctccctcattctggtttcgccccctttctggtcctccccgcgcgcttgagcccaccctttggcttctccttttgggtctgtccttgctcctgcctctggacccggtcccgcccttctcgcgtgtaattgagtcctggccccgccccctccctctctggcttcacccctttccagctccgcctcccgggtaggttctccccggaaccaggctgccgcgtcgctatgggctaacgcaggctcgggtgacgttggtatgagtttgcgccgtcggctgctgctctgtctggtaacattgcattcgatccaccccgacccaatgttctgggcttctcattcacacagatctgtgtgttgacagccagggtttggggaaaaaccgagactcaagcttctgccgagcccgacttggcctttttgggttcctgtctgaggatgacagcatagtaagcacaggttttagtaccagaaagagcatgaaaaatttaaaaaaaaaaactcttaaaataattggatgtctcgatgaagtaccaataaagctataatgggaaaaatag

SEQ ID NO: 181253 - DNA, 1765 bp, Homo sapiens
  Payload ID: 15700
  Gene Symbol: SDR9C7
  Gene Name: short chain dehydrogenase/reductase family 9C, member 7
  Uniprot ID: Q8NEX9
  ENST ID: ENST00000293502
  CDS Start-End: 145-1086
agatttgttgcaagctgtgggaggaaggagagttcttcttccaggtggtttcctgcagactgcctgctagggctcagaggaccagcttcttccctgctgtctcctgagcccagtccctcttggccatcacattccccttgccctatggcggccctcacagacctctcatttatgtatcgctggttcaagaactgcaatctggttggcaacctctcagagaagtacgtcttcatcacaggctgtgactctggcttcgggaacctgctggccaaacagctggttgatcggggcatgcaggtgctggctgcttgcttcactgaggagggatcccagaaacttcagcgggatacctcctatcggctgcagaccaccctactggatgtcaccaagagcgaaagcatcaaggcggcggcccagtgggtgagggacaaagtgggcgaacaaggcctctgggccctggtgaacaatgctggtgtgggcctgcccagtggtcccaacgaatggctgaccaaggatgactttgtgaaggtgattaatgtgaacctggtgggactgatcgaagtgacccttcacatgctgcccatggtcaagagagcccggggcagggttgtcaacatgtccagctctggtggtcgtgtggctgtcattggtggtggctactgcgtctccaagtttggcgttgaggccttctctgacagcataaggcgtgagctctactactttggggtgaaagtctgcatcattgagccagggaactatcggacagccattctcggcaaggagaacctggagtcacgcatgcgaaagctttgggagaggctgcctcaggagacccgggacagctacggagaggattatttccgcatctatactgacaagttaaaaaacataatgcaggtggcagagcccagagtcagagatgtcatcaacagcatggagcatgctattgtttcccggagccctcgcatccgctacaaccctggcctggatgccaaactcctctacatccctctggctaagttgcccacccctgtgacagatttcatcctaagccggtaccttccaaggccagcggacagtgtctaaactggggaggatcaatgggtcagtggagcctagaagtgggggaggaaggaaggaccgtggggtcacaaaaggtggtatcggttatcctgggggcattggctgcaaaggaagcttggctcagctgacacccactgctgtcgaatttaccagtaacttctaacagaaggtgaatgcctcttcccaccctctgggaccccacagaaacctgaggtggtctttgcaggttcagcgatctgcagcaatagctccaaggacgtctgtcacccaatcaggatacagctttttctggtcctggaaaagtcatggagaagaaaaccagctcctgtggaatcatgagcccctttcagttatcactgccactgagaaatactgtgggataatcttgcctccaggagaatctaaccaccttcctaatgggtccctcaatatgcataacttcattcacataacccattactgaagtatgcggtagggcagatagggagtgcaagattaaatcagacaaaagtttaaaatattttctttctttttagattcttctatctataggttattgggatccacatgaaataacattcatttatttaatcaccattaatttttcaaatatttattgagtgcctactacctaccgggcactttgtaggtgctgggggaatataaagatgattaaatcatg

SEQ ID NO: 181254 - DNA, 1864 bp, Homo sapiens
  Payload ID: 15701
  Gene Symbol: SCOC
  Gene Name: short coiled-coil protein
  Uniprot ID: Q9UIL1
  ENST ID: ENST00000338517
  CDS Start-End: 46-414
acttccggttaagaatgcaacactcaggtctgaaaattgaacaagatggacgggtccaggaaagaggaggaggaagacagcacattcaccaacatttctcttgcagatgacatagaccattcctcaagaattttgtatccaaggcccaaaagtttgttacccaagatgatgaatgctgacatggatgcagttgatgctgaaaatcaagtggaactggaggaaaaaacaagacttattaatcaagtgttggaactccaacacacacttgaagatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattggtgtcacatttgtaaaagtaattttaatagttaatcatctctgagagtaacctgtattttaattgttgaaacttaaccaaaataagatactgtctcagctagggcttgtcatttgtgtatttagtgttaagataggaatgctagtgtctctttaattaattggaaatagatggaggctaaaaatgaaggtttttctttgaaactgaattaacttgggaatatttgttgttaaaaacttctttttgcccaaaataactcattttgtattatctgaaaatatataatttctggtcatgtgtatgttaaaatagaaaattttgaggaaaaatggaaatagggtggaaaagtactcggtaaacagtagtaaccaaatattttcactccagatttgtgttttctctggcacagagtagatcttttgggaaatatatatgaaagtggattaagtttgactacccttatgttagccacatctggatgagaacagttacaaagagtttggtctctaagttgatttgtacccagtgggtcaacttctgcaaaattccgtaatggtgtattagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagattccatttggtaaggaaatcaatattggaagtattgctaaaatcttataatatgaaaagagatccactaatgtagcttaaggttattagatttgggcttttaatcatggaataatcttatgtattggtgtaagagttgatgaatgactttagctgtgtgaatatataatagtcaaactgcaaacattttgcatcccttttgtgacctaatttacagacatttaaattgtgttgcagttctgctttgccgtttaataaaaagctatttcagaggt

SEQ ID NO: 181255 - DNA, 1795 bp, Homo sapiens
  Payload ID: 15701
  Gene Symbol: SCOC
  Gene Name: short coiled-coil protein
  ENST ID: ENST00000394201
  CDS Start-End: 126-374
ggggtcagttggtccaagtgtcccggcctgaggtgtcggccggatccctccttctcccggcgcctcaagcggaagaccattcctcaagaattttgtatccaaggcccaaaagtttgttacccaagatgatgaatgctgacatggatgcagttgatgctgaaaatcaagtggaactggaggaaaaaacaagacttattaatcaagtgttggaactccaacacacacttgaagatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattggtgtcacatttgtaaaagtaattttaatagttaatcatctctgagagtaacctgtattttaattgttgaaacttaaccaaaataagatactgtctcagctagggcttgtcatttgtgtatttagtgttaagataggaatgctagtgtctctttaattaattggaaatagatggaggctaaaaatgaaggtttttctttgaaactgaattaacttgggaatatttgttgttaaaaacttctttttgcccaaaataactcattttgtattatctgaaaatatataatttctggtcatgtgtatgttaaaatagaaaattttgaggaaaaatggaaatagggtggaaaagtactcggtaaacagtagtaaccaaatattttcactccagatttgtgttttctctggcacagagtagatcttttgggaaatatatatgaaagtggattaagtttgactacccttatgttagccacatctggatgagaacagttacaaagagtttggtctctaagttgatttgtacccagtgggtcaacttctgcaaaattccgtaatggtgtattagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagattccatttggtaaggaaatcaatattggaagtattgctaaaatcttataatatgaaaagagatccactaatgtagcttaaggttattagatttgggcttttaatcatggaataatcttatgtattggtgtaagagttgatgaatgactttagctgtgtgaatatataatagtcaaactgcaaacattttgcatcccttttgtgacctaatttacagacatttaaattgtgttgcagttctgcttt

SEQ ID NO: 181256 - DNA, 1999 bp, Homo sapiens
  Payload ID: 15701
  Gene Symbol: SCOC
  Gene Name: short coiled-coil protein
  Uniprot ID: Q9UIL1
  ENST ID: ENST00000394203
  CDS Start-End: 179-547
aacactcaggtgagaacttctcaggtggaaagcaggaagagggtggctagtgcaaggatcagatagcacctgcttggaagttcactgattaatgatttaacaagggcggtcacatgggacaactgctgcttttctctgccctcatttttcttactaacaggtctgaaaattgaacaagatggacgggtccaggaaagaggaggaggaagacagcacattcaccaacatttctcttgcagatgacatagaccattcctcaagaattttgtatccaaggcccaaaagtttgttacccaagatgatgaatgctgacatggatgcagttgatgctgaaaatcaagtggaactggaggaaaaaacaagacttattaatcaagtgttggaactccaacacacacttgaagatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattggtgtcacatttgtaaaagtaattttaatagttaatcatctctgagagtaacctgtattttaattgttgaaacttaaccaaaataagatactgtctcagctagggcttgtcatttgtgtatttagtgttaagataggaatgctagtgtctctttaattaattggaaatagatggaggctaaaaatgaaggtttttctttgaaactgaattaacttgggaatatttgttgttaaaaacttctttttgcccaaaataactcattttgtattatctgaaaatatataatttctggtcatgtgtatgttaaaatagaaaattttgaggaaaaatggaaatagggtggaaaagtactcggtaaacagtagtaaccaaatattttcactccagatttgtgttttctctggcacagagtagatcttttgggaaatatatatgaaagtggattaagtttgactacccttatgttagccacatctggatgagaacagttacaaagagtttggtctctaagttgatttgtacccagtgggtcaacttctgcaaaattccgtaatggtgtattagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagattccatttggtaaggaaatcaatattggaagtattgctaaaatcttataatatgaaaagagatccactaatgtagcttaaggttattagatttgggcttttaatcatggaataatcttatgtattggtgtaagagttgatgaatgactttagctgtgtgaatatataatagtcaaactgcaaacattttgcatcccttttgtgacctaatttacagacatttaaattgtgttgcagttctgctttgccgtttaataaaaagctatttcagaggttg

SEQ ID NO: 181257 - DNA, 1964 bp, Homo sapiens
  Payload ID: 15701
  Gene Symbol: SCOC
  Gene Name: short coiled-coil protein
  Uniprot ID: Q9UIL1
  ENST ID: ENST00000394205
  CDS Start-End: 144-512
atttaaaattatagagcttttcatcactacggagatgctcttgcctatgataggaacgatggctacatctgaagctgagcaaatttatcttttctcttcgtctgcatcagggtgacctctggaaggtctgaaaattgaacaagatggacgggtccaggaaagaggaggaggaagacagcacattcaccaacatttctcttgcagatgacatagaccattcctcaagaattttgtatccaaggcccaaaagtttgttacccaagatgatgaatgctgacatggatgcagttgatgctgaaaatcaagtggaactggaggaaaaaacaagacttattaatcaagtgttggaactccaacacacacttgaagatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattggtgtcacatttgtaaaagtaattttaatagttaatcatctctgagagtaacctgtattttaattgttgaaacttaaccaaaataagatactgtctcagctagggcttgtcatttgtgtatttagtgttaagataggaatgctagtgtctctttaattaattggaaatagatggaggctaaaaatgaaggtttttctttgaaactgaattaacttgggaatatttgttgttaaaaacttctttttgcccaaaataactcattttgtattatctgaaaatatataatttctggtcatgtgtatgttaaaatagaaaattttgaggaaaaatggaaatagggtggaaaagtactcggtaaacagtagtaaccaaatattttcactccagatttgtgttttctctggcacagagtagatcttttgggaaatatatatgaaagtggattaagtttgactacccttatgttagccacatctggatgagaacagttacaaagagtttggtctctaagttgatttgtacccagtgggtcaacttctgcaaaattccgtaatggtgtattagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagattccatttggtaaggaaatcaatattggaagtattgctaaaatcttataatatgaaaagagatccactaatgtagcttaaggttattagatttgggcttttaatcatggaataatcttatgtattggtgtaagagttgatgaatgactttagctgtgtgaatatataatagtcaaactgcaaacattttgcatcccttttgtgacctaatttacagacatttaaattgtgttgcagttctgctttgccgtttaataaaaagctatttcagaggttg

SEQ ID NO: 181258 - DNA, 679 bp, Homo sapiens
  Payload ID: 15701
  Gene Symbol: SCOC
  Gene Name: short coiled-coil protein
  ENST ID: ENST00000502535
  CDS Start-End: 409-657
gagtaatgcccttatgcgtagggctgccagatacagtgggcggttttttcactgtgcaacacttgggatgcaatcttacgtagactgtggtgtgaattgtgctctctcgcgttgtatacccttatagcactgttcttgtggcactacttttgtgctcctgcctctaccctaatcttgagtgtaagagtaatttttcctttaataagccctctccaccctgtttttctgctttttattttctttcactttttcagatgaagtcacactgttgctaaaccatgcataggttttctattgtttgaattatatgtggtcagaatttcagaaactggcttctttttctttacctcttatattgaccattcctcaagaattttgtatccaaggcccaaaagtttgttacccaagatgatgaatgctgacatggatgcagttgatgctgaaaatcaagtggaactggaggaaaaaacaagacttattaatcaagtgttggaactccaacacacacttgaagatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgtttt

SEQ ID NO: 181259 - DNA, 841 bp, Homo sapiens
  Payload ID: 15701
  Gene Symbol: SCOC
  Gene Name: short coiled-coil protein
  ENST ID: ENST00000512749
  CDS Start-End: 122-370
tgttatggcaaaggtggatcccggtgctttgagattggacgactggggtgaggcgggcagctaatgcgcagaccattcctcaagaattttgtatccaaggcccaaaagtttgttacccaagatgatgaatgctgacatggatgcagttgatgctgaaaatcaagtggaactggaggaaaaaacaagacttattaatcaagtgttggaactccaacacacacttgaagatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattggtgtcacatttgtaaa

SEQ ID NO: 181260 - DNA, 2193 bp, Homo sapiens
  Payload ID: 15701
  Gene Symbol: SCOC
  Gene Name: short coiled-coil protein
  ENST ID: ENST00000510586
  CDS Start-End: 500-748
agttggtccaagtgtcccggcctgaggtgtcggccggatccctccttctcccggcgcctcaagcggaaggcccaggcgttctttgggagagggacctctcgcggtccctgacgcagacatcgtgtagctttctccccgcagctcctgggtcgggagccgctttgcagctctcggctctggaattggactgcgggaggggcgtttgggtggaatgggacctggcacgcctggaccttcccgtggctgctctgcgagagcctgagagatgggaggggaggctgaggtggggagggagcctagagagccgtaaaataaggattggaccatttttccaggcggcgaaagcggcacctgggtttgtttcctgatcgtcttctcccccagagtcctgctgaacaagttttgggaagaaaggtttggaaaggagaaagaggatacattcctgaaagaccattcctcaagaattttgtatccaaggcccaaaagtttgttacccaagatgatgaatgctgacatggatgcagttgatgctgaaaatcaagtggaactggaggaaaaaacaagacttattaatcaagtgttggaactccaacacacacttgaagatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattggtgtcacatttgtaaaagtaattttaatagttaatcatctctgagagtaacctgtattttaattgttgaaacttaaccaaaataagatactgtctcagctagggcttgtcatttgtgtatttagtgttaagataggaatgctagtgtctctttaattaattggaaatagatggaggctaaaaatgaaggtttttctttgaaactgaattaacttgggaatatttgttgttaaaaacttctttttgcccaaaataactcattttgtattatctgaaaatatataatttctggtcatgtgtatgttaaaatagaaaattttgaggaaaaatggaaatagggtggaaaagtactcggtaaacagtagtaaccaaatattttcactccagatttgtgttttctctggcacagagtagatcttttgggaaatatatatgaaagtggattaagtttgactacccttatgttagccacatctggatgagaacagttacaaagagtttggtctctaagttgatttgtacccagtgggtcaacttctgcaaaattccgtaatggtgtattagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagattccatttggtaaggaaatcaatattggaagtattgctaaaatcttataatatgaaaagagatccactaatgtagcttaaggttattagatttgggcttttaatcatggaataatcttatgtattggtgtaagagttgatgaatgactttagctgtgtgaatatataatagtcaaactgcaaacattttgcatcccttttgtgacctaatttacagacatttaaattgtgttgcagttctgctttgccgtttaataaaaagctatttca

SEQ ID NO: 181261 - DNA, 1838 bp, Homo sapiens
  Payload ID: 15701
  Gene Symbol: SCOC
  Gene Name: short coiled-coil protein
  Uniprot ID: Q9UIL1
  ENST ID: ENST00000506597
  CDS Start-End: 2-397
aatgcgcaggcgtgtattctcgagtcaggattggcgggcgagcggctgggacgggatgggattcttctcacggcgcacgttctgtgggcggagtgggcggagctgccggggtcagttggtccaagtgtcccggcctgaggtgtcggccggatccctccttctcccggcgcctcaagcggaagaccattcctcaagaattttgtatccaaggcccaaaagtttgttacccaagatgatgaatgctgacatggatgatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattggtgtcacatttgtaaaagtaattttaatagttaatcatctctgagagtaacctgtattttaattgttgaaacttaaccaaaataagatactgtctcagctagggcttgtcatttgtgtatttagtgttaagataggaatgctagtgtctctttaattaattggaaatagatggaggctaaaaatgaaggtttttctttgaaactgaattaacttgggaatatttgttgttaaaaacttctttttgcccaaaataactcattttgtattatctgaaaatatataatttctggtcatgtgtatgttaaaatagaaaattttgaggaaaaatggaaatagggtggaaaagtactcggtaaacagtagtaaccaaatattttcactccagatttgtgttttctctggcacagagtagatcttttgggaaatatatatgaaagtggattaagtttgactacccttatgttagccacatctggatgagaacagttacaaagagtttggtctctaagttgatttgtacccagtgggtcaacttctgcaaaattccgtaatggtgtattagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagattccatttggtaaggaaatcaatattggaagtattgctaaaatcttataatatgaaaagagatccactaatgtagcttaaggttattagatttgggcttttaatcatggaataatcttatgtattggtgtaagagttgatgaatgactttagctgtgtgaatatataatagtcaaactgcaaacattttgcatcccttttgtgacctaatttacagacatttaaattgtgttgcagttctgctttgccgtttaataaaaagctat

SEQ ID NO: 181262 - DNA, 687 bp, Homo sapiens
  Payload ID: 15701
  Gene Symbol: SCOC
  Gene Name: short coiled-coil protein
  ENST ID: ENST00000506322
  CDS Start-End: 263-511
ctcatttttcttactaacaggtctgaaaattgaacaagatggacgggtccaggaaagaggaggaggaagacagcacattcaccaacatttctcttgcagatgacatagatgaagtcacactgttgctaaaccatgcataggttttctattgtttgaattatatgtggtcagaatttcagaaactggcttctttttctttacctcttatattgaccattcctcaagaattttgtatccaaggcccaaaagtttgttacccaagatgatgaatgctgacatggatgcagttgatgctgaaaatcaagtggaactggaggaaaaaacaagacttattaatcaagtgttggaactccaacacacacttgaagatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatatttatgaagataatgtcagatgtagacaaaaataacacaataacaggagacttccataagtttgtgtattatg

SEQ ID NO: 181263 - DNA, 5129 bp, Homo sapiens
  Payload ID: 15701
  Gene Symbol: SCOC
  Gene Name: short coiled-coil protein
  Uniprot ID: Q9UIL1
  ENST ID: ENST00000608372
  CDS Start-End: 28-507
ggacgactggggtgaggcgggcagctaatgcgcaggcgtgtattctcgagtcaggattggcgggcgagcggctgggacgggatgggattcttctcacggcgcacgttctgtgggcggagtgggcggagctgccggggtcagttggtccaagtgtcccggcctgaggtgtcggccggatccctccttctcccggcgcctcaagcggaagaccattcctcaagaattttgtatccaaggcccaaaagtttgttacccaagatgatgaatgctgacatggatgcagttgatgctgaaaatcaagtggaactggaggaaaaaacaagacttattaatcaagtgttggaactccaacacacacttgaagatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattggtgtcacatttgtaaaagtaattttaatagttaatcatctctgagagtaacctgtattttaattgttgaaacttaaccaaaataagatactgtctcagctagggcttgtcatttgtgtatttagtgttaagataggaatgctagtgtctctttaattaattggaaatagatggaggctaaaaatgaaggtttttctttgaaactgaattaacttgggaatatttgttgttaaaaacttctttttgcccaaaataactcattttgtattatctgaaaatatataatttctggtcatgtgtatgttaaaatagaaaattttgaggaaaaatggaaatagggtggaaaagtactcggtaaacagtagtaaccaaatattttcactccagatttgtgttttctctggcacagagtagatcttttgggaaatatatatgaaagtggattaagtttgactacccttatgttagccacatctggatgagaacagttacaaagagtttggtctctaagttgatttgtacccagtgggtcaacttctgcaaaattccgtaatggtgtattagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagattccatttggtaaggaaatcaatattggaagtattgctaaaatcttataatatgaaaagagatccactaatgtagcttaaggttattagatttgggcttttaatcatggaataatcttatgtattggtgtaagagttgatgaatgactttagctgtgtgaatatataatagtcaaactgcaaacattttgcatcccttttgtgacctaatttacagacatttaaattgtgttgcagttctgctttgccgtttaataaaaagctatttcagaggttgtgtgtgttttgatatagttgcctaagtaaatggggtatttaggtatagtggtgtatccagggttattcaatgccacagaatagtgtatcttatttaagtacccagttactgattatttaggggaataatatttttattaatacaactataactggttatcaatataaatatcataggctattatacattaatttggaaaacaaaagcaaagcactcaaaggatccagtatctccagggaaaaaggaagttgtattttttagggtaggctaagctactttagcaagagacccagtgataaagaatataaatatagaagtttctctcccaaccagtggttccaaggtcagcattgcaggctagcagcccttgttcaaacagttattcagggactttggctgaggatggtgctgccattttaaatcatggctttcaagtcactctagttattcttctaatttgcagaaaaagaacatggaagtgtacatatgcaaggtgttatgggctgtgcctggaaatggctcatatatcttctcatattccagtggtgtggagacttagttacatctagatacaagaggagctgagaaatgtagtccctggctgggaagccatcttccagctataaatacaagattttggtggctgctagcagcctcagccacagctcttcttgtgctaccaagtatcttcccttacacagaaagtaatccctcttcatccagctagtgattcagctcacaatctaggatctctattaaaggtccatccctttacatgtggcttctaatagtctgacaatctctaaactgataggcaaattatttgctctcacccttgctgctgcccatttataatgtagttgggacaggatggccaaataaaaagtctcaatttggaaaatggaataaagggaaacgtaaaaattgtggaatgctcctgggagatgtatgaagattttgtccctagcagtggagaagttccttgattcaactatgattctgatctctggcaggggactcccttgttcattgaactccatggtttcccctctggaaagttactccttatccattttcttccatggctacctcagaagtagagattgggtgttcactccatgggaattgtgaagacagtccacttcctgctggtgtgaatttggtgcccatcattttaaggccaagctcatgtttctgtggaatacgattctctcaaaaactcaagcctttttatcagtgtgcttctgattgcatatgccgaggaaccacaaccaagcttttgaccaaattctcaaagtatgtattatttttgcctttctttaatggaggctatcttgagatcaactaaaaataagattacactgggaatgttacatgcagatcatcactgcaaagctgggttcctttggcttaacgattggtagagaagtcttcatgggcttccccccaatctcccccacctcaaaaataattttgaacctttgctgctattcagacttcagaaacaattggcttaatttcatgaggttccttgtatcaaaactttgtctattcccttctatctttgcttgaaaatgtcaatttttttgataccttgctgaaagcaaggaatagccaattcacttaacattctggctttttccagctagagctatcagattagtaggtgtcaaaatatatccccactgcttgtcatgttaatggtaagctaatgctatatacttagtttttgctatgcaatacttcaggataatttcttcattagaaatataggtggtacacagtgtgcacagggactgtgtccagcttctggaaaagactcgaccaaattttagacaggcacctctgagccctgtttttgactagtccagttttagcaaaaatcctgctaaatgagtttagagataatcccatcctcaataactgatgatcgtcaacctggcctgtctttggcaagaatcaccctactcttgatgtctccagttagtagttttccatccactgacctcatcactgctcattgactataaatcctcagttgtatttgctgtgttagttgagcccagtttctttcccttattgggtgatggtcttaacatatacagtcctgagtaaagtcttctttactgctttaacaagtgtcagaatggtttttcctttaatacttcctagtttacatgctggtagaataatgtttggtagggaaaaatcagcatactccttgttatggactgaatgtgtcctcccaaaattcttaggttgaaatcctaaccccaatgtgatgcttttaggaggtggggcttttgggagataattaggtaatgagggtgaaaccctcatgaatgggattgtgtcattaaaagaaaccccagagagctctctttctgccacatagaagacagcagtctgcatcttggaagagggccctcaacactgatctctcagacttccagcttccaaaactgagaaataaatttgtttataagccacccagtctatattttgttatagcatcccaaatagtttaaggcacccattttccccactgtttcccaatacaaatttccccagtattgacactgccattctatgcaaaatgtgtcctctttatagtccctttggactcacagcaggttactacacatcacagatcctcgtctgaaacttgtagggccagatgtcttagaatttggagttttccagattttataaaatattatgactcagacaccaatatggtttggggcaacacctataatcaagtatattaacatttctgtagcaaaatgagtattaaagtaggataaagaaagactacatatgtacataaaaccttgccggggaagtcaggctcagctaccaggtgagttttgttgccaaaatgctaggaaaatctttaacttttcagagatttttggtcatggaattgtagcaacaaaaccttttgtagaagagtaaccaaaatcatgtatgcatttagttccaactagttaatgtcacatctctattcctgtcacccttccctgtgatctagtcccttttgtaagagaaatatggtagttgaattataaaatctaaaattaattttgtggtccaaagaaaagcaaaatagatctttagaatgtaaagccattctttactttgcccaataaaaattttgttattccctg

SEQ ID NO: 181264 - DNA, 1959 bp, Homo sapiens
  Payload ID: 15701
  Gene Symbol: SCOC
  Gene Name: short coiled-coil protein
  Uniprot ID: Q9UIL1
  ENST ID: ENST00000614192
  CDS Start-End: 28-507
ggacgactggggtgaggcgggcagctaatgcgcaggcgtgtattctcgagtcaggattggcgggcgagcggctgggacgggatgggattcttctcacggcgcacgttctgtgggcggagtgggcggagctgccggggtcagttggtccaagtgtcccggcctgaggtgtcggccggatccctccttctcccggcgcctcaagcggaagaccattcctcaagaattttgtatccaaggcccaaaagtttgttacccaagatgatgaatgctgacatggatgcagttgatgctgaaaatcaagtggaactggaggaaaaaacaagacttattaatcaagtgttggaactccaacacacacttgaagatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattggtgtcacatttgtaaaagtaattttaatagttaatcatctctgagagtaacctgtattttaattgttgaaacttaaccaaaataagatactgtctcagctagggcttgtcatttgtgtatttagtgttaagataggaatgctagtgtctctttaattaattggaaatagatggaggctaaaaatgaaggtttttctttgaaactgaattaacttgggaatatttgttgttaaaaacttctttttgcccaaaataactcattttgtattatctgaaaatatataatttctggtcatgtgtatgttaaaatagaaaattttgaggaaaaatggaaatagggtggaaaagtactcggtaaacagtagtaaccaaatattttcactccagatttgtgttttctctggcacagagtagatcttttgggaaatatatatgaaagtggattaagtttgactacccttatgttagccacatctggatgagaacagttacaaagagtttggtctctaagttgatttgtacccagtgggtcaacttctgcaaaattccgtaatggtgtattagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagattccatttggtaaggaaatcaatattggaagtattgctaaaatcttataatatgaaaagagatccactaatgtagcttaaggttattagatttgggcttttaatcatggaataatcttatgtattggtgtaagagttgatgaatgactttagctgtgtgaatatataatagtcaaactgcaaacattttgcatcccttttgtgacctaatttacagacatttaaattgtgttgcagttctgctttgccgtttaataaaaagctatttcagaggttg

SEQ ID NO: 181265 - DNA, 1951 bp, Homo sapiens
  Payload ID: 15702
  Gene Symbol: SHOX
  Gene Name: short stature homeobox
  Uniprot ID: O15266
  ENST ID: ENST00000334060
  CDS Start-End: 692-1369
cgcctgcttttgcccgggtcctgagaacaggggctccccacactttttttttttttggttttgttttatttcgtttccgcgcgtctctttctactgcaaacagaaatgggagggtggacaggcgggtaggagcggatcagacgcccaggacgcagcagcccgagtccgcacagggtttgcgggaggtggtgaccgcgctggggacgccaggacgcgaatgaacctccggggcgcgctcggggcctgcgctcagagcttggaaaactggagtttgcttttcctccggccacggagagaacgcgggtaacctgtgtggggggctcgggcgcctgcgcccccctcctgcgcgcgcgctctcccttccaaaaatgggatctttcccccttcgcaccaaggtgtacggacgccaaacagtgatgaaatgagaagaaagccaattgccggcctggggggtgggggagacacagcgtctctgcgtgcgtccgccgcggagcccggagaccagtaattgcaccagacaggcagcgcatggggggctgggcgaggtcgccgcgtataaatagtgagatttccaatggaaaggcgtaaataacagcgctggtgatccacccgcgcgcacgggccgtcctctccgcgcggggagacgcgcgcatccaccagccccggctgctcgccagccccggccccagccatggaagagctcacggcttttgtatccaagtcttttgaccagaaaagcaaggacggtaacggcggaggcggaggcggcggaggtaagaaggattccattacgtaccgggaagttttggagagcggactggcgcgctcccgggagctggggacgtcggattccagcctccaggacatcacggagggcggcggccactgcccggtgcatttgttcaaggaccacgtagacaatgacaaggagaaactgaaagaattcggcaccgcgagagtggcagaagggatttatgaatgcaaagagaagcgcgaggacgtgaagtcggaggacgaggacgggcagaccaagctgaaacagaggcgcagccgcaccaacttcacgctggagcagctgaacgagctcgagcgactcttcgacgagacccattaccccgacgccttcatgcgcgaggagctcagccagcgcctggggctctccgaggcgcgcgtgcaggtttggttccagaaccggagagccaagtgccgcaaacaagagaatcagatgcataaaggcgtcatcttgggcacagccaaccacctagacgcctgccgagtggcaccctacgtcaacatgggagccttacggatgcctttccaacagatggagttttgctcttgtcgcccgggctggagtataatggcatgatctcgactcactgcaacctccgcctcccgagttcaagcgattctcctgcctcagcctcccgagtagctgggattacaggtgcccaccaccatgtcaagataatgtttgtattttcagtagagatggggtttgaccatgttggccaggctggtctcgaactcctgacctcaggtgatccacccgccttagcctcccaaagtgctgggatgacaggcgtgagcccctgcgcccggcctttgtaactttatttttaattttttttttttttttaagaaagacagagtcttgctctgtcacccaggctggagcacactggtgcgatcatagctcactgcagcctcaaactcctgggctcaagcaatcctcccacctcagcctcctgagtagctgggactacaggcacccaccaccacacccagctaatttttttgatttttactagagacgggatcttgctttgctgctgaggctggtcttgagctcctgagctccaaagatcctctcacctccacctcccaaagtgttagaattacaagcatgaaccactgcccgtggtctccaaaaaaaggactgttacgtgga

SEQ ID NO: 181266 - DNA, 1351 bp, Homo sapiens
  Payload ID: 15702
  Gene Symbol: SHOX
  Gene Name: short stature homeobox
  Uniprot ID: O15266
  ENST ID: ENST00000381575
  CDS Start-End: 92-769
gtgatccacccgcgcgcacgggccgtcctctccgcgcggggagacgcgcgcatccaccagccccggctgctcgccagccccggccccagccatggaagagctcacggcttttgtatccaagtcttttgaccagaaaagcaaggacggtaacggcggaggcggaggcggcggaggtaagaaggattccattacgtaccgggaagttttggagagcggactggcgcgctcccgggagctggggacgtcggattccagcctccaggacatcacggagggcggcggccactgcccggtgcatttgttcaaggaccacgtagacaatgacaaggagaaactgaaagaattcggcaccgcgagagtggcagaagggatttatgaatgcaaagagaagcgcgaggacgtgaagtcggaggacgaggacgggcagaccaagctgaaacagaggcgcagccgcaccaacttcacgctggagcagctgaacgagctcgagcgactcttcgacgagacccattaccccgacgccttcatgcgcgaggagctcagccagcgcctggggctctccgaggcgcgcgtgcaggtttggttccagaaccggagagccaagtgccgcaaacaagagaatcagatgcataaaggcgtcatcttgggcacagccaaccacctagacgcctgccgagtggcaccctacgtcaacatgggagccttacggatgcctttccaacagatggagttttgctcttgtcgcccgggctggagtataatggcatgatctcgactcactgcaacctccgcctcccgagttcaagcgattctcctgcctcagcctcccgagtagctgggattacaggtgcccaccaccatgtcaagataatgtttgtattttcagtagagatggggtttgaccatgttggccaggctggtctcgaactcctgacctcaggtgatccacccgccttagcctcccaaagtgctgggatgacaggcgtgagcccctgcgcccggcctttgtaactttatttttaattttttttttttttttaagaaagacagagtcttgctctgtcacccaggctggagcacactggtgcgatcatagctcactgcagcctcaaactcctgggctcaagcaatcctcccacctcagcctcctgagtagctgggactacaggcacccaccaccacacccagctaatttttttgatttttactagagacgggatcttgctttgctgctgaggctggtcttgagctcctgagctccaaagatcctctcacctccacctcccaaagtgttagaattacaagcatgaaccactgcccgtggtctccaaaaaaaggactgttacgtgga

SEQ ID NO: 181267 - DNA, 3757 bp, Homo sapiens
  Payload ID: 15702
  Gene Symbol: SHOX
  Gene Name: short stature homeobox
  Uniprot ID: O15266
  ENST ID: ENST00000381578
  CDS Start-End: 692-1570
cgcctgcttttgcccgggtcctgagaacaggggctccccacactttttttttttttggttttgttttatttcgtttccgcgcgtctctttctactgcaaacagaaatgggagggtggacaggcgggtaggagcggatcagacgcccaggacgcagcagcccgagtccgcacagggtttgcgggaggtggtgaccgcgctggggacgccaggacgcgaatgaacctccggggcgcgctcggggcctgcgctcagagcttggaaaactggagtttgcttttcctccggccacggagagaacgcgggtaacctgtgtggggggctcgggcgcctgcgcccccctcctgcgcgcgcgctctcccttccaaaaatgggatctttcccccttcgcaccaaggtgtacggacgccaaacagtgatgaaatgagaagaaagccaattgccggcctggggggtgggggagacacagcgtctctgcgtgcgtccgccgcggagcccggagaccagtaattgcaccagacaggcagcgcatggggggctgggcgaggtcgccgcgtataaatagtgagatttccaatggaaaggcgtaaataacagcgctggtgatccacccgcgcgcacgggccgtcctctccgcgcggggagacgcgcgcatccaccagccccggctgctcgccagccccggccccagccatggaagagctcacggcttttgtatccaagtcttttgaccagaaaagcaaggacggtaacggcggaggcggaggcggcggaggtaagaaggattccattacgtaccgggaagttttggagagcggactggcgcgctcccgggagctggggacgtcggattccagcctccaggacatcacggagggcggcggccactgcccggtgcatttgttcaaggaccacgtagacaatgacaaggagaaactgaaagaattcggcaccgcgagagtggcagaagggatttatgaatgcaaagagaagcgcgaggacgtgaagtcggaggacgaggacgggcagaccaagctgaaacagaggcgcagccgcaccaacttcacgctggagcagctgaacgagctcgagcgactcttcgacgagacccattaccccgacgccttcatgcgcgaggagctcagccagcgcctggggctctccgaggcgcgcgtgcaggtttggttccagaaccggagagccaagtgccgcaaacaagagaatcagatgcataaaggcgtcatcttgggcacagccaaccacctagacgcctgccgagtggcaccctacgtcaacatgggagccttacggatgcctttccaacaggtccaggctcagctgcagctggaaggcgtggcccacgcgcacccgcacctgcacccgcacctggcggcgcacgcgccctacctgatgttccccccgccgcccttcgggctgcccatcgcgtcgctggccgagtccgcctcggccgccgccgtggtcgccgccgccgccaaaagcaacagcaagaattccagcatcgccgacctgcggctcaaggcgcggaagcacgcggaggccctggggctctgacccgccgcgcagccccccgcgcgcccggactcccgggctccgcgcaccccgcctgcaccgcgcgtcctgcactcaaccccgcctggagctccttccgcggccaccgtgctccgggcaccccgggagctcctgcaagaggcctgaggagggaggctcccgggaccgtccacgcacgacccagccagaccctcgcggagatggtgcagaaggcggagcgggtgagcggccgtgcgtccagcccgggcctctccaaggctgcccgtgcgtcctgggaccctggagaagggtaaacccccgcctggctgcgtcttcctctgctataccctatgcatgcggttaactacacacgtttggaagatccttagagtctattgaaactgcaaagatcccggagctggtctccgatgaaaatgccatttcttcgttgccaacgattttctttactaccatgctccttccttcatcccgagaggctgcggaacgggtgtggatttgaatgtggacttcggaatcccaggaggcaggggccgggctctcctccaccgctcccccggagcctcccaggcagcaataaggaaatagttctctggctgaggctgaggacgtgaaccgcgggctttggaaagggaggggagggagacccgaacctcccacgttgggactcccacgttccggggacctgaatgaggaccgactttataacttttccagtgtttgattcccaaattgggtctggttttgttttggattggtatttttttttttttttttttttttttttttttttgctgtgttacaggattcagacgcaaaagacttgcataagagacggacgcgtggttgcaaggtgtcatactgatatgcagcattaactttactgacatggagtgaagtgcaatattataaatattatagattaaaaaaaaaatagccgtgcactcttgaccccgtcagcgtccaacgtggaaaaggcgttacctcttctcccagcgctggccgcctggccactgagggccctttgcaaaaatcacgggtgtagagatggccctgggcgcgctgggagtgtggttgtgtttctgaaggggataaaagagggcacggtggtgccaagatatcagtttggtacctgagctgtttctggttgggaagcgtaaaagccagggagagatccagagagttttcaagtttttgcagatgtaggtggttccagcttttctttctcccctactccatcttctgcgttcccccagttcttttatttctttgttttttatttttgagacagagacttgctttgtcgcccaggctggagtgcagtggcgcaatgtcagctcactgccacctccgcctcccgggttcaagcgatgctcctgcctcagcctcccgagtagctgggactacaggcacctgccaccacccccggctaattttttgtatttatagtagagacggggtttcaccgtgttggccaggctcgtctcgaactcctgacctcaggtgatctgcccgcctcggcctcccaacgtgcccccagttttataaacagcagatagcaacttgtcgtcacagctggcatgggctggacagttgcttgaaatgacctaaccaaaaacattcaagggttctgcccccagatttcgggagatccacgttccatgttctgattggttttctgggaacacagcaaggggtttggtgacctccgagaagatccatctgcatgattggcattagttaccacagcctgcccagagagaaactatcttctcccaacatttactaacatccactggtcaactctcttatttccataacacatttgcatctttctggattcaagcttggtggttttctttcctaacttctgatttagatacttctccctgaggtggggataaaagaaaaaaaaaaacaacttctttttttcttccgcataacactttctatcttgtcactgagctgaactgtagatccatttggacccgtctcatttgtatcttctgatattctttatacaaaccaaaagtccccttcaacattttttatgtcaaaatgttacaaccgctgtaaaatgacggagagagagagaaagaatcccagacattaacggtattagagagtttgcctcattcatccatttttcttaaaagctggaaattaaaaaaaaaaaagagagagagaggcttt

SEQ ID NO: 181268 - DNA, 1902 bp, Homo sapiens
  Payload ID: 15702
  Gene Symbol: SHOX
  Gene Name: short stature homeobox
  Uniprot ID: O15266
  ENST ID: ENST00000554971
  CDS Start-End: 92-970
gtgatccacccgcgcgcacgggccgtcctctccgcgcggggagacgcgcgcatccaccagccccggctgctcgccagccccggccccagccatggaagagctcacggcttttgtatccaagtcttttgaccagaaaagcaaggacggtaacggcggaggcggaggcggcggaggtaagaaggattccattacgtaccgggaagttttggagagcggactggcgcgctcccgggagctggggacgtcggattccagcctccaggacatcacggagggcggcggccactgcccggtgcatttgttcaaggaccacgtagacaatgacaaggagaaactgaaagaattcggcaccgcgagagtggcagaagggatttatgaatgcaaagagaagcgcgaggacgtgaagtcggaggacgaggacgggcagaccaagctgaaacagaggcgcagccgcaccaacttcacgctggagcagctgaacgagctcgagcgactcttcgacgagacccattaccccgacgccttcatgcgcgaggagctcagccagcgcctggggctctccgaggcgcgcgtgcaggtttggttccagaaccggagagccaagtgccgcaaacaagagaatcagatgcataaaggcgtcatcttgggcacagccaaccacctagacgcctgccgagtggcaccctacgtcaacatgggagccttacggatgcctttccaacaggtccaggctcagctgcagctggaaggcgtggcccacgcgcacccgcacctgcacccgcacctggcggcgcacgcgccctacctgatgttccccccgccgcccttcgggctgcccatcgcgtcgctggccgagtccgcctcggccgccgccgtggtcgccgccgccgccaaaagcaacagcaagaattccagcatcgccgacctgcggctcaaggcgcggaagcacgcggaggccctggggctctgacccgccgcgcagccccccgcgcgcccggactcccgggctccgcgcaccccgcctgcaccgcgcgtcctgcactcaaccccgcctggagctccttccgcggccaccgtgctccgggcaccccgggagctcctgcaagaggcctgaggagggaggctcccgggaccgtccacgcacgacccagccagaccctcgcggagatggtgcagaaggcggagcgggtgagcggccgtgcgtccagcccgggcctctccaaggctgcccgtgcgtcctgggaccctggagaagggtaaacccccgcctggctgcgtcttcctctgctataccctatgcatgcggttaactacacacgtttggaagatccttagagtctattgaaactgcaaagatcccggagctggtctccgatgaaaatgccatttcttcgttgccaacgattttctttactaccatgctccttccttcatcccgagaggctgcggaacgggtgtggatttgaatgtggacttcggaatcccaggaggcaggggccgggctctcctccaccgctcccccggagcctcccaggcagcaataaggaaatagttctctggctgaggctgaggacgtgaaccgcgggctttggaaagggaggggagggagacccgaacctcccacgttgggactcccacgttccggggacctgaatgaggaccgactttataacttttccagtgtttgattcccaaattgggtctggttttgttttggattggtatttttttttttttttttttttttttttttttttgctgtgttacaggattcagacgcaaaagacttgcataagagacggacgcgtggttgcaaggtgtcatactgatatgcagcattaactttactgacatggagtgaagtgcaatattataaatattatagattaaaaaaaaaatagc

SEQ ID NO: 181269 - DNA, 2072 bp, Homo sapiens
  Payload ID: 15703
  Gene Symbol: SHOX2
  Gene Name: short stature homeobox 2
  Uniprot ID: O60902
  ENST ID: ENST00000389589
  CDS Start-End: 137-1204
cctccctctcctcccccacctcctgtcccattgatgtgttattattgggggggctggagcagtaaaaaaagaagaaggaaaaaaagagcggggctctgctggcagaggttgagcgccgggctgacgtgcggcggcgatggaagaacttacggcgttcgtctccaagtcttttgaccagaaagtgaaggagaagaaggaggcgatcacgtaccgggaggtgctggagagcgggccgctgcgcggggccaaggagccgaccggctgcaccgaggcgggccgcgacgaccgcagcagcccggcagtccgggcggccggcggaggcggcggcggaggaggcggaggcggcggcggaggaggcggaggaggtgtaggaggaggaggagcaggcggaggagctggaggagggcgctctcccgtccgggagctggacatgggcgccgccgagagaagcagggagccgggcagcccgcgactgacggagggtagaaggaagccaacgaaagctgaggtccaggctacgctgcttctcccgggcgaggcgtttcggtttcttgtgtccccggagctgaaagatcgcaaagaggatgcgaaagggatggaggacgaaggccagaccaaaatcaagcagaggcgaagtcggaccaatttcaccctggaacaactcaatgagctggagaggctttttgacgagacccactatcccgacgccttcatgcgagaggaactgagccagcgactgggcctgtcggaggcccgagtgcaggtttggtttcaaaatcgaagagctaaatgtagaaaacaagaaaatcaactccataaaggtgttctcataggggccgccagccagtttgaagcttgtagagtcgcaccttatgtcaacgtaggtgctttaaggatgccatttcagcaggatagtcattgcaacgtgacgcccttgtcctttcaggttcaggcgcagctgcagctggacagcgctgtggcgcacgcgcaccaccacctgcatccgcacctggccgcgcacgcgccctacatgatgttcccagcaccgcccttcggactgccgctcgccacgctggccgcggattcggcttccgccgcctcggtagtggcggccgcagcagccgccaagaccaccagcaagaactccagcatcgccgatctcagactgaaagccaaaaagcacgccgcagccctgggtctgtgacgccaacgccagcaccaatgtcgcgcctgtcccgcggcactcagcctgcacgccctccgcgccccgctgcttctccgttacccctttgagacctcgggagccggccctcttcccgcctcactgaccatccctcgtcccctatcgcatcttggactcggaaagccagactccacgcaggaccagggatctcacgaggcacgcaggctccgtggctcctgcccgttttcctactcgagggcctagaattgggttttgtaggagcgggtttgggggagtctggagagagactggacaggggagtgctggaaccgcggagtttggctcaccgcaaagctgcaacgatggactcttgcatagaaaaaaaaatcttgttaacaatgaaaaaatgagcaaacaaaaaaatcgaaagacaaacgggagagaaaaagaggaagggaacttatttcttaactgctatttggcagaagctgaaattggagaaccaaggagcaaaaacaaattttaaaattaaagtattttatacatttaaaaatatggaaaaacaacccagacgattctcgagagactggggggagttaccaacttaaatgtgtgtttttaaaaatgcgctaagaaggcaaagcagaaagaagaggtatacttatttaaaaaactaagatgaaaaaagtgcgcagctgggaagttcacaggttttgaaactgacctttttctgcgaagttcacgttaacacgagaaatttgatgagagaggcgggcctccttttacgttgaatcagatgctttgagtttaaacccaccatgtatggaagagcaagaaaagagaaaatattaaaacgaggagagagaaaaataatattaacacaaaaaaa

SEQ ID NO: 181270 - DNA, 3038 bp, Homo sapiens
  Payload ID: 15703
  Gene Symbol: SHOX2
  Gene Name: short stature homeobox 2
  Uniprot ID: O60902
  ENST ID: ENST00000441443
  CDS Start-End: 27-1022
gagcgccgggctgacgtgcggcggcgatggaagaacttacggcgttcgtctccaagtcttttgaccagaaagtgaaggagaagaaggaggcgatcacgtaccgggaggtgctggagagcgggccgctgcgcggggccaaggagccgaccggctgcaccgaggcgggccgcgacgaccgcagcagcccggcagtccgggcggccggcggaggcggcggcggaggaggcggaggcggcggcggaggaggcggaggaggtgtaggaggaggaggagcaggcggaggagctggaggagggcgctctcccgtccgggagctggacatgggcgccgccgagagaagcagggagccgggcagcccgcgactgacggaggtgtccccggagctgaaagatcgcaaagaggatgcgaaagggatggaggacgaaggccagaccaaaatcaagcagaggcgaagtcggaccaatttcaccctggaacaactcaatgagctggagaggctttttgacgagacccactatcccgacgccttcatgcgagaggaactgagccagcgactgggcctgtcggaggcccgagtgcaggtttggtttcaaaatcgaagagctaaatgtagaaaacaagaaaatcaactccataaaggtgttctcataggggccgccagccagtttgaagcttgtagagtcgcaccttatgtcaacgtaggtgctttaaggatgccatttcagcaggatagtcattgcaacgtgacgcccttgtcctttcaggttcaggcgcagctgcagctggacagcgctgtggcgcacgcgcaccaccacctgcatccgcacctggccgcgcacgcgccctacatgatgttcccagcaccgcccttcggactgccgctcgccacgctggccgcggattcggcttccgccgcctcggtagtggcggccgcagcagccgccaagaccaccagcaagaactccagcatcgccgatctcagactgaaagccaaaaagcacgccgcagccctgggtctgtgacgccaacgccagcaccaatgtcgcgcctgtcccgcggcactcagcctgcacgccctccgcgccccgctgcttctccgttacccctttgagacctcgggagccggccctcttcccgcctcactgaccatccctcgtcccctatcgcatcttggactcggaaagccagactccacgcaggaccagggatctcacgaggcacgcaggctccgtggctcctgcccgttttcctactcgagggcctagaattgggttttgtaggagcgggtttgggggagtctggagagagactggacaggggagtgctggaaccgcggagtttggctcaccgcaaagctgcaacgatggactcttgcatagaaaaaaaaatcttgttaacaatgaaaaaatgagcaaacaaaaaaatcgaaagacaaacgggagagaaaaagaggaagggaacttatttcttaactgctatttggcagaagctgaaattggagaaccaaggagcaaaaacaaattttaaaattaaagtattttatacatttaaaaatatggaaaaacaacccagacgattctcgagagactggggggagttaccaacttaaatgtgtgtttttaaaaatgcgctaagaaggcaaagcagaaagaagaggtatacttatttaaaaaactaagatgaaaaaagtgcgcagctgggaagttcacaggttttgaaactgacctttttctgcgaagttcacgttaacacgagaaatttgatgagagaggcgggcctccttttacgttgaatcagatgctttgagtttaaacccaccatgtatggaagagcaagaaaagagaaaatattaaaacgaggagagagaaaaataatattaacacaaaaaaatgccacagacaatgatttctctgagaaattattatggcaaaactgtctggactgctgacagtaaattccggtttgcatgttacttgtattccattgatggtgtgtctcctcccacccccttatctcccatgcactcactccattttcatcttcactatgaaaaacaataccaaaagtatctggaaattgatatatatatatccatatatatatatcatatatttgccatatatatatatatatatatatatatatatatatatatatatttgccctgtctttgatcctggggaacaaaagaaaaaagtcagaaagggaaaaaattacactcattgtcctaagaagacagaggtgggcagaatatgtggggaaaggaaaaagaaaacaagaccaccaaatgaaataatgaaggtacagcgcctcgctgtgccagacacagtaggcgctcaatcagtattagttcccaccattccccttttcttgtgttccttcttgttggtttcctgaagtcctatttgaagacagtggtttatttccccctctctatcccgtcaaattcaccttaaataacacccagctagatacaggcactaggtttgtgtaagatatgttgatacacacgaacaaagtttattttgactataatgtgtggactgactttcaacatttgcattttatctcacaaaggtgtatctattcaagtaaccttttttttttgtttgtttgtttcttttttgtttttttttttcttttggttgtttgtttcaattcatgtagctatttaaactgggataccttggactaagccagtctgtatcccaattcgctagcaagcctaagtttgtggggttttgtttttgtttttgttttaccttctaatttacaagaaagaggaaaagctcttctaactgaactttggtatgcggttgagctttgtaactatttgttctccatgaaaacaaaattatttatatttgacatatttttttctagtgtattaagttattttaaacaaaagatgttatctcatgacgtgttgtcagtacaaaatgtgtcgcctccaattctgttaaaccttttaaataagtgccaagttattaattgaagacactttgcgatcaattgaatgaaaatatcgtttcatttga

SEQ ID NO: 181271 - DNA, 1513 bp, Homo sapiens
  Payload ID: 15703
  Gene Symbol: SHOX2
  Gene Name: short stature homeobox 2
  ENST ID: ENST00000425436
  CDS Start-End: 43-615
gtgtccccggagctgaaagatcgcaaagaggatgcgaaagggatggaggacgaaggccagaccaaaatcaagcagaggcgaagtcggaccaatttcaccctggaacaactcaatgagctggagaggctttttgacgagacccactatcccgacgccttcatgcgagaggaactgagccagcgactgggcctgtcggaggcccgagtgcaggtttggtttcaaaatcgaagagctaaatgtagaaaacaagaaaatcaactccataaaggtgttctcataggggccgccagccagtttgaagcttgtagagtcgcaccttatgtcaacgtaggtgctttaaggatgccatttcagcaggttcaggcgcagctgcagctggacagcgctgtggcgcacgcgcaccaccacctgcatccgcacctggccgcgcacgcgccctacatgatgttcccagcaccgcccttcggactgccgctcgccacgctggccgcggattcggcttccgccgcctcggtagtggcggccgcagcagccgccaagaccaccagcaagaactccagcatcgccgatctcagactgaaagccaaaaagcacgccgcagccctgggtctgtgacgccaacgccagcaccaatgtcgcgcctgtcccgcggcactcagcctgcacgccctccgcgccccgctgcttctccgttacccctttgagacctcgggagccggccctcttcccgcctcactgaccatccctcgtcccctatcgcatcttggactcggaaagccagactccacgcaggaccagggatctcacgaggcacgcaggctccgtggctcctgcccgttttcctactcgagggcctagaattgggttttgtaggagcgggtttgggggagtctggagagagactggacaggggagtgctggaaccgcggagtttggctcaccgcaaagctgcaacgatggactcttgcatagaaaaaaaaatcttgttaacaatgaaaaaatgagcaaacaaaaaaatcgaaagacaaacgggagagaaaaagaggaagggaacttatttcttaactgctatttggcagaagctgaaattggagaaccaaggagcaaaaacaaattttaaaattaaagtattttatacatttaaaaatatggaaaaacaacccagacgattctcgagagactggggggagttaccaacttaaatgtgtgtttttaaaaatgcgctaagaaggcaaagcagaaagaagaggtatacttatttaaaaaactaagatgaaaaaagtgcgcagctgggaagttcacaggttttgaaactgacctttttctgcgaagttcacgttaacacgagaaatttgatgagagaggcgggcctccttttacgttgaatcagatgctttgagtttaaacccaccatgtatggaagagcaagaaaagagaaaatattaaaacgaggagagagaaattattatggcaaaactgtctggactgctgacagtaaattccggtttgcatg

SEQ ID NO: 181272 - DNA, 1866 bp, Homo sapiens
  Payload ID: 15703
  Gene Symbol: SHOX2
  Gene Name: short stature homeobox 2
  Uniprot ID: O60902
  ENST ID: ENST00000483851
  CDS Start-End: 480-1439
ccgagttgcgaggggaggtaatttactcaaaacaagaggccgccgttaggaagtataaatagtgggacttcaagcgcagcgtcgctatcagatctgaactctccgcaggaagaattgtcaaagatcttaacattgaacaagcgcgctccggcagggaagcatcagttcccatttccctccggcagcccccgccccttctcttctcctcctcctcctccctctcctcttcacccttctccccctcttcctcttcttcctcctcctcctcttcttacttctttttctccttctacttctcctcctctttcttctttcttctcctctttttcttcttctttctcctcctccctctcctcccccacctcctgtcccattgatgtgttattattgggggggctggagcagtaaaaaaagaagaaggaaaaaaagagcggggctctgctggcagaggttgagcgccgggctgacgtgcggcggcgatggaagaacttacggcgttcgtctccaagtcttttgaccagaaagtgaaggagaagaaggaggcgatcacgtaccgggaggtgctggagagcgggccgctgcgcggggccaaggagccgaccggctgcaccgaggcgggccgcgacgaccgcagcagcccggcagtccgggcggccggcggaggcggcggcggaggaggcggaggcggcggcggaggaggcggaggaggtgtaggaggaggaggagcaggcggaggagctggaggagggcgctctcccgtccgggagctggacatgggcgccgccgagagaagcagggagccgggcagcccgcgactgacggaggtgtccccggagctgaaagatcgcaaagaggatgcgaaagggatggaggacgaaggccagaccaaaatcaagcagaggcgaagtcggaccaatttcaccctggaacaactcaatgagctggagaggctttttgacgagacccactatcccgacgccttcatgcgagaggaactgagccagcgactgggcctgtcggaggcccgagtgcaggtttggtttcaaaatcgaagagctaaatgtagaaaacaagaaaatcaactccataaaggtgttctcataggggccgccagccagtttgaagcttgtagagtcgcaccttatgtcaacgtaggtgctttaaggatgccatttcagcaggttcaggcgcagctgcagctggacagcgctgtggcgcacgcgcaccaccacctgcatccgcacctggccgcgcacgcgccctacatgatgttcccagcaccgcccttcggactgccgctcgccacgctggccgcggattcggcttccgccgcctcggtagtggcggccgcagcagccgccaagaccaccagcaagaactccagcatcgccgatctcagactgaaagccaaaaagcacgccgcagccctgggtctgtgacgccaacgccagcaccaatgtcgcgcctgtcccgcggcactcagcctgcacgccctccgcgccccgctgcttctccgttacccctttgagacctcgggagccggccctcttcccgcctcactgaccatccctcgtcccctatcgcatcttggactcggaaagccagactccacgcaggaccagggatctcacgaggcacgcaggctccgtggctcctgcccgttttcctactcgagggcctagaattgggttttgtaggagcgggtttgggggagtctggagagagactggacaggggagtgctggaaccgcggagtttggctcaccgcaaagctgcaacgatggactcttgcatagaaaaaaaaatcttgttaacaatgaaaaaatgagcaaacaaaaaaatcgaaagacaaacgggagagaaaaa

SEQ ID NO: 181273 - DNA, 439 bp, Homo sapiens
  Payload ID: 15703
  Gene Symbol: SHOX2
  Gene Name: short stature homeobox 2
  ENST ID: ENST00000554685
  CDS Start-End: 1-439
gagagaagcagggagccgggcagcccgcgactgacggaggaaggaagccaacgaaagctgaggtccaggctacgctgcttctcccgggcgaggcgtttcggtttcttgtgtccccggagctgaaagatcgcaaagaggatgcgaaagggatggaggacgaaggccagaccaaaatcaagcagaggcgaagtcggaccaatttcaccctggaacaactcaatgagctggagaggctttttgacgagacccactatcccgacgccttcatgcgagaggaactgagccagcgactgggcctgtcggaggcccgagtgcaggtttggtttcaaaatcgaagagctaaatgtagaaaacaagaaaatcaactccataaaggtgttctcataggggccgccagccagtttgaagcttgtagagtcgcaccttatgtcaacgtagg

SEQ ID NO: 181274 - DNA, 2879 bp, Homo sapiens
  Payload ID: 15704
  Gene Symbol: SHQ1
  Gene Name: SHQ1, H/ACA ribonucleoprotein assembly factor
  Uniprot ID: Q6PI26
  ENST ID: ENST00000325599
  CDS Start-End: 141-1874
gcgcgagcacttccgcctcgagccggaagctccgtccctcacaccgagagttcctgcgcgtggggagttggagagtttgcgtggcgggaacgcggcggcagtgagagcgagcggcgccggcccttgcgtccggtgcggcgatgctgaccccggcgttcgacctcagccaggatccggacttcctgactatcgccatccgcgtgccctacgcccgggtctccgagttcgacgtctacttcgaggggtctgacttcaagttctacgccaagccatactttctcagattaacccttcctggaagaattgtagaaaatggaagtgagcaagggtcctatgatgcagataaaggaatttttaccattcgcctgcccaaagaaacccctggccagcattttgaggggctgaacatgttaactgctcttctggcaccaagaaaatccaggacagcaaaaccacttgtggaagaaataggtgcttctgagattcctgaggaagtagttgacgatgaagagtttgattgggaaattgagcagacaccctgtgaagaggtatcagaaagtgctttgaatccgcagtgccactatggatttggaaacttacgatcaggagtgttgcaacggttacaggatgaactgagtgatgttattgatattaaggatccagatttcacccctgcagctgaacgaagacagaagcgcctggccgctgagctggccaagtttgatcctgatcattatctagctgacttttttgaagatgaggcgattgaacagattttgaagtataatccttggtggactgacaaatattcaaaaatgatggcctttttggaaaagagtcaggaacaagaaaatcatgctacattagtgtctttttctgaagaagagaagtatcagctacgaaaatttgtcaataaatcttatctgctggacaagagagcctgtcgtcaagtgtgctacagtttgattgatatccttctggcatattgctatgaaacccgtgtcactgaaggagagaagaatgttgaatctgcatggaatatcaggaaactgagtccaacactatgctggtttgagacttggactaacgttcatgatatcatggtgtcttttggaagaagggtgttgtgttacccactctatcgccatttcaagctggtgatgaaggcctacagggacactataaagatattgcaactgggtaaaagtgcagttttaaagtgtctcctggatattcacaaaatttttcaggaaaatgacccagcgtacatactgaatgatctctacatctcagactactgtgtgtggattcagaaagtcaaatccaaaaagttggcagctcttgcagaagccttaaaggaagtctcccttacaaaggcccagctggggttagaactggaagaactagaagcagcagcactgcttgtccaggaggaagaaactgcattaaaagcagcccattcagtttctgggcagcagacactttgctccagctctgaggcaagtgattcggaggactcagacagcagcgtgtcatctggaaacgaagactcaggctcagattcagaacaagatgaactcaaagatagtccatctgagacagtcagttctttgcaaggtccctttcttgaagaaagcagtgcctttcttattgttgatggtggagtacgcagaaacacagccatccaggagtctgatgccagtcagggaaagccacttgcctcttcctggcctcttggagtgtctgggcctctgatagaggagcttggggaacaactgaagactacagttcaggtttctgaacccaagggcaccactgctgtaaaccgcagcaatattcaggagagagacggctgtcagacaccaaataattgactcttaggtggttttattcattgttgagaaatatggtagattgggtttcatttaccgaatgagaattcttcattttcactttgtaatttttcttagtatatagtcagcccactgtatttgtgtgttccacatctgtggattcaaccaactgcagatcaaaaatattgaagaaaaaatcgcatctgtaccaaacatgtacagacttttttcttgttattattctctaaataatacagtatgacaactatttccacagcatttacattgtattgggtaatataagtaatctagtgatgatttaaactgtgcaggaggatgtgggtaggttatatgcaaatactgcaccattttttatcaggggcttgagcatctgaggattttagtatcctcaggagtcctggaaccaaccccccacagatacggggacaactttatgacattgtttttcaaccaatgaatgtttataccttttgttttccttgccgcgactgtgaagataaagttcaaaagtatttttaccaaagtgtagctaatatttcaagctgaaaataatagttctactgcccgtgtctccagaatgtagagcccatcaatatttttattttaggaggtgtacttgacacccaataaactgcacgtatcaaaagtgtacaatgtgttggcgtatgtataccctgcgtaaaactatcaccacaactgaagtgaggaacggacccatcattcccaagtgcccttgtgccctgttattagtttgcatgtcctagaattctatgtaaattgaatcatacaatatgtatcccttttttggtcaggcatattttactcagtatagttattttgagattcatccatgtggtagcatgtgtcacgagtttttgtttttatgtttttcattgctgagtactgcttcattgaatagatttgttcattgacctatcgatggacacctgggttgtttccagtttggggctgttataaataaagctgttatgaacatttgtgtac

SEQ ID NO: 181275 - DNA, 2844 bp, Homo sapiens
  Payload ID: 15704
  Gene Symbol: SHQ1
  Gene Name: SHQ1, H/ACA ribonucleoprotein assembly factor
  ENST ID: ENST00000444040
  CDS Start-End: 76-228
agttggagagtttgcgtggcgggaacgcggcggcagtgagagcgagcggcgccggcccttgcgtccggtgcggcgatgctgaccccggcgttcgacctcagccaggatccggacttcctgactatcgccatccgcgtgccctacgcccgggtctccgagttcgacgtctacttcgaggggtctgacttcaagttctacgccaagccatactttctcaggacttcatgagacctgtgttaaatctgcagattaacccttcctggaagaattgtagaaaatggaagtgagcaagggtcctatgatgcagataaaggaatttttaccattcgcctgcccaaagaaacccctggccagcattttgaggggctgaacatgttaactgctcttctggcaccaagaaaatccaggacagcaaaaccacttgtggaagaaataggtgcttctgagattcctgaggaagtagttgacgatgaagagtttgattgggaaattgagcagacaccctgtgaagaggtatcagaaagtgctttgaatccgcagtgccactatggatttggaaacttacgatcaggagtgttgcaacggttacaggatgaactgagtgatgttattgatattaaggatccagatttcacccctgcagctgaacgaagacagaagcgcctggccgctgagctggccaagtttgatcctgatcattatctagctgacttttttgaagatgaggcgattgaacagattttgaagtataatccttggtggactgacaaatattcaaaaatgatggcctttttggaaaagagtcaggaacaagaaaatcatgctacattagtgtctttttctgaagaagagaagtatcagctacgaaaatttgtcaataaatcttatctgctggacaagagagcctgtcgtcaagtgtgctacagtttgattgatatccttctggcatattgctatgaaacccgtgtcactgaaggagagaagaatgttgaatctgcatggaatatcaggaaactgagtccaacactatgctggtttgagacttggactaacgttcatgatatcatggtgtcttttggaagaagggtgttgtgttacccactctatcgccatttcaagctggtgatgaaggcctacagggacactataaagatattgcaactgggtaaaagtgcagttttaaagtgtctcctggatattcacaaaatttttcaggaaaatgacccagcgtacatactgaatgatctctacatctcagactactgtgtgtggattcagaaagtcaaatccaaaaagttggcagctcttgcagaagccttaaaggaagtctcccttacaaaggcccagctggggttagaactggaagaactagaagcagcagcactgcttgtccaggaggaagaaactgcattaaaagcagcccattcagtttctgggcagcagacactttgctccagctctgaggcaagtgattcggaggactcagacagcagcgtgtcatctggaaacgaagactcaggctcagattcagaacaagatgaactcaaagatagtccatctgagacagtcagttctttgcaaggtccctttcttgaagaaagcagtgcctttcttattgttgatggtggagtacgcagaaacacagccatccaggagtctgatgccagtcagggaaagccacttgcctcttcctggcctcttggagtgtctgggcctctgatagaggagcttggggaacaactgaagactacagttcaggtttctgaacccaagggcaccactgctgtaaaccgcagcaatattcaggagagagacggctgtcagacaccaaataattgactcttaggtggttttattcattgttgagaaatatggtagattgggtttcatttaccgaatgagaattcttcattttcactttgtaatttttcttagtatatagtcagcccactgtatttgtgtgttccacatctgtggattcaaccaactgcagatcaaaaatattgaagaaaaaatcgcatctgtaccaaacatgtacagacttttttcttgttattattctctaaataatacagtatgacaactatttccacagcatttacattgtattgggtaatataagtaatctagtgatgatttaaactgtgcaggaggatgtgggtaggttatatgcaaatactgcaccattttttatcaggggcttgagcatctgaggattttagtatcctcaggagtcctggaaccaaccccccacagatacggggacaactttatgacattgtttttcaaccaatgaatgtttataccttttgttttccttgccgcgactgtgaagataaagttcaaaagtatttttaccaaagtgtagctaatatttcaagctgaaaataatagttctactgcccgtgtctccagaatgtagagcccatcaatatttttattttaggaggtgtacttgacacccaataaactgcacgtatcaaaagtgtacaatgtgttggcgtatgtataccctgcgtaaaactatcaccacaactgaagtgaggaacggacccatcattcccaagtgcccttgtgccctgttattagtttgcatgtcctagaattctatgtaaattgaatcatacaatatgtatcccttttttggtcaggcatattttactcagtatagttattttgagattcatccatgtggtagcatgtgtcacgagtttttgtttttatgtttttcattgctgagtactgcttcattgaatagatttgttcattgacctatcgatggacacctgggttgtttccagtttggggctgttataaataaagctgttatgaacatttgtgtac

SEQ ID NO: 181276 - DNA, 2065 bp, Homo sapiens
  Payload ID: 15704
  Gene Symbol: SHQ1
  Gene Name: SHQ1, H/ACA ribonucleoprotein assembly factor
  Uniprot ID: Q6PI26
  ENST ID: ENST00000463369
  CDS Start-End: 91-1740
aagattgcgctatcgcactccagcctgagtaacagagcgagactgtctaaaaaaaaaaaaaaaaagaacatacagtttgctataccaaggatgaataaaacctggtccctctccttgaagaatggagactgtagctgcggaggccccatattaacccttcctggaagaattgtagaaaatggaagtgagcaagggtcctatgatgcagataaaggaatttttaccattcgcctgcccaaagaaacccctggccagcattttgaggggctgaacatgttaactgctcttctggcaccaagaaaatccaggacagcaaaaccacttgtggaagaaataggtgcttctgagattcctgaggaagtagttgacgatgaagagtttgattgggaaattgagcagacaccctgtgaagaggtatcagaaagtgctttgaatccgcagtgccactatggatttggaaacttacgatcaggagtgttgcaacggttacaggatgaactgagtgatgttattgatattaaggatccagatttcacccctgcagctgaacgaagacagaagcgcctggccgctgagctggccaagtttgatcctgatcattatctagctgacttttttgaagatgaggcgattgaacagattttgaagtataatccttggtggactgacaaatattcaaaaatgatggcctttttggaaaagagtcaggaacaagaaaatcatgctacattagtgtctttttctgaagaagagaagtatcagctacgaaaatttgtcaataaatcttatctgctggacaagagagcctgtcgtcaagtgtgctacagtttgattgatatccttctggcatattgctatgaaacccgtgtcactgaaggagagaagaatgttgaatctgcatggaatatcaggaaactgagtccaacactatgctggtttgagacttggactaacgttcatgatatcatggtgtcttttggaagaagggtgttgtgttacccactctatcgccatttcaagctggtgatgaaggcctacagggacactataaagatattgcaactgggtaaaagtgcagttttaaagtgtctcctggatattcacaaaatttttcaggaaaatgacccagcgtacatactgaatgatctctacatctcagactactgtgtgtggattcagaaagtcaaatccaaaaagttggcagctcttgcagaagccttaaaggaagtctcccttacaaaggcccagctggggttagaactggaagaactagaagcagcagcactgcttgtccaggaggaagaaactgcattaaaagcagcccattcagtttctgggcagcagacactttgctccagctctgaggcaagtgattcggaggactcagacagcagcgtgtcatctggaaacgaagactcaggctcagattcagaacaagatgaactcaaagatagtccatctgagacagtcagttctttgcaaggtccctttcttgaagaaagcagtgcctttcttattgttgatggtggagtacgcagaaacacagccatccaggagtctgatgccagtcagggaaagccacttgcctcttcctggcctcttggagtgtctgggcctctgatagaggagcttggggaacaactgaagactacagttcaggtttctgaacccaagggcaccactgctgtaaaccgcagcaatattcaggagagagacggctgtcagacaccaaataattgactcttaggtggttttattcattgttgagaaatatggtagattgggtttcatttaccgaatgagaattcttcattttcactttgtaatttttcttagtatatagtcagcccactgtatttgtgtgttccacatctgtggattcaaccaactgcagatcaaaaatattgaagaaaaaatcgcatctgtaccaaacatgtacagacttttttcttgttattattctctaaataatacagtatgacaactatttccacagcatttacattgtattgggtaatataagtaatctagtgatgatttaaactgtgcaggaggatgtgggtag

SEQ ID NO: 181277 - DNA, 553 bp, Homo sapiens
  Payload ID: 15704
  Gene Symbol: SHQ1
  Gene Name: SHQ1, H/ACA ribonucleoprotein assembly factor
  ENST ID: ENST00000471526
  CDS Start-End: 133-324
acttccgcctcgagccggaagctccgtccctcacaccgagagttcctgcgcgtggggagttggagagtttgcgtggcgggaacgcggcggcagtgagagcgagcggcgccggcccttgcgtccggtgcggcgatgctgaccccggcgttcgacctcagccaggatccggacttcctgactatcgccatccgcgtgccctacgcccgggtctccgagttcgacgtctacttcgaggggtctgacttcaagttctacgccaagccatactttctcaggaatttttaccattcgcctgcccaaagaaacccctggccagcattttgaggggctgaacatgttaactgctcttctggcaccaagaaaatccaggacagcaaaaccacttgtggaagaaataggtgcttctgagattcctgaggaagtagttgacgatgaagagtttgattgggaaattgagcagacaccctgtgaagaggtatcagaaagtgctttgaatccgcagtgccactatggatttggaaacttacgatcaggagtgttgcaacggttacag

SEQ ID NO: 181278 - DNA, 502 bp, Homo sapiens
  Payload ID: 15704
  Gene Symbol: SHQ1
  Gene Name: SHQ1, H/ACA ribonucleoprotein assembly factor
  ENST ID: ENST00000482785
  CDS Start-End: 171-502
agggccaactcagattcattctgggagggtactacacaaggtgcggattaacccttcctggaagaattgtagaaaatggaagtgagcaagggtcctatgatgcagataaaggaatttttaccattcgcctgcccaaagaaacccctggccagcattttgaggggctgaacatgttaactgctcttctggcaccaagaaaatccaggacagcaaaaccacttgtggaagaaataggtgcttctgagattcctgaggaagtagttgacgatgaagagtttgattgggaaattgagcagacaccctgtgaagaggtatcagaaagtgctttgaatccgcagtgccactatggatttggaaacttacgatcaggagtgttgcaacggttacaggatgaactgagtgatgttattgatattaaggatccagatttcacccctgcagctgaacgaagacagaagcgcctggccgctgagctggccaagtttgatcctgatcattatct

SEQ ID NO: 181279 - DNA, 3190 bp, Homo sapiens
  Payload ID: 15705
  Gene Symbol: SHROOM1
  Gene Name: shroom family member 1
  Uniprot ID: Q2M3G4
  ENST ID: ENST00000319854
  CDS Start-End: 171-2714
agcgcttgtgacggtgtgaccagggaggggaagtgtaagtgtctggccgtccgtggtggcggggccagcaggctgtcccagccctcacccggagctcctcacccggcaccacatctgtgttttcccaggacccacgcagccacccagcctcagcactcatctgcgcagccatggaggccctgggacctgggggcgaccgcgcctccccggcctcgtccactagcagcctggacctgtggcatctgtccatgcgcgcggactcggcctacagctctttctccgcagcctccggcggccccgagccgcgcacgcagtcgccggggacagacctccttccttacctagactgggactacgtgcgtgtggtttggggcggcccgggccccgccccgcccgacgctgccctttgcacatccccgcggccccggcccgcggttgcagcccgcagtgggccgcagccaacagaggtcccggggaccccgggaccactgaacaggcaggccaccccgctgctgtacgcgctggcggccgaggcggaggccgcggcgcaggctgccgagccgcccagcccgccggcctcgagggccgcctaccgccagcggcttcagggcgcgcagcggcgagtgctccgggagacgtcgttccagcgcaaggagctccgcatgagcctgcccgcccgtctgcggcccactgtcccagcgcggcccccggcgactcacccgcgctccgcctcgctcagccacccgggcggggagggggagccggcgcgctcccgggctcccgcgccaggaactgccggccggggtcccctcgccaaccagcagcggaagtggtgcttctcagagccaggaaagctggatcgtgtgggtcggggcggtgggccggcgcgggaatgcctgggtgaggcctgctccagctctggcctccctgggcccgagcccttggagttccagcatccggcgctggctaagtttgaagatcacgaggtcggatggctgcccgagacgcaaccccaaggctccatgaacctggactccgggtccttgaagctcggtgatgccttcaggcccgccagtcggagtcggagcgcttcaggcgaagtcttgggttcctggggaggatcaggagggaccatacccattgtccaggctgttccccaaggagcagaaacccccagaccattgtttcagaccaaactttccaggttcttgcctcagaaagaggctgcggtgatgtatcctgcagagttaccccagagcagccctgctgacagtgaacagagggtctcagagacctgcattgtgcctgcctggctcccctcccttcctgatgaagtgttcctagaagaggccccactggtcagaatgagatcaccaccagacccccatgcctcccaggggcccccagccagtgtccatgcctctgaccagccgtatggaactggcttaggccaaagaactggccaggttacagtccccacagagtacccgctccatgagtgtccaggaactgcaggggcagatgactgctggcagggggtgaatggttctgtaggtatttccaggcccacaagccacacccccactgggactgcaaatgataacatcccaactattgaccccactggactgaccaccaatccccccacagctgcagagagtgacctcctcaaacctgtcccagctgatgccttgggactttcaggcaatgatactccaggtccctctcacaatactgccctagccaggggcactggccagcctggttccaggcccacatggcctagtcagtgcctcgaggagctggttcaggagctggccagattagatccctctctatgtgaccctcttgcttcccagcccagcccagagccacccctgggcctgctggatggactgattcctttagcagaggtccgggctgcaatgcggcctgcctgtggggaggctggagaggaggctgccagtacttttgagccagggtcctatcagttcagcttcacccagctcctgccggctcctcgggaggagacaaggcttgaaaaccctgccacccaccctgtgcttgaccagccatgtgggcaggggctccctgcaccaaacaacagcatccagggcaagaaagtggagctggccgcccgcctccaaaagatgcttcaggaccttcacacggagcaggagcggctgcagggggaggcacaagcgtgggccaggcgccaagcggctctggaggctgcagtgcgccaggcctgtgcccctcaggagctggagcggttcagccggttcatggccgacctagagcgcgtgcttggccttctgctgctgctgggcagtcgcctggcgcgcgtgcgccgcgccctggcccgggcggcctcagacagcgaccctgatgagcagcgactccggctcctgcagcggcaggaggaggacgccaaggagctgaaggagcacgtagcgcggcgcgagcgggccgtgcgggaggtgctggtgcgagcactaccggtggaggagctgcgcgtctattgcgccctgctggcgggcaaggccgccgtcctggcccagcagcgcaacctggacgagcgcatccgcctccttcaggaccaactggacgccatcagggacgaccttggccatcatgccccgtctcccagcccggcgcggcccccagggacctgtcctccagttcagccgcccttccctcttctccttacatagttataggtggagagggtggggtgcaccgcccctatctctcacccacgtaagtggggtgatgctgatttagtctctgcttttcccttgagggattggggaggacccagtccaggcctttctaagatactcctccagccgggcgcggtggctcacgcctgtaatcccagcactttgggaggccgaggcgggcggatcacaaggtcaggagatcgagaccatcctggctaacacggtgaaaccccgtctctactaaaaatataaaaaattagccgggcgtggtggcgggtgcctgtattgccagctactcggaaggctgaggcaggagaatggcgtgaacctgggaggtggagcttgcagtgagcggacatcgcgccactgcactccagcctgggcgacagagcaagactccgtctcaaaaaaaaaaaaaaaaaaaaaaaaaaaaaagatacttctccaaagtgttctcatgtggcctc

SEQ ID NO: 181280 - DNA, 2352 bp, Homo sapiens
  Payload ID: 15705
  Gene Symbol: SHROOM1
  Gene Name: shroom family member 1
  ENST ID: ENST00000378676
  CDS Start-End: 1-2352
atggaggccctgggacctgggggcgaccgcgcctccccggcctcgtccactagcagcctggacctgtggcatctgtccatgcgcgcggactcggcctacagctctttctccgcagcctccggcggccccgagccgcgcacgcagtcgccggggacagacctccttccttacctagactgggactacgtgcgtgtggtttggggcggcccgggccccgccccgcccgacgctgccctttgcacatccccgcggccccggcccgcggttgcagcccgcagtgggccgcagccaacagaggtcccggggaccccgggaccactgaacaggcaggccaccccgctgctgtacgcgctggcggccgaggcggaggccgcggcgcaggctgccgagccgcccagcccgccggcctcgagggccgcctaccgccagcggcttcagggcgcgcagcggcgagtgctccgggagacgtcgttccagcgcaaggagctccgcatgagcctgcccgcccgtctgcggcccactgtcccagcgcggcccccggcgactcacccgcgctccgcctcgctcagccacccgggcggggagggggagccggcgcgctcccgggctcccgcgccaggaactgccggccggggtcccctcgccaaccagcagcggaagtggtgcttctcagagccaggaaagctggatcgtgtgggtcggggcggtgggccggcgcgggaatgcctgggtgaggcctgctccagctctggcctccctgggcccgagcccttggagttccagcatccggcgctggctaagtttgaagatcacgaggtcggatggctgcccgagacgcaaccccaaggctccatgaacctggactccgggtccttgaagctcggtgatgccttcaggcccgccagtcggagtcggagcgcttcaggcgaagtcttgggttcctggggaggatcaggagggaccatacccattgtccaggctgttccccaaggagcagaaacccccagaccattgtttcagaccaaactttccagtgtccatgcctctgaccagccgtatggaactggcttaggccaaagaactggccaggttacagtccccacagagtacccgctccatgagtgtccaggaactgcaggggcagatgactgctggcagggggtgaatggttctgtaggtatttccaggcccacaagccacacccccactgggactgcaaatgataacatcccaactattgaccccactggactgaccaccaatccccccacagctgcagagagtgacctcctcaaacctgtcccagctgatgccttgggactttcaggcaatgatactccaggtccctctcacaatactgccctagccaggggcactggccagcctggttccaggcccacatggcctagtcagtgcctcgaggagctggttcaggagctggccagattagatccctctctatgtgaccctcttgcttcccagcccagcccagagccacccctgggcctgctggatggactgattcctttagcagaggtccgggctgcaatgcggcctgcctgtggggaggctggagaggaggctgccagtacttttgagccagggtcctatcagttcagcttcacccagctcctgccggctcctcgggaggagacaaggcttgaaaaccctgccacccaccctgtgcttgaccagccatgtgggcaggggctccctgcaccaaacaacagcatccagggcaagaaagtggagctggccgcccgcctccaaaagatgcttcaggaccttcacacggagcaggagcggctgcagggggaggcacaagcgtgggccaggcgccaagcggctctggaggctgcagtgcgccaggcctgtgcccctcaggagctggagcggttcagccggttcatggccgacctagagcgcgtgcttggccttctgctgctgctgggcagtcgcctggcgcgcgtgcgccgcgccctggcccgggcggcctcagacagcgaccctgatgagcaggcctccctgctgcagcgactccggctcctgcagcggcaggaggaggacgccaaggagctgaaggagcacgtagcgcggcgcgagcgggccgtgcgggaggtgctggtgcgagcactaccggtggaggagctgcgcgtctattgcgccctgctggcgggcaaggccgccgtcctggcccagcagcgcaacctggacgagcgcatccgcctccttcaggaccaactggacgccatcagggacgaccttggccatcatgccccgtctcccagcccggcgcggcccccagggacctgtcctccagttcagccgcccttccctcttctccttacatag

SEQ ID NO: 181281 - DNA, 4019 bp, Homo sapiens
  Payload ID: 15705
  Gene Symbol: SHROOM1
  Gene Name: shroom family member 1
  Uniprot ID: Q2M3G4
  ENST ID: ENST00000378679
  CDS Start-End: 806-3364
cggacgcgctggaggccggtgggcggtcgccgtagtcgccctcccaccacctcgctcaggtttctccggcctggggcaagaggcctgtggcccgcgcgggaacgcactgtccaccctcagacctgggactgggccggcgcgcggacgctaccaagaggctgcggctcccgcccccgcggccggacgtggcgcctcccctgaggccgcggccggagcctggaggtggggtcggagtcagagcccggggctctgatgtcaccgcgcggctgcgacggcccaggagcgcgtctcggcgggagcctcagagcctcactttgtcgccaggctggagtgcagtggcgcgatctcggctcactacaacttccgcctcccgggttcaagcgattcttctgcctcagcctcccgagtagctgggactacaggcgtgtgccaccacgcccagctaatttttgggaaagatcacatggagaagccaacagaacggccaggaagcagcctgggtggaacagggttggggaggaaaggaacatgggtacattctcagcgttccaggaggtctcagggtaaaggctgcttgtgtgggcaaggggagcctggcagggaatgagctggtcccaattccttcccctgagctgggccctcaaccttcagaggtgctccctgggactggtcctacttcctctgccacctctgatcccaaggtgactctgccaaaatctgggggatgccagcgcttgtgacggtgtgaccagggaggggaagtgacccacgcagccacccagcctcagcactcatctgcgcagccatggaggccctgggacctgggggcgaccgcgcctccccggcctcgtccactagcagcctggacctgtggcatctgtccatgcgcgcggactcggcctacagctctttctccgcagcctccggcggccccgagccgcgcacgcagtcgccggggacagacctccttccttacctagactgggactacgtgcgtgtggtttggggcggcccgggccccgccccgcccgacgctgccctttgcacatccccgcggccccggcccgcggttgcagcccgcagtgggccgcagccaacagaggtcccggggaccccgggaccactgaacaggcaggccaccccgctgctgtacgcgctggcggccgaggcggaggccgcggcgcaggctgccgagccgcccagcccgccggcctcgagggccgcctaccgccagcggcttcagggcgcgcagcggcgagtgctccgggagacgtcgttccagcgcaaggagctccgcatgagcctgcccgcccgtctgcggcccactgtcccagcgcggcccccggcgactcacccgcgctccgcctcgctcagccacccgggcggggagggggagccggcgcgctcccgggctcccgcgccaggaactgccggccggggtcccctcgccaaccagcagcggaagtggtgcttctcagagccaggaaagctggatcgtgtgggtcggggcggtgggccggcgcgggaatgcctgggtgaggcctgctccagctctggcctccctgggcccgagcccttggagttccagcatccggcgctggctaagtttgaagatcacgaggtcggatggctgcccgagacgcaaccccaaggctccatgaacctggactccgggtccttgaagctcggtgatgccttcaggcccgccagtcggagtcggagcgcttcaggcgaagtcttgggttcctggggaggatcaggagggaccatacccattgtccaggctgttccccaaggagcagaaacccccagaccattgtttcagaccaaactttccaggttcttgcctcagaaagaggctgcggtgatgtatcctgcagagttaccccagagcagccctgctgacagtgaacagagggtctcagagacctgcattgtgcctgcctggctcccctcccttcctgatgaagtgttcctagaagaggccccactggtcagaatgagatcaccaccagacccccatgcctcccaggggcccccagccagtgtccatgcctctgaccagccgtatggaactggcttaggccaaagaactggccaggttacagtccccacagagtacccgctccatgagtgtccaggaactgcaggggcagatgactgctggcagggggtgaatggttctgtaggtatttccaggcccacaagccacacccccactgggactgcaaatgataacatcccaactattgaccccactggactgaccaccaatccccccacagctgcagagagtgacctcctcaaacctgtcccagctgatgccttgggactttcaggcaatgatactccaggtccctctcacaatactgccctagccaggggcactggccagcctggttccaggcccacatggcctagtcagtgcctcgaggagctggttcaggagctggccagattagatccctctctatgtgaccctcttgcttcccagcccagcccagagccacccctgggcctgctggatggactgattcctttagcagaggtccgggctgcaatgcggcctgcctgtggggaggctggagaggaggctgccagtacttttgagccagggtcctatcagttcagcttcacccagctcctgccggctcctcgggaggagacaaggcttgaaaaccctgccacccaccctgtgcttgaccagccatgtgggcaggggctccctgcaccaaacaacagcatccagggcaagaaagtggagctggccgcccgcctccaaaagatgcttcaggaccttcacacggagcaggagcggctgcagggggaggcacaagcgtgggccaggcgccaagcggctctggaggctgcagtgcgccaggcctgtgcccctcaggagctggagcggttcagccggttcatggccgacctagagcgcgtgcttggccttctgctgctgctgggcagtcgcctggcgcgcgtgcgccgcgccctggcccgggcggcctcagacagcgaccctgatgagcaggcctccctgctgcagcgactccggctcctgcagcggcaggaggaggacgccaaggagctgaaggagcacgtagcgcggcgcgagcgggccgtgcgggaggtgctggtgcgagcactaccggtggaggagctgcgcgtctattgcgccctgctggcgggcaaggccgccgtcctggcccagcagcgcaacctggacgagcgcatccgcctccttcaggaccaactggacgccatcagggacgaccttggccatcatgccccgtctcccagcccggcgcggcccccagggacctgtcctccagttcagccgcccttccctcttctccttacatagttataggtggagagggtggggtgcaccgcccctatctctcacccacgtaagtggggtgatgctgatttagtctctgcttttcccttgagggattggggaggacccagtccaggcctttctaagatactcctccagccgggcgcggtggctcacgcctgtaatcccagcactttgggaggccgaggcgggcggatcacaaggtcaggagatcgagaccatcctggctaacacggtgaaaccccgtctctactaaaaatataaaaaattagccgggcgtggtggcgggtgcctgtattgccagctactcggaaggctgaggcaggagaatggcgtgaacctgggaggtggagcttgcagtgagcggacatcgcgccactgcactccagcctgggcgacagagcaagactccgtctcaaaaaaaaaaaaaaaaaaaaaaaaaaaaaagatacttctccaaagtgttctcatgtggcctcacccaggtcttgtgtattatttggtaattaatttatggatcttaaaaactgcagtattcccccattttgtgatgagagtgtggggctggcaggggttggttggagggaggagagaagacagaggagcacttaaggtgcaaagcagcctattttttcttcaataaaaattgttaagagaa

SEQ ID NO: 181282 - DNA, 1080 bp, Homo sapiens
  Payload ID: 15705
  Gene Symbol: SHROOM1
  Gene Name: shroom family member 1
  ENST ID: ENST00000440118
  CDS Start-End: 109-1080
gcccggggctctgatgtcaccgcgcggctgcgacggcccaggagcgcgtctcggcgggagcctcaggacccacgcagccacccagcctcagcactcatctgcgcagccatggaggccctgggacctgggggcgaccgcgcctccccggcctcgtccactagcagcctggacctgtggcatctgtccatgcgcgcggactcggcctacagctctttctccgcagcctccggcggccccgagccgcgcacgcagtcgccggggacagacctccttccttacctagactgggactacgtgcgtgtggtttggggcggcccgggccccgccccgcccgacgctgccctttgcacatccccgcggccccggcccgcggttgcagcccgcagtgggccgcagccaacagaggtcccggggaccccgggaccactgaacaggcaggccaccccgctgctgtacgcgctggcggccgaggcggaggccgcggcgcaggctgccgagccgcccagcccgccggcctcgagggccgcctaccgccagcggcttcagggcgcgcagcggcgagtgctccgggagacgtcgttccagcgcaaggagctccgcatgagcctgcccgcccgtctgcggcccactgtcccagcgcggcccccggcgactcacccgcgctccgcctcgctcagccacccgggcggggagggggagccggcgcgctcccgggctcccgcgccaggaactgccggccggggtcccctcgccaaccagcagcggaagtggtgcttctcagagccaggaaagctggatcgtgtgggtcggggcggtgggccggcgcgggaatgcctgggtgaggcctgctccagctctggcctccctgggcccgagcccttggagttccagcatccggcgctggctaagtttgaagatcacgaggtcggatggctgcccgagacgcaaccccaaggctccatgaacctggactccgggtccttgaagctcggtgatgccttcaggcccgccagtcggagtcggagcgcttcaggcgaagtcttgggttcctggggaggatcaggagggaccatacccatt

SEQ ID NO: 181283 - DNA, 3638 bp, Homo sapiens
  Payload ID: 15705
  Gene Symbol: SHROOM1
  Gene Name: shroom family member 1
  Uniprot ID: Q2M3G4
  ENST ID: ENST00000617339
  CDS Start-End: 445-3003
ctgcctctgccccttgccctgggtcttcccccacccctcctttcttagctcccctgaggtcacaagagtgttcttgaccattgtttatcagggaaagatcacatggagaagccaacagaacggccaggaagcagcctgggtggaacagggttggggaggaaaggaacatgggtacattctcagcgttccaggaggtctcagggtaaaggctgcttgtgtgggcaaggggagcctggcagggaatgagctggtcccaattccttcccctgagctgggccctcaaccttcagaggtgctccctgggactggtcctacttcctctgccacctctgatcccaaggtgactctgccaaaatctgggggatgccagcgcttgtgacggtgtgaccagggaggggaagtgacccacgcagccacccagcctcagcactcatctgcgcagccatggaggccctgggacctgggggcgaccgcgcctccccggcctcgtccactagcagcctggacctgtggcatctgtccatgcgcgcggactcggcctacagctctttctccgcagcctccggcggccccgagccgcgcacgcagtcgccggggacagacctccttccttacctagactgggactacgtgcgtgtggtttggggcggcccgggccccgccccgcccgacgctgccctttgcacatccccgcggccccggcccgcggttgcagcccgcagtgggccgcagccaacagaggtcccggggaccccgggaccactgaacaggcaggccaccccgctgctgtacgcgctggcggccgaggcggaggccgcggcgcaggctgccgagccgcccagcccgccggcctcgagggccgcctaccgccagcggcttcagggcgcgcagcggcgagtgctccgggagacgtcgttccagcgcaaggagctccgcatgagcctgcccgcccgtctgcggcccactgtcccagcgcggcccccggcgactcacccgcgctccgcctcgctcagccacccgggcggggagggggagccggcgcgctcccgggctcccgcgccaggaactgccggccggggtcccctcgccaaccagcagcggaagtggtgcttctcagagccaggaaagctggatcgtgtgggtcggggcggtgggccggcgcgggaatgcctgggtgaggcctgctccagctctggcctccctgggcccgagcccttggagttccagcatccggcgctggctaagtttgaagatcacgaggtcggatggctgcccgagacgcaaccccaaggctccatgaacctggactccgggtccttgaagctcggtgatgccttcaggcccgccagtcggagtcggagcgcttcaggcgaagtcttgggttcctggggaggatcaggagggaccatacccattgtccaggctgttccccaaggagcagaaacccccagaccattgtttcagaccaaactttccaggttcttgcctcagaaagaggctgcggtgatgtatcctgcagagttaccccagagcagccctgctgacagtgaacagagggtctcagagacctgcattgtgcctgcctggctcccctcccttcctgatgaagtgttcctagaagaggccccactggtcagaatgagatcaccaccagacccccatgcctcccaggggcccccagccagtgtccatgcctctgaccagccgtatggaactggcttaggccaaagaactggccaggttacagtccccacagagtacccgctccatgagtgtccaggaactgcaggggcagatgactgctggcagggggtgaatggttctgtaggtatttccaggcccacaagccacacccccactgggactgcaaatgataacatcccaactattgaccccactggactgaccaccaatccccccacagctgcagagagtgacctcctcaaacctgtcccagctgatgccttgggactttcaggcaatgatactccaggtccctctcacaatactgccctagccaggggcactggccagcctggttccaggcccacatggcctagtcagtgcctcgaggagctggttcaggagctggccagattagatccctctctatgtgaccctcttgcttcccagcccagcccagagccacccctgggcctgctggatggactgattcctttagcagaggtccgggctgcaatgcggcctgcctgtggggaggctggagaggaggctgccagtacttttgagccagggtcctatcagttcagcttcacccagctcctgccggctcctcgggaggagacaaggcttgaaaaccctgccacccaccctgtgcttgaccagccatgtgggcaggggctccctgcaccaaacaacagcatccagggcaagaaagtggagctggccgcccgcctccaaaagatgcttcaggaccttcacacggagcaggagcggctgcagggggaggcacaagcgtgggccaggcgccaagcggctctggaggctgcagtgcgccaggcctgtgcccctcaggagctggagcggttcagccggttcatggccgacctagagcgcgtgcttggccttctgctgctgctgggcagtcgcctggcgcgcgtgcgccgcgccctggcccgggcggcctcagacagcgaccctgatgagcaggcctccctgctgcagcgactccggctcctgcagcggcaggaggaggacgccaaggagctgaaggagcacgtagcgcggcgcgagcgggccgtgcgggaggtgctggtgcgagcactaccggtggaggagctgcgcgtctattgcgccctgctggcgggcaaggccgccgtcctggcccagcagcgcaacctggacgagcgcatccgcctccttcaggaccaactggacgccatcagggacgaccttggccatcatgccccgtctcccagcccggcgcggcccccagggacctgtcctccagttcagccgcccttccctcttctccttacatagttataggtggagagggtggggtgcaccgcccctatctctcacccacgtaagtggggtgatgctgatttagtctctgcttttcccttgagggattggggaggacccagtccaggcctttctaagatactcctccagccgggcgcggtggctcacgcctgtaatcccagcactttgggaggccgaggcgggcggatcacaaggtcaggagatcgagaccatcctggctaacacggtgaaaccccgtctctactaaaaatataaaaaattagccgggcgtggtggcgggtgcctgtattgccagctactcggaaggctgaggcaggagaatggcgtgaacctgggaggtggagcttgcagtgagcggacatcgcgccactgcactccagcctgggcgacagagcaagactccgtctcaaaaaaaaaaaaaaaaaaaaaaaaaaaaaagatacttctccaaagtgttctcatgtggcctcacccaggtcttgtgtattatttggtaattaatttatggatcttaaaaactgcagtattcccccattttgtgatgagagtgtggggctggcaggggttggttggagggaggagagaagacagaggagcacttaaggtgcaaagcagcctattttttcttc

SEQ ID NO: 181284 - DNA, 7447 bp, Homo sapiens
  Payload ID: 15706
  Gene Symbol: SHROOM2
  Gene Name: shroom family member 2
  Uniprot ID: Q13796
  ENST ID: ENST00000380913
  CDS Start-End: 91-4941
tctgcggcgctcggagcctcccttgcgatcccacggccgggactgcccggagtgcatgggcgcgggccagggacgctgagcggtcgcgccatggagggcgccgagccccgcgcgcggcccgagcgcctggccgaggccgagacgcgggcggcggacggcgggcgcctggtggaggtgcagctgagcggcggcgccccgtggggcttcaccctgaagggcggccgcgagcacggcgagccgctggtcatcaccaagattgaagagggcagtaaagccgcggcggtcgacaagttactggctggagatgagatcgtcggcatcaatgacattggtctctcagggtttagacaggaagcgatttgcctggtgaaggggtcccataagaccctgaagctggtcgtcaaaaggaggagcgagctgggctggaggcctcactcctggcatgccaccaagttctctgacagccaccccgagctagcggcctccccattcacctccaccagcggctgtccttcctggtccggccgacaccacgcgagttcttcctcccacgacctgtccagttcctgggagcagacgaacctacagcgcaccttagatcacttcagctccttggggagcgttgacagcctggaccacccctccagtcgcctctcggtggccaagtccaacagcagcatcgaccacctgggcagccacagcaagcgcgactcggcctacggctccttctccaccagctctagcactcctgaccacaccttgtccaaagccgacacgtcctccgcagagaacatcctctacactgtgggcctctgggaggctcccaggcagggtggccggcaggcccaggccgcaggcgaccctcagggctcggaggagaagctcagttgtttcccgcccagggtccccggtgacagcggcaaaggccccaggccagagtacaatgccgagcccaagctggctgcccctgggaggtccaattttgggccagtctggtatgttcccgataagaagaaagcaccatcatccccacctcctccccctccccctctccgcagtgacagctttgctgccaccaagagccacgagaaggcccagggccctgtgttctcagaggcggctgcggcacagcactttacggccctggcccaggctcagcctcgtggtgaccggagaccagagctcaccgatcggccttggaggtcagcacacccggggagcctcgggaagggatcgggaggcccgggctgcccacaggaggcccacgcagacggcagctggccgccctccaaggatggagcttccagtaggctgcaggcctctctgtccagctcagatgtgcgcttccctcagtctcctcatagcggccgacaccctcccctatacagcgaccacagccccctctgtgctgacagccttgggcaggagccaggggctgccagcttccagaacgacagccctcctcaggtgagggggctcagcagctgtgaccagaagctggggagcggctggcagggtccccggccctgtgtgcagggagacctgcaagcagcacagctctgggcgggatgctggccttctgacacagcccttggagccctcgagagtcttcccccacccacggtgggccagagcccacgccatcacctacctcagcctgagggtcctccggatgcccgcgagacaggacggtgttacccgctggacaaaggggccgagggctgctccgcgggagcccaggagcctcccagggccagccgtgcagaaaaagccagccagaggctggcagccagcatcacgtgggcagatggggagagcagcaggatctgcccgcaggagacgcccctgttgcactccctgacccaggaggggaagcgccggcctgagagcagtccagaggacagcgccaccagaccgccaccgttcgacgcccacgtgggcaagcccacccgaagaagcgaccgctttgccaccaccctgcggaatgagatccagatgcatagagccaagctgcagaagagccggagcacagtggctctgactgcagcaggggaggcggaggatggcaccggccgctggagggccgggttgggaggtggcacccaggaaggacccctcgctggcacctataaagaccacctgaaagaggcccaagcccgggtcctgagggccacgtccttcaagcgccgcgacttggaccccaacccaggagacctatacccggagtcactggaacaccggatgggggatccagacactgtcccccacttctgggaggcaggcctggcccagccaccctcatctacaagtggcgggccccacccgccccgcatcggaggccggagacggttcacagctgagcagaaattgaagtcctactcggaacctgagaagatgaacgaggtgggcctcacgaggggctacagtcctcaccagcaccccaggacatctgaggatactgtgggcacgtttgctgacaggtggaagttttttgaggaaacgagcaaacctgttccccagaggcctgcccagaagcaagctcttcacggaatcccgagagacaagccagagaggccgcggacagcgggccgcacatgtgagggcacggagccctggtcgcgcaccacctcccttggggacagcctcaacgctcacagcgcagcggagaaggcagggacttcagacctgccgcggaggctcggcacctttgcagagtatcaggcctcttggaaggaacagaggaaacctctggaggccaggagctctgggcgctgccactcagcggatgacatcctggatgtgagcctggacccacaggagaggccgcagcacgttcatgggaggtcccggtcttcaccgtccacagaccactacaagcaggaagcttctgtcgaactgcgaaggcaggcaggggaccccggcgagcccagagaagagcttccctccgcagtccgggccgaggagggacagtccacgccgagacaagcagatgcccagtgtcgggaaggcagcccaggatcacagcagcacccaccgagtcagaaggcaccgaacccacccacattctctgaactatctcactgccggggagccccagagctgccccgggagggccggggccgagcgggaaccctacctcgagattatagatactcggaggagagcaccccagcagacttgggaccccgagcccagagccctggctcacccctgcatgctcgaggacaagactcgtggccagtgagctcagccctgctctccaagaggccagccccacagaggccaccgccacccaagcgcgagcccaggagatacagggccacagacggcgcacctgctgacgcccccgtgggcgtcctcggcaggcccttcccaacgccatcccctgcgtccctggatgtgtatgtggcccgcctgtccctctcccacagcccctctgtgttcagcagtgcccagccccaggacaccccgaaggccactgtctgtgagcgtggaagccagcatgtgagcggggacgcatcacgtcctctgccagaagcactgctccctcccaagcagcagcacctgcgcctgcagacggccaccatggagacctcgcgctccccctcgccccagttcgccccccagaaactgacggacaaacctcccctgctcatccaggatgaggattcaaccagaattgagcgggtgatggacaacaacaccacggtgaagatggtgcccatcaagatcgtgcactcggagagccagccagagaaggagagccgccagagcctggcatgccccgccgagccacctgccctgccccacgggctggagaaagaccagatcaagacgctgagcacatctgagcagttctactcgcgcttctgtctgtacacgcggcagggtgctgagcccgaggccccacatagggcccagccggctgagccccagcccctgggcacccaggtgccccccgagaaagaccgctgcacctcccctccagggctcagctacatgaaggccaaagagaagactgtggaagacctgaagtcggaggagctggccagggagatcgtggggaaggataagtccctggccgacatcctggatcccagtgtgaagatcaaaaccactatggacttgatggaaggcatcttccccaaagacgagcacctcctggaagaagcccagcaacggaggaagctgctccccaaaatcccctctcctagaagcacagaggagaggaaagaggagcccagcgtgcctgcggccgtgtccctggccaccaattctacctactacagcacgtcggcccccaaggcggagctgctgatcaagatgaaggacctgcaggagcagcaggagcacgaagaggattcgggaagcgacttggaccacgacctgtcggtgaagaagcaggagctcatcgagagcatcagccgcaagctgcaggtgctccgggaggcccgcgagagcctgctggaggacgtgcaggccaacaccgtgctgggggccgaggtggaggccatcgtgaaaggcgtctgcaagcccagcgagtttgacaagttccggatgttcattggagacctggacaaagtggtgaacctcctgctgtcgctgtcaggccgcctggcccgggtggagaatgccctcaataatttggacgacggcgcttctcccggtgatcggcaatcactgcttgagaagcagagagtcctgatccagcagcacgaggacgccaaggagctcaaggagaacctggaccgccgcgagcgcatcgtctttgacattttggccaactatctgagcgaggagagcctcgcggactatgagcacttcgtgaagatgaagtcggccctcatcatcgagcagcgggagctggaagataaaatccaccttggtgaagagcagctgaagtgcttattggacagccttcagcccgaaaggggcaaataagagaccagtccccggtggaggaggggcacggggcctccgagctccagctccgttcccaaggatactcgtgaagaccccatctgtgttcatggcctggaaagagacttctcccatagcaaagaggctgttataaaagcaataacttttgtgtttgtgtgggatgatttatttaattttttagtttcccctttgattgctgagagccattttcctttacacataactacacctgacaccaggctctgctggatgtgagtttccactgcatgggctgtgggctgggcctgtggtgcctgccgagtggtcactgtcagtgggaaacccgttgttcctcccgtcttcagatgctgagccaactgcttggacagcagccagcgcgtcatgacgtgcatgagagggggaccctggtgctcatcttctcttgtcattcatccaggcatgggctgccaggttttgtccctgctcgttcaacagtgtgagcatttgtctctgttatctaatgatgttctctgacccagcagaaatcatcatcatgatgatgataatttattaactttttggaagggtgaatagtttcctaatggttaaaaaccaactgtgaaaggaaccacctgtgtggttgggttcactcattctcagattaaattgccacttaaagaaataacgtgcatgctttaaaaaacacagtcacgcaccaagcaggcaaatagctttagtccttctcacctcacatcacagttgttctgcaaagtaaaattttttggttaagagcgtgtccagtagtaatgtgcttgttagctgtttctcaagaccaacagaagattttttcagttactttccccccatgtattttgtatgcatatgattgtccgtgataattggctacttttccattgtttcctccttaaatcgtttagcatggcatgagggccacattccatggacgggaagaccccttcctcttcagaggtcccgtggactacacagctcctgagcttgatctttttctgccatgaagtttaaagattctatgcccatttccttgattgaaatggcaggattctaaagagagcctggtttgttaaaagaaaacactgtcatgctgtcagttcccaattgacaagtcacagactgggagaaaatatttgcaaatcgtgtatctgacaaaaggtttgtgtccaggatgtacaaagaactctcaaaccggatagtaagaaaacaaacagcccaagtgaaaagcaggcaaaagacttgaatagacacttcaccaaagagcatacacgcgtggcaaacaagcacacgaaaagacgttcagccgccgatggcttggttataatttataacttacttatttttatctaataattgtagattcagtgtatttcttcaaaaaatgtttaattaaatgcatgttaatggtgagtgaatcccttgggtgacttcgtgtttaggtcgtattagggcatttgttggatcaacggatcattttaaccctgacttccccttattcccataaaagaagttttccagtggaatggagatttcattttgtcagcagcagtgaccacagccttaccaaagcagacgcgtgcgcgtgcacagatgcacacacacagatgtcttaaaagactagaatccacacttcctgagccagaggggccgtgttgacggtaatgcattctctatagagccaagtccaaactggcaagctcaatgatgcaggcaataaaccgcctttttggcagcctaccaatgccaaaaggataaatgtctttccaaaagtgtgtattcctgttaaattaagctcttgctaacttgaaaaatccctgttctgccagcgaagcttcctcctcctctccagctggtagtcacttgcgtgaatgctggtcagtctgaaaaggtgaagctggctgtgcacttacccccatctttctccctcggggagacgacccaaggaatttcagagtattttgtttggcagagcttttacctgttattctttgccctcaaatacagtattgtggtcattttgatgatatgtgtgtaaaatgtgaataatccaattggtgtctgtactcagccttttgatgtctttttaggactttctcttctacacagcaatacgtcgtgctcgagtatccttgtagcaaagcacatagagccagctgtcctgtcagttcccctgtttgcctctgaaacgtctggttagtggggacccaaagattctagtgagtcaacatccataactctgtatctagttgtattattcatagaaaatcaatctggtgctaatggttggccctggtgttgttgggtggcagctgctccttcgccctcttgtagtgtggctgtggagggctctgcctatggggggtggcctgtggcttgtatccttcagtccaccacagcaaatgtgtgtagatttcatgctcgacacttaccactcacctatcaacagatcatcctgcttgactgtaacaaaataaatagtgtctcttcaagtgaa

SEQ ID NO: 181285 - DNA, 2276 bp, Homo sapiens
  Payload ID: 15706
  Gene Symbol: SHROOM2
  Gene Name: shroom family member 2
  ENST ID: ENST00000452575
  CDS Start-End: 1150-2276
gtttgtagttcccagtggctcttttgttctgctatcttgaagggcaggttgcttgtcagctcacaatgctgtgggtaaggtctggtgaggtcggcgaatgtgttctcattgtttattcttctgcctgaagatgagaaataatgcaaatcagggtgcagattccggctcgagctccacaggcgtgcacgtatgtgtaagggcatgctcgccggtgctgcatgtcctcgtggatgcatgcaatttttacagctttgggattcacggttagctgaaagcacattggaactggaaggcggtgctcttaacaccgtgttctaggctggaagccgtagagccatcatctgctctgatgggactgcagcccttggtatgtgggacccttgctccatgtgagttctgcagatgggttccccgagggagctggctggaggacgccagcatcgcatgaagacctgcctgcctcgtttgccttttgtttttcagtagcagtaagaaacaggcattctcactacacaggcattgaatgcggacattgagaaaaaatgacaagcagatgcccagtgtcgggaaggcagcccaggatcacagcagcacccaccgagtcagaaggcaccgaacccacccacattctctgaactatctcactgccggggagccccagagctgccccgggagggccggggccgagcgggaaccctacctcgagattatagatactcggaggagagcaccccagcagacttgggaccccgagcccagagccctggctcacccctgcatgctcgaggacaagactcgtggccagtgagctcagccctgctctccaagaggccagccccacagaggccaccgccacccaagcgcgagcccaggagatacagggccacagacggcgcacctgctgacgcccccgtgggcgtcctcggcaggcccttcccaacgccatcccctgcgtccctggatgtgtatgtggcccgcctgtccctctcccacagcccctctgtgttcagcagtgcccagccccaggacaccccgaaggccactgtctgtgagcgtggaagccagcatgtgagcggggacgcatcacgtcctctgccagaagcactgctccctcccaagcagcagcacctgcgcctgcagacggccaccatggagacctcgcgctccccctcgccccagttcgccccccagaaactgacggacaaacctcccctgctcatccaggatgaggattcaaccagaattgagcgggtgatggacaacaacaccacggtgaagatggtgcccatcaagatcgtgcactcggagagccagccagagaaggagagccgccagagcctggcatgccccgccgagccacctgccctgccccacgggctggagaaagaccagatcaagacgctgagcacatctgagcagttctactcgcgcttctgtctgtacacgcggcagggtgctgagcccgaggccccacatagggcccagccggctgagccccagcccctgggcacccaggtgccccccgagaaagaccgctgcacctcccctccagggctcagctacatgaaggccaaagagaagactgtggaagacctgaagtcggaggagctggccagggagatcgtggggaaggataagtccctggccgacatcctggatcccagtgtgaagatcaaaaccactatggacttgatggaaggcatcttccccaaagacgagcacctcctggaagaagcccagcaacggaggaagctgctccccaaaatcccctctcctagaagcacagaggagaggaaagaggagcccagcgtgcctgcggccgtgtccctggccaccaattctacctactacagcacgtcggcccccaaggcggagctgctgatcaagatgaaggacctgcaggagcagcaggagcacgaagaggattcgggaagcgacttggaccacgacctgtcggtgaagaagcaggagctcatcgagagcatcagccgcaagctgcaggtgctccgggaggcccgcgagagcctgctggaggacgtgcaggccaacaccgtgctgggggccgaggtggaggccatcgtgaaaggcgtctgcaagcccagcgagtttgacaagttccggatgttcattggagacctggacaaagtggtgaacctcctgctgtcgctgtcaggccgcctggcccgggtggagaatgccctcaataatttggacgacggcgcttctcccggtgatcggcaatcactgcttgagaagcagagagtcctgatccagca

SEQ ID NO: 181286 - DNA, 4615 bp, Homo sapiens
  Payload ID: 15706
  Gene Symbol: SHROOM2
  Gene Name: shroom family member 2
  ENST ID: ENST00000418909
  CDS Start-End: 759-2111
atcaacaagacagcaggcacagacaggccagctgttgtgagcttggctttaggactccattcagtaggcaggaggagagctgcagcagaggcgggctgtgggtccctgaagcacatcgctgccttcacagctgggcgaactcccatccagcacgacaagcagatgcccagtgtcgggaaggcagcccaggatcacagcagcacccaccgagtcagaaggcaccgaacccacccacattctctgaactatctcactgccggggagccccagagctgccccgggagggccggggccgagcgggaaccctacctcgagattatagatactcggaggagagcaccccagcagacttgggaccccgagcccagagccctggctcacccctgcatgctcgaggacaagactcgtggccagtgagctcagccctgctctccaagaggccagccccacagaggccaccgccacccaagcgcgagcccaggagatacagggccacagacggcgcacctgctgacgcccccgtgggcgtcctcggcaggcccttcccaacgccatcccctgcgtccctggatgtgtatgtggcccgcctgtccctctcccacagcccctctgtgttcagcagtgcccagccccaggacaccccgaaggccactgtctgtgagcgtggaagccagcatgtgagcggggacgcatcacgtcctctgccagaagcactgctccctcccaagcagcagcacctgcgcctgcagacggccaccatggagacctcgcgctccccctcgccccagttcgccccccagaaactgacggacaaacctcccctgctcatccaggatgaggattcaaccagaattgagcgggtgatggacaacaacaccacggtgaagatggtgcccatcaagatcgtgcactcggagagccagccagagaaggagagccgccagagcctggcatgccccgccgagccacctgccctgccccacgggctggagaaagaccagatcaagacgctgagcacatctgagcagttctactcgcgcttctgtctgtacacgcggcagggtgctgagcccgaggccccacatagggcccagccggctgagccccagcccctgggcacccaggtgccccccgagaaagaccgctgcacctcccctccagggctcagctacatgaaggccaaagagaagactgtggaagacctgaagtcggaggagctggccagggagatcgtggggaaggataagtccctggccgacatcctggatcccagtgtgaagatcaaaaccactatggacttgatggaaggcatcttccccaaagacgagcacctcctggaagaagcccagcaacggaggaagctgctccccaaaatcccctctcctagaagcacagaggagaggaaagaggagcccagcgtgcctgcggccgtgtccctggccaccaattctacctactacagcacgtcggcccccaaggcggagctgctgatcaagatgaaggacctgcaggagcagcaggagcacgaagaggattcgggaagcgacttggaccacgacctgtcggtgaagaaggagctcatcgagagcatcagccgcaagctgcaggtgctccgggaggcccgcgagagcctgctggaggacgtgcaggccaacaccgtgctgggggccgaggtggaggccatcgtgaaaggcgtctgcaagcccagcgagtttgacaagttccggatgttcattggagacctggacaaagtggtgaacctcctgctgtcgctgtcaggccgcctggcccgggtggagaatgccctcaataatttggacgacggcgcttctcccggtgatcggcaatcactgcttgagaagcagagagtcctgatccagcagcacgaggacgccaaggagctcaaggagaacctggaccgccgcgagcgcatcgtctttgacattttggccaactatctgagcgaggagagcctcgcggactatgagcacttcgtgaagatgaagtcggccctcatcatcgagcagcgggagctggaagataaaatccaccttggtgaagagcagctgaagtgcttattggacagccttcagcccgaaaggggcaaataagagaccagtccccggtggaggaggggcacggggcctccgagctccagctccgttcccaaggatactcgtgaagaccccatctgtgttcatggcctggaaagagacttctcccatagcaaagaggctgttataaaagcaataacttttgtgtttgtgtgggatgatttatttaattttttagtttcccctttgattgctgagagccattttcctttacacataactacacctgacaccaggctctgctggatgtgagtttccactgcatgggctgtgggctgggcctgtggtgcctgccgagtggtcactgtcagtgggaaacccgttgttcctcccgtcttcagatgctgagccaactgcttggacagcagccagcgcgtcatgacgtgcatgagagggggaccctggtgctcatcttctcttgtcattcatccaggcatgggctgccaggttttgtccctgctcgttcaacagtgtgagcatttgtctctgttatctaatgatgttctctgacccagcagaaatcatcatcatgatgatgataatttattaactttttggaagggtgaatagtttcctaatggttaaaaaccaactgtgaaaggaaccacctgtgtggttgggttcactcattctcagattaaattgccacttaaagaaataacgtgcatgctttaaaaaacacagtcacgcaccaagcaggcaaatagctttagtccttctcacctcacatcacagttgttctgcaaagtaaaattttttggttaagagcgtgtccagtagtaatgtgcttgttagctgtttctcaagaccaacagaagattttttcagttactttccccccatgtattttgtatgcatatgattgtccgtgataattggctacttttccattgtttcctccttaaatcgtttagcatggcatgagggccacattccatggacgggaagaccccttcctcttcagaggtcccgtggactacacagctcctgagcttgatctttttctgccatgaagtttaaagattctatgcccatttccttgattgaaatggcaggattctaaagagagcctggtttgttaaaagaaaacactgtcatgctgtcagttcccaattgacaagtcacagactgggagaaaatatttgcaaatcgtgtatctgacaaaaggtttgtgtccaggatgtacaaagaactctcaaaccggatagtaagaaaacaaacagcccaagtgaaaagcaggcaaaagacttgaatagacacttcaccaaagagcatacacgcgtggcaaacaagcacacgaaaagacgttcagccgccgatggcttggttataatttataacttacttatttttatctaataattgtagattcagtgtatttcttcaaaaaatgtttaattaaatgcatgttaatggtgagtgaatcccttgggtgacttcgtgtttaggtcgtattagggcatttgttggatcaacggatcattttaaccctgacttccccttattcccataaaagaagttttccagtggaatggagatttcattttgtcagcagcagtgaccacagccttaccaaagcagacgcgtgcgcgtgcacagatgcacacacacagatgtcttaaaagactagaatccacacttcctgagccagaggggccgtgttgacggtaatgcattctctatagagccaagtccaaactggcaagctcaatgatgcaggcaataaaccgcctttttggcagcctaccaatgccaaaaggataaatgtctttccaaaagtgtgtattcctgttaaattaagctcttgctaacttgaaaaatccctgttctgccagcgaagcttcctcctcctctccagctggtagtcacttgcgtgaatgctggtcagtctgaaaaggtgaagctggctgtgcacttacccccatctttctccctcggggagacgacccaaggaatttcagagtattttgtttggcagagcttttacctgttattctttgccctcaaatacagtattgtggtcattttgatgatatgtgtgtaaaatgtgaataatccaattggtgtctgtactcagccttttgatgtctttttaggactttctcttctacacagcaatacgtcgtgctcgagtatccttgtagcaaagcacatagagccagctgtcctgtcagttcccctgtttgcctctgaaacgtctggttagtggggacccaaagattctagtgagtcaacatccataactctgtatctagttgtattattcatagaaaatcaatctggtgctaatggttggccctggtgttgttgggtggcagctgctccttcgccctcttgtagtgtggctgtggagggctctgcctatggggggtggcctgtggcttgtatccttcagtccaccacagcaaatgtgtgtagatttcatgctcgacacttaccactcacctatcaacagatcatcctgcttgactgtaacaaaataaatagtgtctcttcaagtg

SEQ ID NO: 181287 - DNA, 11020 bp, Homo sapiens
  Payload ID: 15707
  Gene Symbol: SHROOM3
  Gene Name: shroom family member 3
  Uniprot ID: Q8TF72
  ENST ID: ENST00000296043
  CDS Start-End: 954-6944
gttattaactgtaagactgtttgaattgtcaggtctttgtggtgagctgaattctgcatggcagtgcttactgtgcagaaaggttgcaatgcctcactttgccttaatccatgttcctctaacttccttactctttctctcaagaggaggcaagtggctgtggcggccgcagcagtggctgatcatcactgaaaataccaaagaaaagaactgagctgcctccttcatattttttccattgaggattaatttaccgtgctttttcattttctctacatcctgcaaaagtttttttctctcctaagaaacaaactatgaactgattgttgaaaaaaagaagtaaaaagttttagcacagcttctctgtctcttcgggacaagttagaaaattctgaagtgagccgaagcatagtaagtgctttctttctttttaagctacttctggggagggaggaggctattgtaatggtaaatttcactccgagaggaagaaagggttgataatcaatcaaaaatgaggtattcctttgagtatttgtgattttcttactatattgtaagatgcttttaattttctctgtaaaataggcagaaatggttttagtgtgtgtatgtgtgaaataaaagctcagaaaagcaatcttcagagcgccactgaaggaagttttgacgaacggagtagagatgtataccacttgggggcttcagtgagaacccagaattcctggaggaggatttacattcagaaatgttgaagtgaaaattccttctggttcagcatcttggagttcagcttggaagaacattttacgtatggaagaatttgcttctccaaacctctcttttggccattgtgtgtcctgaaggatgggacaacttgtgctgtagaagcactgcttgcctgagtttgcttcaggcattttaaatttaacttgagggatcatgtgtttggcatgatgaggaccactgaagacttccacaagcctagtgccacattaaactctaacacggccaccaagggaaggtacatttatctggaggcattcctggagggaggagctccctggggttttactctaaagggtggcctggagcacggagaaccattaatcatctctaaggtcgaagaagggggcaaagcagacaccctgagctccaaactgcaggctggggatgaggttgtgcacatcaatgaggtgactctgagcagctccagaaaggaggcagtttccctggtgaaaggatcctacaagaccctcaggctggtagtgcgcagagatgtgtgcacagacccaggccatgcagatactggtgcctctaacttcgtcagcccagaacacctcacctctggcccccagcacaggaaagcagcgtggtcaggaggggttaaacttcggctgaagcacaggcgcagtgagcctgcaggccgacctcactcgtggcacacaactaaatctggggagaagcaacccgatgccagcatgatgcagatatctcagggtatgatcggccctccttggcaccaaagctaccattccagctcctctactagtgacctctccaactatgaccatgcttatctaaggcggagccctgaccagtgcagctcccaggggagcatggagagcctggagcccagtggggcatacccaccctgtcatctttcccctgccaagtccaccggcagcattgaccagctcagccacttccataacaagagagactcggcttacagctctttctccaccagttctagcatcctagagtatccacaccctggcatctctggccgggagcgttcaggctccatggacaatacttctgctcgaggtggcctcctcgaagggatgaggcaggcagatattcgctatgtcaagacagtctatgacacccggaggggagtctcagcagagtatgaggtgaactcttcagccctgctgcttcaaggtagggaggcccgagcctcagcaaatggtcagggctatgataaatggtctaatattcctcggggcaagggagtgccacccccatcctggagccagcagtgccccagttccttggagactgccacggacaaccttcctcctaaggtgggtgcacccctgcctccagctcggagtgacagttacgcagcatttcggcaccgtgagcggcccagctcctggtctagccttgatcagaaacggctctgccggcctcaggcaaactctttaggctccctgaagtctccattcatagaggagcagctgcatactgtgctggagaagagtccagagaacagccccccagtgaagcccaagcataactatacccagaaggcccaacctggccaacctctgctgccgaccagcatctacccggtaccttccctggagccacactttgcccaggtgcctcagccttctgtgagtagcaacggtatgctctaccctgcactggccaaggagagtggatacatagcccctcagggagcatgcaacaagatggctaccattgatgagaatgggaaccagaatggatctggcaggcctgggtttgccttctgccagcccttagaacatgacttgctgtccccagtggagaagaaaccagaagctacagccaagtatgtcccctccaaagtccatttctgttcagtgcctgaaaatgaggaggatgcctccctgaagagacatctcacacctccccaaggcaacagcccacattccaatgagagaaagagcacccacagtaacaaaccatcttctcatccccacagcctcaaatgccctcaggctcaggcctggcaagcgggtgaagacaagagatcttccaggctctcagagccctgggagggcgatttccaggaagaccacaatgccaacctctggaggaggctggagagagaaggcctaggccagagcctgtcaggcaactttggcaagaccaagtcagccttctcatctctccagaacattcctgagagtctgagaagacacagcagcctggagctaggccggggaacccaggagggttaccccgggggcaggcccacctgtgcagtcaacaccaaggcagaagaccctgggaggaaagccgctcctgacctcgggagccatctggaccggcaggtttcctacccgcggcccgaggggaggaccggtgcctcggcttctttcaacagcacagacccaagtcccgaagagccgcctgccccctcgcacccgcacacatccagtctgggccggagggggcccggcccaggcagcgcctcggctcttcagggctttcagtacgggaagccccactgctcggtgctggagaaggtctccaaattcgagcagcgagagcaagggagccagagaccgagtgtgggcggctctggttttggccataactataggccccacaggaccgtctcaacttccagtacttctgggaatgacttcgaggagacaaaagcacacattcgtttctctgagtcagctgaacccctaggcaacggggagcagcacttcaaaaacggggagctgaagttggaagaggcttcccggcagccctgcggtcagcagctgagcggaggagcgtcggacagcggccgtggcccccagaggccggacgctcggctcctccgtagccagagcaccttccagctctccagcgagccagagagggagcccgagtggcgggacaggcccggctcgcccgaatcgcccctgctggatgcccccttcagccgcgcctaccggaacagcatcaaggacgcacagtcccgtgtcttgggggccacctcctttcgacgtcgagacctggagctgggggcgcccgtggcgtcgaggtcctggcggccacggccttcctcggcccacgtggggctgcggagccccgaggcgtcggcctccgcctccccgcacacgccccgggagcggcacagcgtgacccctgctgagggcgacctggccaggcccgtgccccctgccgcccggagaggtgctcgccggcgcctgactcccgagcagaagaagcgctcctactcggagcccgagaagatgaacgaggtggggatcgtggaggaggccgaaccggcacccctgggcccgcagagaaatgggatgcgtttcccggagagcagcgtggccgaccggcgccgtctcttcgagcgcgatggcaaggcctgctccacgctcagcctgtcggggcccgagctgaagcagttccagcagagcgccctggcggactacatccagcgcaagaccggcaagcggcctacctccgccgccggctgcagcctccaggagcccgggccactgcgtgagcgcgcccagagtgcctacctccagcccggccccgcggcgctcgaaggctccggcctcgcctcggcctccagcttgagctcactgcgggagcccagcctgcagccccgcagggaggccacgctcctgccggccacagttgcagaaacccagcaggctccccgagatcgcagcagctccttcgccggtggccgccgcctcggggaacggcgacgcggggacctgcttagcggagcaaacggtggaacaaggggcacccagagaggggatgagacccccagggagccatcctcctggggggccagggccgggaagtccatgtcggccgaggacctgctggaacgctcggacgtccttgcgggccctgtccatgtgaggtccaggtcatctcccgccaccgcagacaagcgccaggatgtgcttttggggcaagacagtggctttggtcttgtgaaggatccatgttatttggctggtcctggatctaggtcactcagttgttcagaaagaggccaagaagagatgctgccgctcttccaccatctcacccctcgttggggtggttcaggctgcaaagccattggtgattcctccgttcctagtgaatgtcctggaaccctggaccatcagaggcaagccagtaggacaccctgccccaggccaccactggcaggaacgcaagggctggtcacagacaccagggctgcacccctgaccccaattggcacccctctgccttcagccattccctctggctactgctcacaggacggtcagacagggcgacagcctctcccgccctacacccctgccatgatgcacagaagcaatggtcacaccctgacccagcctcccggtccaagaggctgtgagggcgatggcccagagcatggggtagaagagggaacgaggaagagggtctcgctgcctcagtggccacctccttctcgagcaaagtgggcccacgcagccagagaggacagccttcctgaggaatcctcagcccctgattttgcaaacctgaagcactatcaaaaacagcagagtcttccaagtttatgcagcacttctgacccagacacacctcttggggccccgagcactccagggaggatctccctccgaatatctgagtctgtcctgcgggactccccgccacctcatgaggattatgaagacgaagtgtttgtgagggatccgcaccccaaggccacgtccagccccacatttgaacctcttcccccacccccacctcctccaccgagtcaggaaaccccggtgtatagcatggatgacttccctccacctcctccccacactgtatgtgaggcgcagctggacagtgaggatcccgaggggccacgccccagcttcaacaaactttctaaagtgacaattgcaagggaaaggcacatgcctggtgcagcccatgtggtaggtagtcagacactggcttccagactccaaacttctatcaagggttcagaggctgagtccacaccaccctccttcatgagcgttcacgcccaacttgctgggtctcttggtgggcagccagcacccatccagactcaaagcctcagccatgatccagtcagtggaactcagggtttagaaaagaaagtcagtcctgatcctcagaagagttcagaagacatcagaacagaggctttggccaaggaaattgtccaccaagacaaatctctagcagacattttggatccagactccaggctgaagacaacaatggacctgatggaaggtttgtttccccgagatgtgaacttgctgaaggaaaacagtgtaaagaggaaggccatacagagaactgtcagctcttcaggatgtgaaggcaagaggaatgaagacaaggaagcagtgagcatgttggttaactgccctgcctactacagtgtgtctgctcccaaggctgagctactgaacaaaatcaaagagatgccagcagaagtgaatgaggaagaggaacaggcagatgtcaatgaaaagaaggctgagctcattggaagtctcacccacaagctggagaccctccaggaggcgaaggggagcctgctcacggacatcaagctcaacaacgccctgggagaagaggtggaggctctgatcagcgagctctgcaagcccaatgagtttgacaagtataggatgttcataggggatttggacaaggtggtcaacctgctgctctccctctcggggcgtctagcccgtgttgagaatgtccttagcggccttggtgaagatgccagtaatgaagaaaggagctctctttacgagaaaaggaagatcctggctggtcagcatgaggatgcccgggagctgaaggagaacctggatcgcagggagcgagtagtgctgggcatcttggccaattacctttcagaggagcagctccaggactaccagcacttcgtgaaaatgaagtccacgctcctcattgagcaacggaagctggatgacaagatcaagctgggccaggagcaggtcaagtgtctgctggagagcctgccctcagatttcattcccaaggctggggccctggctctgcccccaaacctcacgagtgagcccattcctgctgggggctgtactttcagtggtattttcccaacattaacctctccactttaacctcttctaaaatacccaaccaaaagatcactgtttctctcaacactatttaatctgaaaaatgtttcagtacaaaccactgtttgaactatctgggttattggtgtttgttcctgatgaaaggaaaaaaattctctccaggaggaagcctttttccttcttgcccttcctgattgatcttctgagagctcgaatgctgctggacacgtacccctttctattattactttgtagtagaaagaaagttaatgaaactgagaactgattggagggtgtttgatcatttagtttttaacaggctgaggcaacatggatcagtgtgtgtccccctcaggaatgtatccacagtggccttccttgctggtgggcagtgtatcctgatggcagggtacaagtaccattaatgaagggtctgcaacataaagccttaaaaagacacacactaagaaaactgtaaaaccttgaacattgttatttatattttttaaaatggaaaagatcactatgtttgttgtgctaaccacttatttgattctgttttgtggtggacatagatgattacgtttgagctttgtattttgtgaaaaccttaatgaaatgaattccaaagatagtcacgttgagcgtgaagactttttttcttacattcctgtcttatttttaccaacacgagcaggcattctgcgcttccactggactgagtatgggggagtcctgctcccctcctgtctcacaccttccccaggaggaaggcctcatgcactgcggttattgcatcatttcctagtgcttcatgtcattatcactggtggggaaacaaagctaaattttattaacaaagacaactctcagacctatataataggaggaggacgtccagaatccaacaaaattcaaacggagcccatgctgttctcctgaacaagatttgggctaaatacggcctgtttattgaggctgttttaatgatgctttaaaaaaaaaaaatgttttctaaaatgtcaaacctgttgaccacactttgattaaaaactgcctccttaacctctgaagactgattttgctttatcatgtttcaataataacatttcagaggttactctgtagccccagttgtaagcttataaaaacaaactggaaggctgaggaggttatgggctggcagccaggctatgtttacagctgctggagatggcagtagccttatactttgagcaggtagtacatcccaggctgtgctagaggtagatttgttttttcacgtttgatctgtggctggtggccacctttgttgatttgggcttacgagtttcatagtagccagtcttagaaaattgggggagtaaaattttgaagtaaaaaaaaaaaaaaaatgacaagggaaccaaatgctccttctccccttagtacattttcattacttaatgaagttttatctcctatgtaagaatatcaaaattgtagtttgggtctccagtagagatgtcttttgattaacttataaacaactggccacccagaagtttcctttgcatagtcaaccaaagctatggctttgttctttggagcttatatactgcatgactccattgatacaaataagacagcaccttggtttcccagggatgttttcattcagaggtcctgtctcccaggaaagcagtagaaccagtgacagcattcaacagccacactgcatggtcatcagtcttaggccaacatgggagcctgaaattaactccatcagtaactacctgtgtgtcttgctgatactgaatgagccctcacaagccaagccaggtggaagacagccagcaaacgtctacagttattcttagtgaaattcctcagaggaatccagggggctcccagttcccaacactcttcgagatgaccatttttcgggatttgactggggaacattttacatattcagtctttctcaaaaatttttatttattttcttgagaaagggtcttactatgttgcccaggctggagtgcagagtggtgcgataacagctcattgcagtctgaacctctgaggctcaagccatcctcccatctcagcctcccaagtagctgggaccacaggtgtgcaccactatgcttggctaattttttgattttttatagagacgggggtctcgctatgttgcccaggctggtttcaaactcctgggctcaagggatccttccgctttggtcccagaagtgctgggattacaggcatgagccacttcacccagccacttttctaatttatagacataaaagtaattgactcccacagcacagtaacaggcaatgctgcttggcatgccacaaacatctgaaagcttgtgacactcctaggattgtgtccattctttcattatgtggaaactttgttctgttatgtgaaatgggtaaggcaccaagtgagactttgaaatctaatttttaggtggatgtgatatttattgtaataggacttgacctctgtactttaaagaaatcactaaccaaattttcaaagtttccttttaaatgcgtttagctagaaatctatgtatttatccctttcctattttgcattcttctcccactatttttaaaaactcatttacagtagaaaccattcttctttctcccaacagtatcctttgccaagaccatgagaacagtaaggagcatgttgttggtcagggtttcagaatacgcgtgatgtcactgagaatgtttgctcacagtcaataattgtctttgtggatgtgataattttggagatacacttctggtcagaactcaggtgagataatcttgcaatactccaaatgcagatactccagccacccgcaaggttccaggaaaggacaatgtcctgcgagaaaatcaggaggcctccacttcctgggccacttgagaagttcctgggcatgtcactacatgttggttgactcagccatttctcatgctgttttgtttcttgcggtggccacttaaccccaaagaatgaagggaggatccacagtgaaagtgcctgagtttctctatgagaccagatgctgtcgaaaccaaacatcttttcctttgctctatgggaacattttagggtttgttttgcacagctggtttccagactagaagattaacaagtttgggtccacccctaagaatcagtggctgtcttttaaggtgaggagtgtgggcttaactgaggtcctttgagggagctataaaggagaaacaacctgggacatcccagttttcctattcctccactgttaatatctcatctaaaataattcatgagtttaaatggtaaatatatgctttaagctctacctttaaacttgtatgttattcaggcatctcttattaagatactgggtctctggatacccaaggaaatgttggctttttattcttatgtggttccaaatttacttctcttcagtttaattgtccatggtagtgctggcttcattgttaggttggagttattattttccttttagaacaacatgaattttattcaccttactattagaaaaaggaataactacagccagaaataacttcatttcctacaaggtataaaaagtggtcaagtgaatgtgaaggggcttttctacacaggaatatattatcgggaacaaagtatttcctgctgccttaactctttgggatgcataggataaaatgataaagaccattttaatatcagaaagggttgtcttattaatttttaaataaaacttcacatttcttaatggggagctcattcagaaactaaataatggtttctcaaagtgtggtcaggatacgatctgcatcagaatccttggaatgcttgttaaaaataccaattgctatgacaaaaccaagtctgctggaaactgcatttcagcaggtttcccatgttattctgatgtattttaacatttgagagccactaccaatcatctgtacagttcctactgttatgatcacaataagactaacatgaatttaataatctgaataatttttaaaatttaaataaacagaaattgaagttaaatttaaaaataaaaataacctcagaagttgaaa

SEQ ID NO: 181288 - DNA, 6261 bp, Homo sapiens
  Payload ID: 15708
  Gene Symbol: SHROOM4
  Gene Name: shroom family member 4
  Uniprot ID: Q9ULL8
  ENST ID: ENST00000289292
  CDS Start-End: 285-4766
ccgttttcttgtccattacgcgctatccctccgcctctccttctttcttttcttttctttttttcccttctccttttcccccctctctccccctttctccagctccgtgtcatttcctccttgcgctcgctcgctgcctgagcgtctccagccgggagagtaggcggagcagggcggtgcggggtggcgtagagctggagggcgatggtggcggagctgctgggggcggaggcaacgtagccccctcggaaaaggagcccggcggcgcctgagcccagccgaggatggagaaccggcctgggtccttccagtacgtccctgtgcagctgcaagggggggcaccctggggcttcacccttaaggggggtctggaacactgtgagccgctcacagtgtctaagattgaagatggaggcaaggcagctttgtcccagaagatgaggactggtgatgagctggtgaatatcaatggcactccattatatggctcccgccaagaggccctcattctcatcaaaggctccttccggattctcaagctgattgtcaggaggaggaacgcccctgtcagtaggccgcactcatggcatgtggccaagctgctggagggatgccctgaagcagccaccaccatgcatttcccttctgaagccttcagcttgtcctggcattctggctgcaacacaagtgacgtgtgtgtgcagtggtgtccactctcccggcattgcagcaccgagaaaagcagctccattggcagcatggagagcctggagcaaccaggccaagccacctatgagagccatctgttgcctattgaccagaacatgtaccctaaccagcgtgactcagcctacagctccttctcggccagctcaaatgcttctgactgtgccctttccctcaggccagaggagccagcctctacagactgcatcatgcaaggcccagggccaactaaggcccccagtggccggcctaatgtggctgagacctcaggaggtagtcggcgcaccaatgggggccacctgacccccagctctcagatgtcatcccgtccacaggagggataccagtcagggcccgccaaagcagtcaggggcccaccacaacctccagtgaggcgggacagccttcaggcctccagagcccaactcctcaatggagagcagcgcagggcatctgagcctgtggtccccttgccacagaaggagaaactgagcttagagcctgtgctacccgcaaggaaccctaataggttctgttgcctcagtgggcatgaccaagtgacaagtgagggccatcagaactgtgagttcagtcagcctcctgaatccagccaacagggctctgagcatctactgatgcaggcctcaaccaaagctgttggatccccaaaagcctgtgacagagcttccagcgtggattccaacccactcaatgaggcttctgcagagctagctaaggcttcttttggcagacctccacatctcataggacccacagggcatcgccatagtgcccctgaacagctgctggcatcccacctgcagcatgtgcaccttgataccaggggcagcaaagggatggagctcccacccgtacaggatgggcaccagtggactctgtcccctttgcacagcagccacaaagggaagaaaagtccatgcccccctacaggaggaacccatgaccagtccagcaaagaaagaaagaccagacaagtggatgacaggtctttagttttgggacaccagagccaaagcagtcccccacatggagaggctgatggacacccctcagaaaaaggtttcctggacccaaacagaacaagcagagcagccagtgaattggccaaccagcaaccctctgcctctggctcccttgttcaacaagccacggactgttcttcaaccactaaagcagctagtggcacagaggcaggtgaagaaggggacagcgagcccaaggagtgcagccggatgggtggtaggcgaagtggagggacccggggccgctcgatccaaaaccggcggaagagtgagcgttttgctaccaatctgcgtaatgaaattcagaggaggaaggcccagctccagaaaagcaagggtcccttgtcacagctgtgtgacactaaggagccagtggaagagacccaggagcccccagaaagtcctccactcactgcctctaacacatctcttctatcttcatgtaaaaaacctcccagccccagagacaagctcttcaacaaaagcatgatgctcagagctaggtcttccgagtgcctcagccaagcccctgagagccatgaatctaggacaggcttagagggacgaataagccctggccagaggcctggccagtcctctttgggcctgaacacctggtggaaagcacctgacccatcctcctcagaccctgagaaagcacatgctcactgtggagtccgtggaggtcattggagatggtctccagagcataattcacagccacttgtggcagcagccatggaaggcccttccaacccaggtgacaacaaggaattgaaggcttctactgctcaagctggggaggatgccatcctcttgccttttgcagacagaagaaagttctttgaagagagtagcaaatccttatctacatctcatttgccaggtttaaccactcatagcaacaagacttttacccagagaccaaaacctatagaccaaaacttccagccaatgagctccagctgtagggaattgaggcgccatcccatggaccaatcatatcattccgcagaccaaccatatcatgccacagaccaatcatatcattccatgtcaccccttcagtcagaaactcccacttactcagaatgttttgcaagcaaaggtctagaaaattccatgtgttgtaagccactacactgtggtgattttgattaccacaggacctgctcttactcctgcagtgttcaaggagctctagtccatgatccttgcatttattgttctggggaaatctgccctgccttgctaaagagaaatatgatgccaaattgctacaactgccggtgccaccaccaccaatgcattcggtgttcagtttgctatcataatcctcagcacagtgccctcgaggacagcagcttggcacctggcaacacttggaaacccaggaagctgacagtgcaggaatttcctggggacaaatggaatccaataacaggaaacaggaagaccagccagtcagggagggaaatggctcattccaagactagcttttcatgggcaacccctttccatccttgccttgagaacccagcactggacttgtcaagctaccgagcaatttcttctcttgacctccttggagacttcaaacatgctttgaaaaaatcagaggaaacttcagtttatgaggaggggagctcccttgcctccatgccccacccactgcgcagccgtgccttctcagagagtcacatcagcttggcgccccaaagcacccgggcctgggggcagcataggagggagctctttagcaaaggtgatgagacccagtcggatcttctcggagccaggaagaaggcctttcctcctcctcgccctcctcctcccaactgggagaagtacaggctctttcgtgcagcccagcagcagaagcagcaacagcagcagcagaagcaacaggaggaggaggaggaggaggaagaagaagaagaagaggaagaggaagaggaggaggaggaggcagaggaggaggaagaggagctgccaccccagtatttcagttcagaaacctctggttcctgtgctctcaatcctgaggaggtcctagagcagccacaacccctcagctttggccacctggagggctcgagacagggttcacaaagtgtcccagcagagcaagaatcctttgcactccattccagtgatttcttgcctccaataaggggtcacttgggatctcaacctgagcaggctcagcccccttgctactatggcattggtgggctttggaggacatcgggacaggaagccactgaatccgccaaacaagagtttcagcacttttcgcctccttcaggggccccaggaatccctacctcttactcagcttattacaatatttctgtggccaaggcagagctgctgaacaaactgaaagaccaacctgagatggcagagattggcctaggagaggaggaagttgaccatgaactggctcaaaaaaagatacagcttatcgaaagcatcagcagaaaactttctgtcttgcgggaggcccagcgagggctgctagaggacatcaatgccaattctgcccttggggaggaggtggaggccaacttaaaagccgtctgcaaatccaatgaatttgaaaagtaccacttgtttgttggggacctggacaaagtggtcaacctgttgctgtcactctctggacgactggcccgggtggagaatgctctgaacagcatcgattcagaggccaaccaggagaagttggtactgatagagaagaagcagcagctgacggggcagttggcagatgccaaggagctgaaggagcacgtggaccgccgggagaagttggtgtttggcatggtctcccgctacctgcctcaggaccagctccaagattaccagcactttgtcaagatgaaatctgctctcatcattgaacagcgagagctggaggagaagatcaagctcggggaagagcaactcaaatgtctcagggagagtctactcctggggcccagcaatttctaattctaccagcactctgccacagcatccctgcccagccatgtgggaagtgctttcaatcttctttgttagcagtttctcagcaagtagatagcaattagcagtttgttccagccctctaccctggatgtctctcactaccccttccctagcagtggtcctaaccagctaggagaccctggggaagccacaagcttctacccaagggagctgcagcaaggtgtgatcttagaaccacactctccttcccacagttgccaagggcaagtacttgctgcacagagaaccaaggaagtgccttcattctgctttgtactaggacaccaaagacatcaagtactcatcacccacccatatcatcaacagcctctaaaggctcagagggaatctgccttgcagctctactctgccccagggcttgtggccagccatttctcacagagagctggctgccttgagggcattcacctggcaccagtttcagggcctcacccaagctttgcaggggaaagcacagagggaggaattacactgaaaaaaatgcaagcaaaggttgagtacccccaggtgccccttaggaaggaaccaggtttaaataggctctacccttacctttcccagcagcaagttcaggggaagaggcctactcttagccctggctagtgtgaccctcttcctgtcctaagactttggtcctaccacctcttgtttcatctttcctttacattgctgggggttaccgcaggtgcctaccccagggcttcaccatatgggccattaatagctctactaaaactgacttctagatgtaggtttcattattgggggagggggttcttattgttatattttaaatggccttttgattttatttatttttatgttttgattatttttttcttttttaactaataaggcgagaagagggaagttggagagggaaaagttagcccagaaggaaagcattttctgcagatcagcctgaatccaccgtggctaggcatattcttgctcttctcgtgttgctcacaactacctgcctggatgaatttaggaaagttgcaggatacaaggttaaaacacaagatcaaatgaacaatccgaaaatgttattaagaaaacagttccggccgggcatggtggctcacgcctgaaatcccagcactttgggaggccgaggcaggtggatcacgaggtcaggagatcaagaccatcctggctaacacggtgaaaccctatctctactaaaaatacaaaaaattagccaggtgtggtggcacgcaccagtagtcccagctactcgggaggctgaggcaggagaattgcttgaacctggaaggcagagattgcagtgagctgagaccacaccactgcactccatcctgggcaacagagtgagactttgtctcaaaaagaaagaaagaaagaaagaaagaaagaaagaaagaaaagaaagaaagaaagaaagaaagaaaacagttccatttacaatagcatc

SEQ ID NO: 181289 - DNA, 9556 bp, Homo sapiens
  Payload ID: 15708
  Gene Symbol: SHROOM4
  Gene Name: shroom family member 4
  Uniprot ID: Q9ULL8
  ENST ID: ENST00000376020
  CDS Start-End: 27-4508
ccggcggcgcctgagcccagccgaggatggagaaccggcctgggtccttccagtacgtccctgtgcagctgcaagggggggcaccctggggcttcacccttaaggggggtctggaacactgtgagccgctcacagtgtctaagattgaagatggaggcaaggcagctttgtcccagaagatgaggactggtgatgagctggtgaatatcaatggcactccattatatggctcccgccaagaggccctcattctcatcaaaggctccttccggattctcaagctgattgtcaggaggaggaacgcccctgtcagtaggccgcactcatggcatgtggccaagctgctggagggatgccctgaagcagccaccaccatgcatttcccttctgaagccttcagcttgtcctggcattctggctgcaacacaagtgacgtgtgtgtgcagtggtgtccactctcccggcattgcagcaccgagaaaagcagctccattggcagcatggagagcctggagcaaccaggccaagccacctatgagagccatctgttgcctattgaccagaacatgtaccctaaccagcgtgactcagcctacagctccttctcggccagctcaaatgcttctgactgtgccctttccctcaggccagaggagccagcctctacagactgcatcatgcaaggcccagggccaactaaggcccccagtggccggcctaatgtggctgagacctcaggaggtagtcggcgcaccaatgggggccacctgacccccagctctcagatgtcatcccgtccacaggagggataccagtcagggcccgccaaagcagtcaggggcccaccacaacctccagtgaggcgggacagccttcaggcctccagagcccaactcctcaatggagagcagcgcagggcatctgagcctgtggtccccttgccacagaaggagaaactgagcttagagcctgtgctacccgcaaggaaccctaataggttctgttgcctcagtgggcatgaccaagtgacaagtgagggccatcagaactgtgagttcagtcagcctcctgaatccagccaacagggctctgagcatctactgatgcaggcctcaaccaaagctgttggatccccaaaagcctgtgacagagcttccagcgtggattccaacccactcaatgaggcttctgcagagctagctaaggcttcttttggcagacctccacatctcataggacccacagggcatcgccatagtgcccctgaacagctgctggcatcccacctgcagcatgtgcaccttgataccaggggcagcaaagggatggagctcccacccgtacaggatgggcaccagtggactctgtcccctttgcacagcagccacaaagggaagaaaagtccatgcccccctacaggaggaacccatgaccagtccagcaaagaaagaaagaccagacaagtggatgacaggtctttagttttgggacaccagagccaaagcagtcccccacatggagaggctgatggacacccctcagaaaaaggtttcctggacccaaacagaacaagcagagcagccagtgaattggccaaccagcaaccctctgcctctggctcccttgttcaacaagccacggactgttcttcaaccactaaagcagctagtggcacagaggcaggtgaagaaggggacagcgagcccaaggagtgcagccggatgggtggtaggcgaagtggagggacccggggccgctcgatccaaaaccggcggaagagtgagcgttttgctaccaatctgcgtaatgaaattcagaggaggaaggcccagctccagaaaagcaagggtcccttgtcacagctgtgtgacactaaggagccagtggaagagacccaggagcccccagaaagtcctccactcactgcctctaacacatctcttctatcttcatgtaaaaaacctcccagccccagagacaagctcttcaacaaaagcatgatgctcagagctaggtcttccgagtgcctcagccaagcccctgagagccatgaatctaggacaggcttagagggacgaataagccctggccagaggcctggccagtcctctttgggcctgaacacctggtggaaagcacctgacccatcctcctcagaccctgagaaagcacatgctcactgtggagtccgtggaggtcattggagatggtctccagagcataattcacagccacttgtggcagcagccatggaaggcccttccaacccaggtgacaacaaggaattgaaggcttctactgctcaagctggggaggatgccatcctcttgccttttgcagacagaagaaagttctttgaagagagtagcaaatccttatctacatctcatttgccaggtttaaccactcatagcaacaagacttttacccagagaccaaaacctatagaccaaaacttccagccaatgagctccagctgtagggaattgaggcgccatcccatggaccaatcatatcattccgcagaccaaccatatcatgccacagaccaatcatatcattccatgtcaccccttcagtcagaaactcccacttactcagaatgttttgcaagcaaaggtctagaaaattccatgtgttgtaagccactacactgtggtgattttgattaccacaggacctgctcttactcctgcagtgttcaaggagctctagtccatgatccttgcatttattgttctggggaaatctgccctgccttgctaaagagaaatatgatgccaaattgctacaactgccggtgccaccaccaccaatgcattcggtgttcagtttgctatcataatcctcagcacagtgccctcgaggacagcagcttggcacctggcaacacttggaaacccaggaagctgacagtgcaggaatttcctggggacaaatggaatccaataacaggaaacaggaagaccagccagtcagggagggaaatggctcattccaagactagcttttcatgggcaacccctttccatccttgccttgagaacccagcactggacttgtcaagctaccgagcaatttcttctcttgacctccttggagacttcaaacatgctttgaaaaaatcagaggaaacttcagtttatgaggaggggagctcccttgcctccatgccccacccactgcgcagccgtgccttctcagagagtcacatcagcttggcgccccaaagcacccgggcctgggggcagcataggagggagctctttagcaaaggtgatgagacccagtcggatcttctcggagccaggaagaaggcctttcctcctcctcgccctcctcctcccaactgggagaagtacaggctctttcgtgcagcccagcagcagaagcagcaacagcagcagcagaagcaacaggaggaggaggaggaggaggaagaagaagaagaagaggaagaggaagaggaggaggaggaggcagaggaggaggaagaggagctgccaccccagtatttcagttcagaaacctctggttcctgtgctctcaatcctgaggaggtcctagagcagccacaacccctcagctttggccacctggagggctcgagacagggttcacaaagtgtcccagcagagcaagaatcctttgcactccattccagtgatttcttgcctccaataaggggtcacttgggatctcaacctgagcaggctcagcccccttgctactatggcattggtgggctttggaggacatcgggacaggaagccactgaatccgccaaacaagagtttcagcacttttcgcctccttcaggggccccaggaatccctacctcttactcagcttattacaatatttctgtggccaaggcagagctgctgaacaaactgaaagaccaacctgagatggcagagattggcctaggagaggaggaagttgaccatgaactggctcaaaaaaagatacagcttatcgaaagcatcagcagaaaactttctgtcttgcgggaggcccagcgagggctgctagaggacatcaatgccaattctgcccttggggaggaggtggaggccaacttaaaagccgtctgcaaatccaatgaatttgaaaagtaccacttgtttgttggggacctggacaaagtggtcaacctgttgctgtcactctctggacgactggcccgggtggagaatgctctgaacagcatcgattcagaggccaaccaggagaagttggtactgatagagaagaagcagcagctgacggggcagttggcagatgccaaggagctgaaggagcacgtggaccgccgggagaagttggtgtttggcatggtctcccgctacctgcctcaggaccagctccaagattaccagcactttgtcaagatgaaatctgctctcatcattgaacagcgagagctggaggagaagatcaagctcggggaagagcaactcaaatgtctcagggagagtctactcctggggcccagcaatttctaattctaccagcactctgccacagcatccctgcccagccatgtgggaagtgctttcaatcttctttgttagcagtttctcagcaagtagatagcaattagcagtttgttccagccctctaccctggatgtctctcactaccccttccctagcagtggtcctaaccagctaggagaccctggggaagccacaagcttctacccaagggagctgcagcaaggtgtgatcttagaaccacactctccttcccacagttgccaagggcaagtacttgctgcacagagaaccaaggaagtgccttcattctgctttgtactaggacaccaaagacatcaagtactcatcacccacccatatcatcaacagcctctaaaggctcagagggaatctgccttgcagctctactctgccccagggcttgtggccagccatttctcacagagagctggctgccttgagggcattcacctggcaccagtttcagggcctcacccaagctttgcaggggaaagcacagagggaggaattacactgaaaaaaatgcaagcaaaggttgagtacccccaggtgccccttaggaaggaaccaggtttaaataggctctacccttacctttcccagcagcaagttcaggggaagaggcctactcttagccctggctagtgtgaccctcttcctgtcctaagactttggtcctaccacctcttgtttcatctttcctttacattgctgggggttaccgcaggtgcctaccccagggcttcaccatatgggccattaatagctctactaaaactgacttctagatgtaggtttcattattgggggagggggttcttattgttatattttaaatggccttttgattttatttatttttatgttttgattatttttttcttttttaactaataaggcgagaagagggaagttggagagggaaaagttagcccagaaggaaagcattttctgcagatcagcctgaatccaccgtggctaggtaagcaagtgccaaggcgttgaattgttcccaccatagctaccgatgtctaggaaggagttttccccttgaactcagagcctccctactgtggcctggccttgtgcttcccttaaagtctaagtgacttgagtttagcattccccagcagggtttaagtttttcttactgatttctttttgaaaccaaagaaatctcctgaaatggagaaaggttcagtcatttctctaccatctccaagctatgggatcagtagaggtgagctcagaaggaactcctctaaccattgctttctcagcctgtggcctggctcaagggaaccaaaactcaaggtagctgggagctccagccagagccagctccccagagcaattgaagacccagccaggatcttaggcatacaaacaactaaaactgctgctgttgccaaggccctgacaccagtagctagtttctatgctggaaaagcagccctcaggtggacgatggcaagaagggggttatggccaaatgctgccctgttatccagcttagctccctgttcctcactaactggggccaatccttggtatcacacaacccagccaaggcctggcatctcttctagttactgctgagttcctcagggtccttgaaggtcaactgtagcagcagggatgtctcattcaaccaaagaatttgccaaggaacttttgctgctgttacaaatacttgtcactagcttccatttcctcttcattgtatttgaaaacaatgggagaatcttggccagcagggtgtcctggggtagggggtggggtaagcctttctgtggagctctgggtttgctcttagtactgctgccagaaacactgttagaatggcaaccctgccattctcccctccagtggaagattctactttattcaggaaggctggtggcttgcaggggctaggcttacacaagccagccaagattgagaaggtaggggagtgctttcaatggaggccatagttgtcatcttttcttctgagcaggctctaggacaaacaatgagcaaattgagatgtcctgtattgggaggatgaggctgatatgtttcatcattctcagaatttgtgggctagagcacctttttgggaatatgggcctagggaaaagaacggtcacttacctggacactatggccatagtcttgagtttttctagtcagcatgtgattggttgtaccttaagtttatgacaccaaaaatactattaactctgttatttttgttcttaatcccatctcaaattagtttctagagttagaatcagaacacaaggatgctcattttcacatggagggaaagttgccaaagcatttaaaaaataaccccaaaagtatatctagcagtgaagcttggtagataaaggtgaactgctaaacagacactggcgtgccacactcctgccagggcagtctcattgtgtgtgacggtgctgcaacactgccagtattacttgagatgcagtctctctcccctgttctcagttcctgggctcagccctcctccaaggcctgccagtgagtagcagtttggaaggcaggccaagggagatccccaaagacagttatcagtcttaacttctgctgtctcccgtcaaatacttatacaggcccccatgggtaataggcaagcatgatggctgatagagaagtcagtgcatgagttactatcacatgtccccccaacccctcctgccacctcccagggctctggataattgaatcttcctgagtcccacagctggagactcaaccaggatatagctgtaaatgcccaagtagaatctgacagaataagacagagacactgaaaataaagccctagaaaggaagaaattggaagcaaagaaaaggagaggtgaaaagataaaaagcctccttcaaggttaggttcaggttctgttttccatttaacctcatgtgccataaagctgcccaggcacaccagagccacatcctgaacccgaccctccctgacagtgctgctctgccagtagcaagccccagatggaggaagctgggcccatttctggccacttccacccatttggagctttgccagaggagtcgtctatgccaataatatttctgcaacagcatattatattatttgaagattagtagatctttttgggggggtggggcaggggacagtttctatagatgaagaaccagtgttggttgtacagctgttgggggtcatctatcccatgtgaagctattctttttccaaatcttgttgtttctgcatttgtgtcctccaccactcccttcttggctgacatagatatgcctgccagattgtcatcaagggtcatatttcaataaaaggtgctaaggacaaaaaaaaatctcatgtgttttaactcaggtgatggaagtctaaagattctgctgaaaagtactggaaaggaatttggtcacctatccatagtccttcacagataaacatatgaccagacccttacccacatccctaaacccttaccctggcctctgagggatggtattgatgctataccattcatcatccccagttaaatagcaggatctgccatagcctttttaggggaacagcttttagacatctatttcaagaccatcctgagtagggggtacagagtttaagccattggttatttctgttgttatcacagtattgaagcatggtatttttctactcagaaggatctcaggatcacagccctgccctttagctcactgatatatttcttcctctctggttactcagtggcaacatcacatccagtctaaccccatgtttagaatgcagaaaaagtcaacaataggtgtaatctcaggtatagacctaagcagtatacagagtctagttctggagtctagcctgatcgaaggtaagccattctttctagacttcttccaatcttgaattctgtctagtattttcatcttacttctagctgatagtccaatctcacaccttcatgctcagctccctggaaagcaagggccttggtgatctgctctccaaggcaacctcaaagattagactcaaatgtattccaggaagcaactctgacattgaaaagctttcttttttcgtgatccatattctgttcacattccaactatcctccttctactcaagatatccattgtggtagagtagaaagagtccagctttggcattagaatgaactgtgttcaaatcctggttctgccacttattcaatgaacctgggctactagctcaacttctgaggtcattttcttatctgtaaaatgggaacagtattatcttgcttgcagttattgtaacttgaaaataataaataaaagccactaacaatccaagaagttattaggcagaatcccaggcccaccccaaacccagtgatagcagtctgaattttaactagatttccaggagattcatgaacatattacagcatgggaagtactgacttgttgaaaacatattcagtacatggtaaccattattatagtcctgatctactcaattcattttttccttatcccaggcatattcttgctcttctcgtgttgctcacaactacctgcctggatgaatttaggaaagttgcaggatacaaggttaaaacacaagatcaaatgaacaatccgaaaatgttattaagaaaacagttccggccgggcatggtggctcacgcctgaaatcccagcactttgggaggccgaggcaggtggatcacgaggtcaggagatcaagaccatcctggctaacacggtgaaaccctatctctactaaaaatacaaaaaattagccaggtgtggtggcacgcaccagtagtcccagctactcgggaggctgaggcaggagaattgcttgaacctggaaggcagagattgcagtgagctgagaccacaccactgcactccatcctgggcaacagagtgagactttgtctcaaaaagaaagaaagaaagaaagaaagaaagaaagaaagaaaagaaagaaagaaagaaagaaagaaaacagttccatttacaatagcatc

SEQ ID NO: 181290 - DNA, 8919 bp, Homo sapiens
  Payload ID: 15708
  Gene Symbol: SHROOM4
  Gene Name: shroom family member 4
  Uniprot ID: Q9ULL8
  ENST ID: ENST00000460112
  CDS Start-End: 456-4589
ctttcatccttccctttgccaccagggtgctggctggttcctggagcagcgtcttcactcctatccagctcttgacactggctttcgttccctaaggctgtggccatatctaggtccatccaggctgatggtcataccttgccttcagtgctactccttcctgttcttagaactggaacctgactgtgcctgagccccttggatcacactcagcatcttgggctgatggtccctcgccccagaaggtcttaactggagggcagatgggtcccagctaagggaggacgctggctggagggtttgtcaacgagagtctgagctagccggataccccgctctctcccaagccatctctccaccctgggcaacttccatggaggaacgcccctgtcagtaggccgcactcatggcatgtggccaagctgctggagggatgccctgaagcagccaccaccatgcatttcccttctgaagccttcagcttgtcctggcattctggctgcaacacaagtgacgtgtgtgtgcagtggtgtccactctcccggcattgcagcaccgagaaaagcagctccattggcagcatggagagcctggagcaaccaggccaagccacctatgagagccatctgttgcctattgaccagaacatgtaccctaaccagcgtgactcagcctacagctccttctcggccagctcaaatgcttctgactgtgccctttccctcaggccagaggagccagcctctacagactgcatcatgcaaggcccagggccaactaaggcccccagtggccggcctaatgtggctgagacctcaggaggtagtcggcgcaccaatgggggccacctgacccccagctctcagatgtcatcccgtccacaggagggataccagtcagggcccgccaaagcagtcaggggcccaccacaacctccagtgaggcgggacagccttcaggcctccagagcccaactcctcaatggagagcagcgcagggcatctgagcctgtggtccccttgccacagaaggagaaactgagcttagagcctgtgctacccgcaaggaaccctaataggttctgttgcctcagtgggcatgaccaagtgacaagtgagggccatcagaactgtgagttcagtcagcctcctgaatccagccaacagggctctgagcatctactgatgcaggcctcaaccaaagctgttggatccccaaaagcctgtgacagagcttccagcgtggattccaacccactcaatgaggcttctgcagagctagctaaggcttcttttggcagacctccacatctcataggacccacagggcatcgccatagtgcccctgaacagctgctggcatcccacctgcagcatgtgcaccttgataccaggggcagcaaagggatggagctcccacccgtacaggatgggcaccagtggactctgtcccctttgcacagcagccacaaagggaagaaaagtccatgcccccctacaggaggaacccatgaccagtccagcaaagaaagaaagaccagacaagtggatgacaggtctttagttttgggacaccagagccaaagcagtcccccacatggagaggctgatggacacccctcagaaaaaggtttcctggacccaaacagaacaagcagagcagccagtgaattggccaaccagcaaccctctgcctctggctcccttgttcaacaagccacggactgttcttcaaccactaaagcagctagtggcacagaggcaggtgaagaaggggacagcgagcccaaggagtgcagccggatgggtggtaggcgaagtggagggacccggggccgctcgatccaaaaccggcggaagagtgagcgttttgctaccaatctgcgtaatgaaattcagaggaggaaggcccagctccagaaaagcaagggtcccttgtcacagctgtgtgacactaaggagccagtggaagagacccaggagcccccagaaagtcctccactcactgcctctaacacatctcttctatcttcatgtaaaaaacctcccagccccagagacaagctcttcaacaaaagcatgatgctcagagctaggtcttccgagtgcctcagccaagcccctgagagccatgaatctaggacaggcttagagggacgaataagccctggccagaggcctggccagtcctctttgggcctgaacacctggtggaaagcacctgacccatcctcctcagaccctgagaaagcacatgctcactgtggagtccgtggaggtcattggagatggtctccagagcataattcacagccacttgtggcagcagccatggaaggcccttccaacccaggtgacaacaaggaattgaaggcttctactgctcaagctggggaggatgccatcctcttgccttttgcagacagaagaaagttctttgaagagagtagcaaatccttatctacatctcatttgccaggtttaaccactcatagcaacaagacttttacccagagaccaaaacctatagaccaaaacttccagccaatgagctccagctgtagggaattgaggcgccatcccatggaccaatcatatcattccgcagaccaaccatatcatgccacagaccaatcatatcattccatgtcaccccttcagtcagaaactcccacttactcagaatgttttgcaagcaaaggtctagaaaattccatgtgttgtaagccactacactgtggtgattttgattaccacaggacctgctcttactcctgcagtgttcaaggagctctagtccatgatccttgcatttattgttctggggaaatctgccctgccttgctaaagagaaatatgatgccaaattgctacaactgccggtgccaccaccaccaatgcattcggtgttcagtttgctatcataatcctcagcacagtgccctcgaggacagcagcttggcacctggcaacacttggaaacccaggaagctgacagtgcaggaatttcctggggacaaatggaatccaataacaggaaacaggaagaccagccagtcagggagggaaatggctcattccaagactagcttttcatgggcaacccctttccatccttgccttgagaacccagcactggacttgtcaagctaccgagcaatttcttctcttgacctccttggagacttcaaacatgctttgaaaaaatcagaggaaacttcagtttatgaggaggggagctcccttgcctccatgccccacccactgcgcagccgtgccttctcagagagtcacatcagcttggcgccccaaagcacccgggcctgggggcagcataggagggagctctttagcaaaggtgatgagacccagtcggatcttctcggagccaggaagaaggcctttcctcctcctcgccctcctcctcccaactgggagaagtacaggctctttcgtgcagcccagcagcagaagcagcaacagcagcagcagaagcaacaggaggaggaggaggaggaggaagaagaagaagaagaggaagaggaagaggaggaggaggaggcagaggaggaggaagaggagctgccaccccagtatttcagttcagaaacctctggttcctgtgctctcaatcctgaggaggtcctagagcagccacaacccctcagctttggccacctggagggctcgagacagggttcacaaagtgtcccagcagagcaagaatcctttgcactccattccagtgatttcttgcctccaataaggggtcacttgggatctcaacctgagcaggctcagcccccttgctactatggcattggtgggctttggaggacatcgggacaggaagccactgaatccgccaaacaagagtttcagcacttttcgcctccttcaggggccccaggaatccctacctcttactcagcttattacaatatttctgtggccaaggcagagctgctgaacaaactgaaagaccaacctgagatggcagagattggcctaggagaggaggaagttgaccatgaactggctcaaaaaaagatacagcttatcgaaagcatcagcagaaaactttctgtcttgcgggaggcccagcgagggctgctagaggacatcaatgccaattctgcccttggggaggaggtggaggccaacttaaaagccgtctgcaaatccaatgaatttgaaaagtaccacttgtttgttggggacctggacaaagtggtcaacctgttgctgtcactctctggacgactggcccgggtggagaatgctctgaacagcatcgattcagaggccaaccaggagaagttggtactgatagagaagaagcagcagctgacggggcagttggcagatgccaaggagctgaaggagcacgtggaccgccgggagaagttggtgtttggcatggtctcccgctacctgcctcaggaccagctccaagattaccagcactttgtcaagatgaaatctgctctcatcattgaacagcgagagctggaggagaagatcaagctcggggaagagcaactcaaatgtctcagggagagtctactcctggggcccagcaatttctaattctaccagcactctgccacagcatccctgcccagccatgtgggaagtgctttcaatcttctttgttagcagtttctcagcaagtagatagcaattagcagtttgttccagccctctaccctggatgtctctcactaccccttccctagcagtggtcctaaccagctaggagaccctggggaagccacaagcttctacccaagggagctgcagcaaggtgtgatcttagaaccacactctccttcccacagttgccaagggcaagtacttgctgcacagagaaccaaggaagtgccttcattctgctttgtactaggacaccaaagacatcaagtactcatcacccacccatatcatcaacagcctctaaaggctcagagggaatctgccttgcagctctactctgccccagggcttgtggccagccatttctcacagagagctggctgccttgagggcattcacctggcaccagtttcagggcctcacccaagctttgcaggggaaagcacagagggaggaattacactgaaaaaaatgcaagcaaaggttgagtacccccaggtgccccttaggaaggaaccaggtttaaataggctctacccttacctttcccagcagcaagttcaggggaagaggcctactcttagccctggctagtgtgaccctcttcctgtcctaagactttggtcctaccacctcttgtttcatctttcctttacattgctgggggttaccgcaggtgcctaccccagggcttcaccatatgggccattaatagctctactaaaactgacttctagatgtaggtttcattattgggggagggggttcttattgttatattttaaatggccttttgattttatttatttttatgttttgattatttttttcttttttaactaataaggcgagaagagggaagttggagagggaaaagttagcccagaaggaaagcattttctgcagatcagcctgaatccaccgtggctaggtaagcaagtgccaaggcgttgaattgttcccaccatagctaccgatgtctaggaaggagttttccccttgaactcagagcctccctactgtggcctggccttgtgcttcccttaaagtctaagtgacttgagtttagcattccccagcagggtttaagtttttcttactgatttctttttgaaaccaaagaaatctcctgaaatggagaaaggttcagtcatttctctaccatctccaagctatgggatcagtagaggtgagctcagaaggaactcctctaaccattgctttctcagcctgtggcctggctcaagggaaccaaaactcaaggtagctgggagctccagccagagccagctccccagagcaattgaagacccagccaggatcttaggcatacaaacaactaaaactgctgctgttgccaaggccctgacaccagtagctagtttctatgctggaaaagcagccctcaggtggacgatggcaagaagggggttatggccaaatgctgccctgttatccagcttagctccctgttcctcactaactggggccaatccttggtatcacacaacccagccaaggcctggcatctcttctagttactgctgagttcctcagggtccttgaaggtcaactgtagcagcagggatgtctcattcaaccaaagaatttgccaaggaacttttgctgctgttacaaatacttgtcactagcttccatttcctcttcattgtatttgaaaacaatgggagaatcttggccagcagggtgtcctggggtagggggtggggtaagcctttctgtggagctctgggtttgctcttagtactgctgccagaaacactgttagaatggcaaccctgccattctcccctccagtggaagattctactttattcaggaaggctggtggcttgcaggggctaggcttacacaagccagccaagattgagaaggtaggggagtgctttcaatggaggccatagttgtcatcttttcttctgagcaggctctaggacaaacaatgagcaaattgagatgtcctgtattgggaggatgaggctgatatgtttcatcattctcagaatttgtgggctagagcacctttttgggaatatgggcctagggaaaagaacggtcacttacctggacactatggccatagtcttgagtttttctagtcagcatgtgattggttgtaccttaagtttatgacaccaaaaatactattaactctgttatttttgttcttaatcccatctcaaattagtttctagagttagaatcagaacacaaggatgctcattttcacatggagggaaagttgccaaagcatttaaaaaataaccccaaaagtatatctagcagtgaagcttggtagataaaggtgaactgctaaacagacactggcgtgccacactcctgccagggcagtctcattgtgtgtgacggtgctgcaacactgccagtattacttgagatgcagtctctctcccctgttctcagttcctgggctcagccctcctccaaggcctgccagtgagtagcagtttggaaggcaggccaagggagatccccaaagacagttatcagtcttaacttctgctgtctcccgtcaaatacttatacaggcccccatgggtaataggcaagcatgatggctgatagagaagtcagtgcatgagttactatcacatgtccccccaacccctcctgccacctcccagggctctggataattgaatcttcctgagtcccacagctggagactcaaccaggatatagctgtaaatgcccaagtagaatctgacagaataagacagagacactgaaaataaagccctagaaaggaagaaattggaagcaaagaaaaggagaggtgaaaagataaaaagcctccttcaaggttaggttcaggttctgttttccatttaacctcatgtgccataaagctgcccaggcacaccagagccacatcctgaacccgaccctccctgacagtgctgctctgccagtagcaagccccagatggaggaagctgggcccatttctggccacttccacccatttggagctttgccagaggagtcgtctatgccaataatatttctgcaacagcatattatattatttgaagattagtagatctttttgggggggtggggcaggggacagtttctatagatgaagaaccagtgttggttgtacagctgttgggggtcatctatcccatgtgaagctattctttttccaaatcttgttgtttctgcatttgtgtcctccaccactcccttcttggctgacatagatatgcctgccagattgtcatcaagggtcatatttcaataaaaggtgctaaggacaaaaaaaaatctcatgtgttttaactcaggtgatggaagtctaaagattctgctgaaaagtactggaaaggaatttggtcacctatccatagtccttcacagataaacatatgaccagacccttacccacatccctaaacccttaccctggcctctgagggatggtattgatgctataccattcatcatccccagttaaatagcaggatctgccatagcctttttaggggaacagcttttagacatctatttcaagaccatcctgagtagggggtacagagtttaagccattggttatttctgttgttatcacagtattgaagcatggtatttttctactcagaaggatctcaggatcacagccctgccctttagctcactgatatatttcttcctctctggttactcagtggcaacatcacatccagtctaaccccatgtttagaatgcagaaaaagtcaacaataggtgtaatctcaggtatagacctaagcagtatacagagtctagttctggagtctagcctgatcgaaggtaagccattctttctagacttcttccaatcttgaattctgtctagtattttcatcttacttctagctgatagtccaatctcacaccttcatgctcagctccctggaaagcaagggccttggtgatctgctctccaaggcaacctcaaagattagactcaaatgtattccaggaagcaactctgacattgaaaagctttcttttttcgtgatccatattctgttcacattccaactatcctccttctactcaagatatccattgtggtagagtagaaagagtccagctttggcattagaatgaactgtgttcaaatcctggttctgccacttattcaatgaacctgggctactagctcaacttctgaggtcattttcttatctgtaaaatgggaacagtattatcttgcttgcagttattgtaacttg

SEQ ID NO: 181291 - DNA, 2338 bp, Homo sapiens
  Payload ID: 15709
  Gene Symbol: SGOL1
  Gene Name: shugoshin-like 1 (S. pombe)
  Uniprot ID: Q5FBB7
  ENST ID: ENST00000263753
  CDS Start-End: 141-1826
agttccaggcgacggcggacggtggtacggtcctggagggcccagtgcgcggggctagccgtggctggagagcttcgaagagccttgaaatgtgaggaggaggaagatagctgttgcagaagtagtggccaaggcaaaagatggccaaggaaagatgcctgaaaaagtcctttcaagatagtcttgaagacataaagaagcgaatgaaagagaaaaggaataaaaacttggcagagattggcaaacgcaggtcttttatagctgcaccatgccaaataatcaccaacacttctacactgctgaaaaattaccaagacaacaacaaaatgttagttttagctttggaaaatgaaaaatccaaagtgaaagaagcccaagatatcatcctacagctgagaaaagaatgttactatctcacatgtcagctatatgcattgaaaggaaaacttacatcacaacaaacagtagaacctgctcagaaccaggaaatatgttcctctggaatggaccccaatagtgatgacagctccagaaatttatttgtgaaggatttaccgcaaattcctcttgaagaaactgaacttccaggacaaggagaatcatttcaaatagaagatcagatacctactattcctcaagacacactgggagttgattttgattcaggtgaagctaagtctactgataatgtcttacctagaactgtatctgttcgtagcagtttaaagaaacattgtaacagtatatgtcagtttgatagcttggatgattttgaaaccagtcatttggcagggaagtcttttgaattcgaaagagttggatttttagacccactagtaaacatgcacatacctgaaaatgtacaacacaatgcttgtcaatggagcaaggaccaagttaacttatcaccaaagctgattcagccaggaacgtttactaaaacaaaagaagacattttagaatctaaatctgaacaaactaaaagtaagcaaagagatacacaagaaagaaaaagagaagagaaaagaaaagctaacaggagaaaatcaaaacgtatgtcaaaatataaagagaataaaagcgaaaataaaaaaactgttccccaaaaaaaaatgcacaaatctgtcagttccaatgatgcttacaattttaatttggaagagggtgttcatcttactcctttccgacaaaaagtgagcaatgactctaatagagaagaaaacaacgagtctgaagtgagcctctgtgaatcaagtggttcaggagatgattccgatgacctctatttgcccacttgcaagtacattcagaatcccacgagcaattcagatagaccagtcaccaggcctctagctaaaagagcactgaaatacacagatgaaaaagagacggagggttctaagccaacaaaaactcctaccactacaccacctgaaactcagcagtcacctcatcttagcctgaaggatatcaccaatgtctccttgtatcctgttgtgaaaatcagaagactttctctttctccaaaaaagaataaagcaagcccagcagtggctctgcctaaacgtaggtgcacagccagcgtgaactataaggagcccaccctcgcttcgaaactgagaagaggggacccttttacagatttgtgttttttgaattctcctattttcaagcagaaaaaggatttgagacgttctaaaaaaagagccctggaggtatcacctgccaaagaagcaatttttattttatattatgttcgagaatttgtttcgagattcccagactgtaggaaatgtaaacttgaaacccacatctgcttgaggtaaagtccacgggcttcacatccttagaaaacttttttagtccatgcattcactaatgtatgcagacctttaatagattctagctttatgtgttgggggagagatggaggggtgttgacagtctgtttcactcagcctacatacataataaaatctaagccctttaattagagatagcaactttcccagggtgaccgaggaatcagtacgtgttgaacccctcttttaagtttccttttggttgtgtcacttggagattgccttttctttcttgtaagctcagctgtgtcctcaaatatattgcattttacccagcatttccaggtgttttcaggggtcaaagtttttaagttatcttagtctttgatattgtgtaagcgaaattctccaatcccatctcctagatgatttttttttaaatcacaaaatgtgattatgcttaacagctgtttcctgtttctcttaaaataaaatccatttcctatttctcttaaaataaaatccattattcttaa

SEQ ID NO: 181292 - DNA, 1531 bp, Homo sapiens
  Payload ID: 15709
  Gene Symbol: SGOL1
  Gene Name: shugoshin-like 1 (S. pombe)
  Uniprot ID: Q5FBB7
  ENST ID: ENST00000306698
  CDS Start-End: 141-1019
agttccaggcgacggcggacggtggtacggtcctggagggcccagtgcgcggggctagccgtggctggagagcttcgaagagccttgaaatgtgaggaggaggaagatagctgttgcagaagtagtggccaaggcaaaagatggccaaggaaagatgcctgaaaaagtcctttcaagatagtcttgaagacataaagaagcgaatgaaagagaaaaggaataaaaacttggcagagattggcaaacgcaggtcttttatagctgcaccatgccaaataatcaccaacacttctacactgctgaaaaattaccaagacaacaacaaaatgttagttttagctttggaaaatgaaaaatccaaagtgaaagaagcccaagatatcatcctacagctgagaaaagaatgttactatctcacatgtcagctatatgcattgaaaggaaaacttacatcacaacaaacagtagaacctgctcagaaccaggaaatatgttcctctggaatggaccccaatagtgatgacagctccagaaatttatttgtgaaggatttaccgcaaattcctcttgaagaaactgaacttccaggacaaggagaatcatttcaaatagaagctacaccacctgaaactcagcagtcacctcatcttagcctgaaggatatcaccaatgtctccttgtatcctgttgtgaaaatcagaagactttctctttctccaaaaaagaataaagcaagcccagcagtggctctgcctaaacgtaggtgcacagccagcgtgaactataaggagcccaccctcgcttcgaaactgagaagaggggacccttttacagatttgtgttttttgaattctcctattttcaagcagaaaaaggatttgagacgttctaaaaaaagagccctggaggtatcacctgccaaagaagcaatttttattttatattatgttcgagaatttgtttcgagattcccagactgtaggaaatgtaaacttgaaacccacatctgcttgaggtaaagtccacgggcttcacatccttagaaaacttttttagtccatgcattcactaatgtatgcagacctttaatagattctagctttatgtgttgggggagagatggaggggtgttgacagtctgtttcactcagcctacatacataataaaatctaagccctttaattagagatagcaactttcccagggtgaccgaggaatcagtacgtgttgaacccctcttttaagtttccttttggttgtgtcacttggagattgccttttctttcttgtaagctcagctgtgtcctcaaatatattgcattttacccagcatttccaggtgttttcaggggtcaaagtttttaagttatcttagtctttgatattgtgtaagcgaaattctccaatcccatctcctagatgatttttttttaaatcacaaaatgtgattatgcttaacagctgtttcctgtttctcttaaaataaaatccatttcctatttctcttaaaataaaatccattattcttaa

SEQ ID NO: 181293 - DNA, 1187 bp, Homo sapiens
  Payload ID: 15709
  Gene Symbol: SGOL1
  Gene Name: shugoshin-like 1 (S. pombe)
  Uniprot ID: Q5FBB7
  ENST ID: ENST00000437051
  CDS Start-End: 141-968
agttccaggcgacggcggacggtggtacggtcctggagggcccagtgcgcggggctagccgtggctggagagcttcgaagagccttgaaatgtgaggaggaggaagatagctgttgcagaagtagtggccaaggcaaaagatggccaaggaaagatgcctgaaaaagtcctttcaagatagtcttgaagacataaagaagcgaatgaaagagaaaaggaataaaaacttggcagagattggcaaacgcaggtcttttatagctgcaccatgccaaataatcaccaacacttctacactgctgaaaaattaccaagacaacaacaaaatgttagttttagctttggaaaatgaaaaatccaaagtgaaagaagcccaagatatcatcctacagctgagaaaagaatgttactatctcacatgtcagctatatgcattgaaaggaaaacttacatcacaacaaacagtagaacctgctcagaaccaggaaatatgttcctctggaatggaccccaatagtgatgacagctccagaaatttatttgtgaaggatttaccgcaaattcctcttgaagaaactgaacttccaggacaaggagaatcatttcaaatagaagatcagatacctactattcctcaagacacactgggagttgattttgattcagctacaccacctgaaactcagcagtcacctcatcttagcctgaaggatatcaccaatgtctccttgtatcctgttgtgaaaatcagaagactttctctttctccaaaaaagaataaagcaagcccagcagtggctctgcctaaacgtaggtgcacagccagcgtgaactataaggagcccaccctcgcttcgaaactgagaagaggggacccttttacagatttgtgttttttgaattctcctattttcaagcagaaaaaggatttgagacgttctaaaaaaagtatgaaacaaatacaatgaaggttttgttggatattgtttaaattcaatctacacctctttctgttgcttcaggagaggatctgtaagagtacacaaacagagtgagccattgccatagaatattctcttgacaggaccctagctcataaacatttcttcagaactatacttcaaatgggatgctttgtattaaaactttaataaatttaatttattttttcttttgaatataaataa

SEQ ID NO: 181294 - DNA, 1075 bp, Homo sapiens
  Payload ID: 15709
  Gene Symbol: SGOL1
  Gene Name: shugoshin-like 1 (S. pombe)
  Uniprot ID: Q5FBB7
  ENST ID: ENST00000417364
  CDS Start-End: 188-1015
ctggagagcttcgaagagccttgaaatgtgaggaggaggaagatagctgttgcagaagtagtggccaaggtatcgttctggacgcgcctgcggcaggagggtcgccgcgtccacttccgccagccccacctccccccggccttcctggagtccctgaaagaggaagaagtaggttttaaggcaaaagatggccaaggaaagatgcctgaaaaagtcctttcaagatagtcttgaagacataaagaagcgaatgaaagagaaaaggaataaaaacttggcagagattggcaaacgcaggtcttttatagctgcaccatgccaaataatcaccaacacttctacactgctgaaaaattaccaagacaacaacaaaatgttagttttagctttggaaaatgaaaaatccaaagtgaaagaagcccaagatatcatcctacagctgagaaaagaatgttactatctcacatgtcagctatatgcattgaaaggaaaacttacatcacaacaaacagtagaacctgctcagaaccaggaaatatgttcctctggaatggaccccaatagtgatgacagctccagaaatttatttgtgaaggatttaccgcaaattcctcttgaagaaactgaacttccaggacaaggagaatcatttcaaatagaagatcagatacctactattcctcaagacacactgggagttgattttgattcagctacaccacctgaaactcagcagtcacctcatcttagcctgaaggatatcaccaatgtctccttgtatcctgttgtgaaaatcagaagactttctctttctccaaaaaagaataaagcaagcccagcagtggctctgcctaaacgtaggtgcacagccagcgtgaactataaggagcccaccctcgcttcgaaactgagaagaggggacccttttacagatttgtgttttttgaattctcctattttcaagcagaaaaaggatttgagacgttctaaaaaaagtatgaaacaaatacaatgaaggttttgttggatattgtttaaattcaatctacacctctttctgttgcttcaggagagg

SEQ ID NO: 181295 - DNA, 1582 bp, Homo sapiens
  Payload ID: 15709
  Gene Symbol: SGOL1
  Gene Name: shugoshin-like 1 (S. pombe)
  Uniprot ID: Q5FBB7
  ENST ID: ENST00000419233
  CDS Start-End: 141-1070
agttccaggcgacggcggacggtggtacggtcctggagggcccagtgcgcggggctagccgtggctggagagcttcgaagagccttgaaatgtgaggaggaggaagatagctgttgcagaagtagtggccaaggcaaaagatggccaaggaaagatgcctgaaaaagtcctttcaagatagtcttgaagacataaagaagcgaatgaaagagaaaaggaataaaaacttggcagagattggcaaacgcaggtcttttatagctgcaccatgccaaataatcaccaacacttctacactgctgaaaaattaccaagacaacaacaaaatgttagttttagctttggaaaatgaaaaatccaaagtgaaagaagcccaagatatcatcctacagctgagaaaagaatgttactatctcacatgtcagctatatgcattgaaaggaaaacttacatcacaacaaacagtagaacctgctcagaaccaggaaatatgttcctctggaatggaccccaatagtgatgacagctccagaaatttatttgtgaaggatttaccgcaaattcctcttgaagaaactgaacttccaggacaaggagaatcatttcaaatagaagatcagatacctactattcctcaagacacactgggagttgattttgattcagctacaccacctgaaactcagcagtcacctcatcttagcctgaaggatatcaccaatgtctccttgtatcctgttgtgaaaatcagaagactttctctttctccaaaaaagaataaagcaagcccagcagtggctctgcctaaacgtaggtgcacagccagcgtgaactataaggagcccaccctcgcttcgaaactgagaagaggggacccttttacagatttgtgttttttgaattctcctattttcaagcagaaaaaggatttgagacgttctaaaaaaagagccctggaggtatcacctgccaaagaagcaatttttattttatattatgttcgagaatttgtttcgagattcccagactgtaggaaatgtaaacttgaaacccacatctgcttgaggtaaagtccacgggcttcacatccttagaaaacttttttagtccatgcattcactaatgtatgcagacctttaatagattctagctttatgtgttgggggagagatggaggggtgttgacagtctgtttcactcagcctacatacataataaaatctaagccctttaattagagatagcaactttcccagggtgaccgaggaatcagtacgtgttgaacccctcttttaagtttccttttggttgtgtcacttggagattgccttttctttcttgtaagctcagctgtgtcctcaaatatattgcattttacccagcatttccaggtgttttcaggggtcaaagtttttaagttatcttagtctttgatattgtgtaagcgaaattctccaatcccatctcctagatgatttttttttaaatcacaaaatgtgattatgcttaacagctgtttcctgtttctcttaaaataaaatccatttcctatttctcttaaaataaaatccattattcttaa

SEQ ID NO: 181296 - DNA, 2266 bp, Homo sapiens
  Payload ID: 15709
  Gene Symbol: SGOL1
  Gene Name: shugoshin-like 1 (S. pombe)
  Uniprot ID: Q5FBB7
  ENST ID: ENST00000442720
  CDS Start-End: 267-1043
gaatgtggcggcggtagttccaggcgacggcggacggtggtacggtcctggagggcccagtgcgcggggctagccgtggctggagagcttcgaagagccttgaaatgtgaggaggaggaagatagctgttgcagaagtagtggccaaggtatcgttctggacgcgcctgcggcaggagggtcgccgcgtccacttccgccagccccacctccccccggccttcctggagtccctgaaagaggaagaagtaggttttaaggcaaaagatggccaaggaaagatgcctgaaaaagtcctttcaagatagtcttgaagacataaagaagcgaatgaaagagaaaaggaataaaaacttggcagagattggcaaacgcaggtcttttatagctgcaccatgccaaataatcaccaacacttctacactgctgaaaaattaccaagacaacaacaaaatgttagttttagctttggaaaatgaaaaatccaaagtgaaagaagcccaagatatcatcctacagctgagaaaagaatgttactatctcacatgtcagctatatgcattgaaaggaaaacttacatcacaacaaacagtagaacctgctcagaaccaggaaatatgttcctctggaatggaccccaatagtgatgacagctccagaaatttatttgtgaaggatttaccgcaaattcctcttgaagaaactgaacttccaggacaaggagaatcatttcaaatagaagctacaccacctgaaactcagcagtcacctcatcttagcctgaaggatatcaccaatgtctccttgtatcctgttgtgaaaatcagaagactttctctttctccaaaaaagaataaagcaagcccagcagtggctctgcctaaacgtaggtgcacagccagcgtgaactataaggagcccaccctcgcttcgaaactgagaagaggggacccttttacagatttgtgttttttgaattctcctattttcaagcagaaaaaggatttgagacgttctaaaaaaagtatgaaacaaatacaatgaaggttttgttggatattgtttaaattcaatctacacctctttctgttgcttcaggagaggatctgtaagagtacacaaacagagtgagccattgccatagaatattctcttgacaggaccctagctcataaacatttcttcagaactatacttcaaatgggatgctttgtattaaaactttaataaatttaatttattttttcttttgaatataaataactgagcttaagcattatcatcatatcgatttcttatgctgcctaaacctcttaattttagtcgaaatatatctttttttttttttggaggcggaatttcattcttgttgcccaggctggagtgcaatggcacgatctcagcttaccgcaacctccgcctcccaggttcaagcgattctcctgcctcagactcccgagtagctgggactacaggcatgtgccactacgcccggctaattttgtatttttagtagagacagggtttctccatgttggtcaggttgctctcaaactcccaacctcaggtgatctgcccacctcggcctcccaaagtgctgggattactgagccactgtgcccagcccaaaatgtatcttatacaaacattgtagaaatgaataatgattactcaaataagatcttttaattataagcttctggcatctctatttttcccttaagtaggggatactaaagtgaatgattttctaagaggatcttttgaaactctttagtacaatatttgagtaaaataaattattgtggatcttttgaaactctgtgtagtattcgagtaaaataaatatttgacatttacagtagggtacaccctaagttgtttatgaattccttataccactgttatatttaatttttcagataaaatatgtatgggaaaatgactagagaaattgattcttttttaggctcagggacaagataagtgactaattgtgaaccccaagctctaattgtatgttcagagtgatgtctccataaaattacaaatgtcatgtactttcagggtagctccttatttagtcagaaatctcagagattaaatgtgtgaatatttagggtttttgcatatttttgaccaaccaatgaaagcgaattagttcagtttagaaagtttgatgtctatacttgtatatacctctttaaattttagaactttgtaggttattcatttttaaagagcaataaagtttgtataagatagtg

SEQ ID NO: 181297 - DNA, 663 bp, Homo sapiens
  Payload ID: 15709
  Gene Symbol: SGOL1
  Gene Name: shugoshin-like 1 (S. pombe)
  ENST ID: ENST00000456624
  CDS Start-End: 6-260
aaaagatggccaaggaaagatgcctgaaaaagtcctttcaagatagtcttgaagacataaagaagcgaatgaaagagaaaaggaataaaaacttggcagagattggcaaacgcaggtcttttatagctgcaccatgccaaataatcaccaacacttctacactgctgaaaaattaccaagacaacaacaaaataaccaggaaatatgttcctctggaatggaccccaatagtgatgacagctccagaaatttatttgtgaaggatttaccgcaaattcctcttgaagaaactgaacttccaggacaaggagaatcatttcaaatagaagatcagatacctactattcctcaagacacactgggagttgattttgattcaggtgaagctaagtctactgataatgtcttacctagaactgtatctgttcgtagcagtttaaagaaacattgtaacagtatatgtcagtttgatagcttggatgattttgaaaccagtcatttggcagggaagtcttttgaattcgaaagagttggatttttagacccactagtaaacatgcacatacctgaaaatgtacaacacaatgcttgtcaatggagcaaggaccaagttaacttatcaccaaagctgattcagccaggaacgtttactaaaacaaaaga

SEQ ID NO: 181298 - DNA, 2587 bp, Homo sapiens
  Payload ID: 15709
  Gene Symbol: SGOL1
  Gene Name: shugoshin-like 1 (S. pombe)
  Uniprot ID: Q5FBB7
  ENST ID: ENST00000412997
  CDS Start-End: 353-1936
tctgcctgcgacggtggtgttgggtgcatcctgcgccacgtgaccgcctcccagccaaccaatggaggagcgaggcggaaaatttcgaatgtggcggcggtagttccaggcgacggcggacggtggtacggtcctggagggcccagtgcgcggggctagccgtggctggagagcttcgaagagccttgaaatgtgaggaggaggaagatagctgttgcagaagtagtggccaaggtatcgttctggacgcgcctgcggcaggagggtcgccgcgtccacttccgccagccccacctccccccggccttcctggagtccctgaaagaggaagaagtaggttttaaggcaaaagatggccaaggaaagatgcctgaaaaagtcctttcaagatagtcttgaagacataaagaagcgaatgaaagagaaaaggaataaaaacttggcagagattggcaaacgcaggtcttttatagctgcaccatgccaaataatcaccaacacttctacactgctgaaaaattaccaagacaacaacaaaatgttagttttagctttggaaaatgaaaaatccaaagtgaaagaagcccaagatatcatcctacagctgagaaaagaatgttactatctcacatgtcagctatatgcattgaaaggaaaacttacatcacaacaaacagtagaacctgctcagaaccaggaaatatgttcctctggaatggaccccaatagtgatgacagctccagaaatttatttgtgaaggatttaccgcaaattcctcttgaagaaactgaacttccaggacaaggagaatcatttcaaatagaagatcagatacctactattcctcaagacacactgggagttgattttgattcaggtgaagctaagtctactgataatgtcttacctagaactgtatctgttcgtagcagtttaaagaaacattgtaacagtatatgtcagtttgatagcttggatgattttgaaaccagtcatttggcagggaagtcttttgaattcgaaagagttggatttttagacccactagtaaacatgcacatacctgaaaatgtacaacacaatgcttgtcaatggagcaaggaccaagttaacttatcaccaaagctgattcagccaggaacgtttactaaaacaaaagaagacattttagaatctaaatctgaacaaactaaaagtaagcaaagagatacacaagaaagaaaaagagaagagaaaagaaaagctaacaggagaaaatcaaaacgtatgtcaaaatataaagagaataaaagcgaaaataaaaaaactgttccccaaaaaaaaatgcacaaatctgtcagttccaatgatgcttacaattttaatttggaagagggtgttcatcttactcctttccgacaaaaagtgagcaatgactctaatagagaagaaaacaacgagtctgaagtgagcctctgtgaatcaagtggttcaggagatgattccgatgacctctatttgcccacttgcaagtacattcagaatcccacgagcaattcagatagaccagtcaccaggcctctagctaaaagagcactgaaatacacagatgaaaaagagacggagggttctaagccaacaaaaactcctaccactacaccacctgaaactcagcagtcacctcatcttagcctgaaggatatcaccaatgtctccttgtatcctgttgtgaaaatcagaagactttctctttctccaaaaaagaataaagcaagcccagcagtggctctgcctaaacgtaggtgcacagccagcgtgaactataaggagcccaccctcgcttcgaaactgagaagaggggacccttttacagatttgtgttttttgaattctcctattttcaagcagaaaaaggatttgagacgttctaaaaaaagtatgaaacaaatacaatgaaggttttgttggatattgtttaaattcaatctacacctctttctgttgcttcaggagaggatctgtaagagtacacaaacagagtgagccattgccatagaatattctcttgacaggaccctagctcataaacatttcttcagaactatacttcaaatgggatgctttgtattaaaactttaataaatttaatttattttttcttttgaatataaataactgagcttaagcattatcatcatatcgatttcttatgctgcctaaacctcttaattttagtcgaaatatatctttttttttttttggaggcggaatttcattcttgttgcccaggctggagtgcaatggcacgatctcagcttaccgcaacctccgcctcccaggttcaagcgattctcctgcctcagactcccgagtagctgggactacaggcatgtgccactacgcccggctaattttgtatttttagtagagacagggtttctccatgttggtcaggttgctctcaaactcccaacctcaggtgatctgcccacctcggcctcccaaagtgctgggattactgagccactgtgcccagcccaaaatgtatcttatacaaacattgtagaaatgaataatgattactcaaataagatcttttaattataa

SEQ ID NO: 181299 - DNA, 1162 bp, Homo sapiens
  Payload ID: 15709
  Gene Symbol: SGOL1
  Gene Name: shugoshin-like 1 (S. pombe)
  Uniprot ID: Q5FBB7
  ENST ID: ENST00000452020
  CDS Start-End: 188-1066
ctggagagcttcgaagagccttgaaatgtgaggaggaggaagatagctgttgcagaagtagtggccaaggtatcgttctggacgcgcctgcggcaggagggtcgccgcgtccacttccgccagccccacctccccccggccttcctggagtccctgaaagaggaagaagtaggttttaaggcaaaagatggccaaggaaagatgcctgaaaaagtcctttcaagatagtcttgaagacataaagaagcgaatgaaagagaaaaggaataaaaacttggcagagattggcaaacgcaggtcttttatagctgcaccatgccaaataatcaccaacacttctacactgctgaaaaattaccaagacaacaacaaaatgttagttttagctttggaaaatgaaaaatccaaagtgaaagaagcccaagatatcatcctacagctgagaaaagaatgttactatctcacatgtcagctatatgcattgaaaggaaaacttacatcacaacaaacagtagaacctgctcagaaccaggaaatatgttcctctggaatggaccccaatagtgatgacagctccagaaatttatttgtgaaggatttaccgcaaattcctcttgaagaaactgaacttccaggacaaggagaatcatttcaaatagaagctacaccacctgaaactcagcagtcacctcatcttagcctgaaggatatcaccaatgtctccttgtatcctgttgtgaaaatcagaagactttctctttctccaaaaaagaataaagcaagcccagcagtggctctgcctaaacgtaggtgcacagccagcgtgaactataaggagcccaccctcgcttcgaaactgagaagaggggacccttttacagatttgtgttttttgaattctcctattttcaagcagaaaaaggatttgagacgttctaaaaaaagagccctggaggtatcacctgccaaagaagcaatttttattttatattatgttcgagaatttgtttcgagattcccagactgtaggaaatgtaaacttgaaacccacatctgcttgaggtaaagtccacgggcttcacatccttagaaaacttttttagtccatgcattcactaatgtatgcagacctttaatagattctagctttatgtgttggggg

SEQ ID NO: 181300 - DNA, 931 bp, Homo sapiens
  Payload ID: 15709
  Gene Symbol: SGOL1
  Gene Name: shugoshin-like 1 (S. pombe)
  Uniprot ID: Q5FBB7
  ENST ID: ENST00000443724
  CDS Start-End: 188-835
ctggagagcttcgaagagccttgaaatgtgaggaggaggaagatagctgttgcagaagtagtggccaaggtatcgttctggacgcgcctgcggcaggagggtcgccgcgtccacttccgccagccccacctccccccggccttcctggagtccctgaaagaggaagaagtaggttttaaggcaaaagatggccaaggaaagatgcctgaaaaagtcctttcaagatagtcttgaagacataaagaagcgaatgaaagagaaaaggaataaaaacttggcagagattggcaaacgcaggtcttttatagctgcaccatgccaaataatcaccaacacttctacactgctgaaaaattaccaagacaacaacaaaatgttagttttagctttggaaaatgaaaaatccaaagtgaaagaagcccaagatatcatcctacagctgagaaaagaatgttactatctcacatgtcagctatatgcattgaaaggaaaacttacatcacaacaaacagtagaacctgctcagaaccaggaaatatgttcctctggaatggaccccaatagtgatgacagctccagaaatttatttgtgaaggatttaccgcaaattcctcttgaagaaactgaacttccaggacaaggagaatcatttcaaatagaagatcagatacctactattcctcaagacacactgggagttgattttgattcaggagccctggaggtatcacctgccaaagaagcaatttttattttatattatgttcgagaatttgtttcgagattcccagactgtaggaaatgtaaacttgaaacccacatctgcttgaggtaaagtccacgggcttcacatccttagaaaacttttttagtccatgcattcactaatgtatgcagacctttaatagattctagctttatgtgttggggg

SEQ ID NO: 181301 - DNA, 1969 bp, Homo sapiens
  Payload ID: 15709
  Gene Symbol: SGOL1
  Gene Name: shugoshin-like 1 (S. pombe)
  Uniprot ID: Q5FBB7
  ENST ID: ENST00000421451
  CDS Start-End: 188-1873
ctggagagcttcgaagagccttgaaatgtgaggaggaggaagatagctgttgcagaagtagtggccaaggtatcgttctggacgcgcctgcggcaggagggtcgccgcgtccacttccgccagccccacctccccccggccttcctggagtccctgaaagaggaagaagtaggttttaaggcaaaagatggccaaggaaagatgcctgaaaaagtcctttcaagatagtcttgaagacataaagaagcgaatgaaagagaaaaggaataaaaacttggcagagattggcaaacgcaggtcttttatagctgcaccatgccaaataatcaccaacacttctacactgctgaaaaattaccaagacaacaacaaaatgttagttttagctttggaaaatgaaaaatccaaagtgaaagaagcccaagatatcatcctacagctgagaaaagaatgttactatctcacatgtcagctatatgcattgaaaggaaaacttacatcacaacaaacagtagaacctgctcagaaccaggaaatatgttcctctggaatggaccccaatagtgatgacagctccagaaatttatttgtgaaggatttaccgcaaattcctcttgaagaaactgaacttccaggacaaggagaatcatttcaaatagaagatcagatacctactattcctcaagacacactgggagttgattttgattcaggtgaagctaagtctactgataatgtcttacctagaactgtatctgttcgtagcagtttaaagaaacattgtaacagtatatgtcagtttgatagcttggatgattttgaaaccagtcatttggcagggaagtcttttgaattcgaaagagttggatttttagacccactagtaaacatgcacatacctgaaaatgtacaacacaatgcttgtcaatggagcaaggaccaagttaacttatcaccaaagctgattcagccaggaacgtttactaaaacaaaagaagacattttagaatctaaatctgaacaaactaaaagtaagcaaagagatacacaagaaagaaaaagagaagagaaaagaaaagctaacaggagaaaatcaaaacgtatgtcaaaatataaagagaataaaagcgaaaataaaaaaactgttccccaaaaaaaaatgcacaaatctgtcagttccaatgatgcttacaattttaatttggaagagggtgttcatcttactcctttccgacaaaaagtgagcaatgactctaatagagaagaaaacaacgagtctgaagtgagcctctgtgaatcaagtggttcaggagatgattccgatgacctctatttgcccacttgcaagtacattcagaatcccacgagcaattcagatagaccagtcaccaggcctctagctaaaagagcactgaaatacacagatgaaaaagagacggagggttctaagccaacaaaaactcctaccactacaccacctgaaactcagcagtcacctcatcttagcctgaaggatatcaccaatgtctccttgtatcctgttgtgaaaatcagaagactttctctttctccaaaaaagaataaagcaagcccagcagtggctctgcctaaacgtaggtgcacagccagcgtgaactataaggagcccaccctcgcttcgaaactgagaagaggggacccttttacagatttgtgttttttgaattctcctattttcaagcagaaaaaggatttgagacgttctaaaaaaagagccctggaggtatcacctgccaaagaagcaatttttattttatattatgttcgagaatttgtttcgagattcccagactgtaggaaatgtaaacttgaaacccacatctgcttgaggtaaagtccacgggcttcacatccttagaaaacttttttagtccatgcattcactaatgtatgcagacctttaatagattctagctttatgtgttggggg

SEQ ID NO: 181302 - DNA, 1213 bp, Homo sapiens
  Payload ID: 15709
  Gene Symbol: SGOL1
  Gene Name: shugoshin-like 1 (S. pombe)
  Uniprot ID: Q5FBB7
  ENST ID: ENST00000425061
  CDS Start-End: 188-1117
ctggagagcttcgaagagccttgaaatgtgaggaggaggaagatagctgttgcagaagtagtggccaaggtatcgttctggacgcgcctgcggcaggagggtcgccgcgtccacttccgccagccccacctccccccggccttcctggagtccctgaaagaggaagaagtaggttttaaggcaaaagatggccaaggaaagatgcctgaaaaagtcctttcaagatagtcttgaagacataaagaagcgaatgaaagagaaaaggaataaaaacttggcagagattggcaaacgcaggtcttttatagctgcaccatgccaaataatcaccaacacttctacactgctgaaaaattaccaagacaacaacaaaatgttagttttagctttggaaaatgaaaaatccaaagtgaaagaagcccaagatatcatcctacagctgagaaaagaatgttactatctcacatgtcagctatatgcattgaaaggaaaacttacatcacaacaaacagtagaacctgctcagaaccaggaaatatgttcctctggaatggaccccaatagtgatgacagctccagaaatttatttgtgaaggatttaccgcaaattcctcttgaagaaactgaacttccaggacaaggagaatcatttcaaatagaagatcagatacctactattcctcaagacacactgggagttgattttgattcagctacaccacctgaaactcagcagtcacctcatcttagcctgaaggatatcaccaatgtctccttgtatcctgttgtgaaaatcagaagactttctctttctccaaaaaagaataaagcaagcccagcagtggctctgcctaaacgtaggtgcacagccagcgtgaactataaggagcccaccctcgcttcgaaactgagaagaggggacccttttacagatttgtgttttttgaattctcctattttcaagcagaaaaaggatttgagacgttctaaaaaaagagccctggaggtatcacctgccaaagaagcaatttttattttatattatgttcgagaatttgtttcgagattcccagactgtaggaaatgtaaacttgaaacccacatctgcttgaggtaaagtccacgggcttcacatccttagaaaacttttttagtccatgcattcactaatgtatgcagacctttaatagattctagctttatgtgttggggg

SEQ ID NO: 181303 - DNA, 4214 bp, Homo sapiens
  Payload ID: 15710
  Gene Symbol: SGOL2
  Gene Name: shugoshin-like 2 (S. pombe)
  Uniprot ID: Q562F6
  ENST ID: ENST00000357799
  CDS Start-End: 99-3896
aaccgccaacggctgtggcgtttaaacccaagccgcagccgctgctgctcgccgagctcccggagctgggtgggggtgccccacgctgaaagagagtgatggagtgcccagtgatggaaactggctcactttttacctcaggaattaagagacatttgaaagacaaaagaatttcaaagactactaagttgaatgtttctcttgcttcaaaaataaaaacaaaaatactaaataattcttctattttcaaaatatctttaaagcacaacaacagggcattagctcaggctcttagtagagaaaaagagaattctcgaagaattacaactgaaaagatgctattgcaaaaagaagtagagaaactgaattttgagaacacatttcttcgcctaaagctaaataacttgaataagaagcttatagacatagaagctctcatgaacaataacttgataactgcaattgaaatgagcagtctttctgagttccatcagagttcctttctactgtcagctagcaagaagaaacgaattagtaaacagtgcaagttgatgcgtcttccatttgcaagggttccattaacttcaaatgatgatgaagatgaagataaagagaaaatgcagtgtgacaacaatattaaatcaaagacattacctgatattccctcttcaggatcaacaacacaacctttatcaactcaggataattcggaagtgttatttcttaaagaaaataatcaaaatgtatatggtttagatgattcagaacatatttcttctatagttgatgtacctcccagagaaagccattcccactcagaccaaagttctaagacttctctaatgagtgagatgagaaacgcccagtctattggccgcagatgggagaaaccatctcctagtaatgtgactgaaaggaagaagcgtgggtcatcttgggaatcaaataatctttctgcagacactccctgtgcaacagttttagataaacaacacatttcaagtccagaattaaattgcaataatgagataaatggtcatactaatgaaacaaatactgaaatgcaaagaaataaacaggatcttcctggcttatcttctgagtctgccagagaacctaatgcagagtgcatgaatcaaattgaggataatgatgactttcaattgcagaaaactgtgtatgatgctgacatggatttaactgctagtgaagtcagcaaaattgtcacagtctcaacaggcattaaaaagaaaagtaataaaaaaacaaatgaacatggaatgaaaactttcagaaaagtgaaagattccagctctgaaaaaaagagagaaagatcaaagagacagtttaaaaatagttcagatgtcgatattggggaaaagattgaaaacaggacagaaagatctgatgtcctggatggcaaaaggggtgcagaagatcccggttttattttcaataatgaacagctggctcagatgaatgaacagctggctcaggtgaatgaactaaagaaaatgacccttcaaactggctttgaacaaggtgacagagaaaatgtactgtgtaataaaaaggagaaaagaataacaaatgagcaagaggaaacatactctttatcccaaagttcaggtaaatttcaccaggagagtaaatttgataagggtcagaattccctaacttgtaataaaagtaaagcttctagacagacatttgtgattcacaaattagaaaaagataacttactcccaaaccaaaaggataaagtaaccatttatgaaaacctagacgtcacaaatgaatttcacacagccaatctttccaccaaagataatggaaatttatgtgattatgggacccacaatatattggatttgaaaaagtatgtcactgatattcaaccctcagagcaaaatgaatcaaacattaataagcttagaaagaaagtaaaccggaagacagaaataatttctggaatgaaccacatgtatgaggataatgataaagatgtggtgcatggcctaaaaaaaggtaatttttttttcaaaacccaagaggataaagaacctatctctgaaaacatagaagtttccaaagagcttcaaatcccagctctttctactagagataatgaaaatcaatgtgactataggacccagaatgtgttgggtttgcaaaagcagatcaccaatatgtaccccgttcagcaaaatgaatcaaaagttaataagaagcttaggcagaaagtaaatcggaagacagaaataatttctgaagtgaatcatttagataatgacaaaagtatagaatacacagttaaaagtcactcactctttttaacgcaaaaagataaggaaatcatccctggaaacctagaagacccaagtgagtttgaaacacctgctctttctaccaaagatagtggaaacctgtatgattctgagattcaaaatgttttgggggtgaaacatggccatgatatgcaacctgcttgtcaaaatgattcaaaaataggtaagaagcctagactaaatgtatgtcaaaagtcagaaataattcctgaaaccaaccaaatatatgagaatgataacaaaggtgtacatgacctagaaaaagataacttcttctctctaaccccaaaggataaagaaacaatttctgaaaatctacaagtcacaaatgaatttcaaacagttgatcttctcatcaaagataatggaaatttatgtgattatgacacccagaatatattggagttgaaaaagtatgttactgataggaaatctgctgagcaaaatgaatcaaaaataaataagctcaggaataaagtgaattggaagacagaaataatttctgaaatgaaccagatatatgaggataatgataaagatgcacatgtccaagaaagctatacaaaagatcttgattttaaagtaaataaatctaaacaaaaacttgaatgccaagacattatcaataaacactatatggaagtcaacagtaatgaaaaggaaagttgtgatcaaattttagattcctacaaagtagttaaaaaacgtaagaaagaatcatcatgcaaggcaaagaacattttgacaaaagctaagaacaaacttgcttcacagttaacagaatcttcacagacatctatctccttagaatctgatttaaaacatattactagtgaagcagattctgatccaggaaacccagttgaactatgtaagactcagaagcaaagcactaccactttgaataaaaaagatctcccttttgtggaagaaataaaagaaggagagtgtcaggttaaaaaggtaaataaaatgacatctaagtcaaagaaaaggaagacctccatagatccttctccagagagccatgaagtaatggaaagaatacttgacagcgttcagggaaagtctactgtatctgaacaagctgataaggaaaacaatttggagaatgagaaaatggtcaaaaataagccagacttttacacaaaggcatttagatctttgtctgagatacattcacctaacatacaagattcttcctttgacagtgttcgtgaaggtttagtacctttgagcgtttcttctggtaaaaatgtgataataaaagaaaattttgccttggagtgctccccagcctttcaagtaagtgatgatgagcatgagaagatgaacaagatgaaatttaaagtcaaccggagaacccaaaaatcaggaataggtgatagaccattacaggacttgtcaaataccagttttgtttcaaataacactgctgaatctgaaaataagtcagaagatctatcttcagaacggacaagcagaagaagaaggtgtactcctttctattttaaagagccaagcctcagagacaagatgagaagatgaagtgaatttatggattctggtttttctgaattttcaaagcataaggaatcaaaacagaaatatagtatcaagaagatgaaatgcttaatgaaaaggttttttttttgtttctttggcctttcatggagtgttgatttgtccattcttaatgtttattaataggtatatgtgcataaaatagctattttgtaacattaaactttttgagtcattttggtcatcatataacttaccttcctgtttatttaagcttctttttacctagtagcctttaaccaaacaataaccttttaaccaaataaaatgtgttaataaata

SEQ ID NO: 181304 - DNA, 1041 bp, Homo sapiens
  Payload ID: 15710
  Gene Symbol: SGOL2
  Gene Name: shugoshin-like 2 (S. pombe)
  Uniprot ID: Q562F6
  ENST ID: ENST00000409203
  CDS Start-End: 89-832
ggctgtggcgtttaaacccaagccgcagccgctgctgctcgccgagctcccggagctgggtgggggtgccccacgctgaaagagagtgatggagtgcccagtgatggaaactggctcactttttacctcaggaattaagagacatttgaaagacaaaagaatttcaaagactactaagttgaatgtttctcttgcttcaaaaataaaaacaaaaatactaaataattcttctattttcaaaatatctttaaagcacaacaacagggcattagctcaggctcttagtagagaaaaagagaattctcgaagaattacaactgaaaagatgctattgcaaaaagaagtagagaaactgaattttgagaacacatttcttcgcctaaagctaaataacttgaataagaagcttatagacatagaagctctcatgaacaataacttgataactgcaattgaaatgagcagtctttctgagttccatcagagttcctttctactgtcagctagcaagaagaaacgaattagtaaacagtgcaagttgatgcgtcttccatttgcaagggttccattaacttcaaatgatgatgaagatgaagataaagagaaaatgcagtgtgacaacaatattaaatcaaagacattacctgatattccctcttcaggatcaacaacacaacctttatcaactcaggataattcggaagtgttatttcttaaagaaaataatcaaaatgtatatggtttagatgattcagaacatatttcttctatagttgatgtacctcccagaggtgagattgttttaaaaattcattttgagtatttgtattagttacattcatcagatgttcttcctgagggcaattatgtataacagttaataagttagctctcttatgttaccgatttgctaacttctgccatttaaaactgctggtgatagatttaattttaaagtaaatatgctgacaaacatcacacccacagtggcctaatactgttactctggaagaaatatttagaaataaatggacctaatga

SEQ ID NO: 181305 - DNA, 640 bp, Homo sapiens
  Payload ID: 15710
  Gene Symbol: SGOL2
  Gene Name: shugoshin-like 2 (S. pombe)
  ENST ID: ENST00000418045
  CDS Start-End: 379-640
gacctgcggcccgccagaccctcggcgcggccgccggacgccgcggggcggacgcggaagtgaacgccttctcagctgctcggcaactcgggagcagagcggccccagcggcgcccccgtgcggcccggctctgaggcagcggctcagggagggagggaggccacgtcccgggcacgccacgccacgccacgccccgcccccagattcgtctcgccccagtgggccgcctcggagtcgggtgggtcttccatcccggaggacccgattggctgatggggcaaccgccaacggctgtggcgtttaaacccaagccgcagccgctgctgctcgccgagctcccggagctgggtgggggtgccccacgctgaaagagagtgatggagtgcccagtgatggaaactggctcactttttacctcaggaattaagagacatttgaaagacaaaagaatttcaaagactactaagttgaatgtttctcttgcttcaaaaataaaaacaaaaatactaaataattcttctattttcaaaatatctttaaagcacaacaacagggcattagctcaggctcttagtagagaaaaagagaattctcgaagaattacaactgaaaagatgctattgcaaaaagaagtagaga

SEQ ID NO: 181306 - DNA, 1631 bp, Homo sapiens
  Payload ID: 15711
  Gene Symbol: SBDS
  Gene Name: Shwachman-Bodian-Diamond syndrome
  Uniprot ID: Q9Y3A5
  ENST ID: ENST00000246868
  CDS Start-End: 185-937
gtaagtaagcctgccagacacactgtgacggctgcctgaagctagtgagtcgcggcgccgcgcactggtggttgggtcagtgccgcgcgccgatcggtcgttaccgcgaggcgctggtggccttcaggctggacggcgcgggtcagccctggttcgccggcttctgggtctttgaacagccgcgatgtcgatcttcacccccaccaaccagatccgcctaaccaatgtggccgtggtacggatgaagcgtgccgggaagcgcttcgaaatcgcctgctacaaaaacaaggtcgtcggctggcggagcggcgtggaaaaagacctcgatgaagttctgcagacccactcagtgtttgtaaatgtttctaaaggtcaggttgccaaaaaggaagatctcatcagtgcgtttggaacagatgaccaaactgaaatctgtaagcagattttgactaaaggagaagttcaagtatcagataaagaaagacacacacaactggagcagatgtttagggacattgcaactattgtggcagacaaatgtgtgaatcctgaaacaaagagaccatacaccgtgatccttattgagagagccatgaaggacatccactattcggtgaaaaccaacaagagtacaaaacagcaggctttggaagtgataaagcagttaaaagagaaaatgaagatagaacgtgctcacatgaggcttcggttcatccttccagtcaatgaaggcaagaagctgaaagaaaagctcaagccactgatcaaggtcatagaaagtgaagattatggccaacagttagaaatcgtatgtctgattgacccgggctgcttccgagaaattgatgagctaataaaaaaggaaactaaaggcaaaggttctttggaagtactcaatctgaaagatgtagaagaaggagatgagaaatttgaatgacacccatcaatctcttcacctctaaaacactaaagtgtttccgtttccgacggcactgtttcatgtctgtggtctgccaaatacttgcttaaactatttgacattttctatctttgtgttaacagtggacacagcaaggctttcctacataagtataataatgtgggaatgatttggttttaattataaactggggtctaaatcctaaagcaaaattgaaactccaagatgcaaagtccagagtggcattttgctactctgtctcatgccttgatagctttccaaaatgaaagttacttgaggcagctcttgtgggtgaaaagttatttgtacagtagagtaagattattaggggtatgtctatacaacaaaagggggggtctttcctaaaaaagaaaacatatgatgcttcatttctacttaatggaacttgtgttctgagggtcattatggtatcgtaatgtaaagcttggatgatgttcctgattatctgagaaacagatatagaaaaattgtgccggacttacctttcattgaacatgctgccataacttagattattcttggttaaaaaataaaagtcacttatttctaattcttaaagtttataatatatattaatatagctaaaattgtatgtaatcaataaaaccactcttatgtttattaaactatggcttgtgtttctagacaa

SEQ ID NO: 181307 - DNA, 1531 bp, Homo sapiens
  Payload ID: 15711
  Gene Symbol: SBDS
  Gene Name: Shwachman-Bodian-Diamond syndrome
  ENST ID: ENST00000414306
  CDS Start-End: 160-420
tgacggctgcctgaagctagtgagtcgcggcgccgcgcactggtggttgggtcagtgccgcgcgccgatcggtcgttaccgcgaggcgctggtggccttcaggctggacggcgcgggtcagccctggttcgccggcttctgggtctttgaacagccgcgatgtcgatcttcacccccaccaaccagatccgcctaaccaatgtggccgtggtacggatgaagcgtgccgggaagcgcttcgaaatcgcctgctacaaaaacaaggtcgtcggctggcggagcggcgtggaaaaagacctcgatgaagttctgcagacccactcagtgtttgtaaatgtttctaaaggtcaggttgccaaaaaggaagatctcatcagtgcgtttggaacagatgaccaaactgaaatctattttgactaaaggagaagttcaagtatcagataaagaaagacacacacaactggagcagatgtttagggacattgcaactattgtggcagacaaatgtgtgaatcctgaaacaaagagaccatacaccgtgatccttattgagagagccatgaaggacatccactattcggtgaaaaccaacaagagtacaaaacagcaggctttggaagtgataaagcagttaaaagagaaaatgaagatagaacgtgctcacatgaggcttcggttcatccttccagtcaatgaaggcaagaagctgaaagaaaagctcaagccactgatcaaggtcatagaaagtgaagattatggccaacagttagaaatcgtatgtctgattgacccgggctgcttccgagaaattgatgagctaataaaaaaggaaactaaaggcaaaggttctttggaagtactcaatctgaaagatgtagaagaaggagatgagaaatttgaatgacacccatcaatctcttcacctctaaaacactaaagtgtttccgtttccgacggcactgtttcatgtctgtggtctgccaaatacttgcttaaactatttgacattttctatctttgtgttaacagtggacacagcaaggctttcctacataagtataataatgtgggaatgatttggttttaattataaactggggtctaaatcctaaagcaaaattgaaactccaagatgcaaagtccagagtggcattttgctactctgtctcatgccttgatagctttccaaaatgaaagttacttgaggcagctcttgtgggtgaaaagttatttgtacagtagagtaagattattaggggtatgtctatacaacaaaagggggggtctttcctaaaaaagaaaacatatgatgcttcatttctacttaatggaacttgtgttctgagggtcattatggtatcgtaatgtaaagcttggatgatgttcctgattatctgagaaacagatatagaaaaattgtgccggacttacctttcattgaacatgctgccataacttagattattcttggttaaaaaataaaagtcacttatttctaattcttaaagtttataatatatattaatatagc

SEQ ID NO: 181308 - DNA, 953 bp, Homo sapiens
  Payload ID: 15711
  Gene Symbol: SBDS
  Gene Name: Shwachman-Bodian-Diamond syndrome
  ENST ID: ENST00000617799
  CDS Start-End: 171-923
cagacacactgtgacggctgcctgaagctagtgagtcgcggcgccgcgcactggtggttgggtcagtgccgcgcgccgatcggtcgttaccgcgaggcgctggtggccttcaggctggacggcgcgggtcagccctggttcgccggcttctgggtctttgaacagccgcgatgtcgatcttcacccccaccaaccagatccgcctaaccaatgtggccgtggtacggatgaagcgtgccgggaagcgcttcgaaatcgcctgctacaaaaacaaggtcgtcggctggcggagcgcgtgggaaaaagacctcgatgaagttctgcagacccactcagtgtttgtaaatgtttctaaaggtcaggttgccaaaaaggaagatctcatcagtgcgtttggaacagatgaccaaactgaaatctgtaagcagattttgactaaaggagaagttcaagtatcagataaagaaagacacacacaactggagcagatgtttagggacattgcaactattgtggcagacaaatgtgtgaatcctgaaacaaagagaccatacaccgtgatccttattgagagagccatgaaggacatccactattcggtgaaaaccaacaagagtacaaaacagcaggctttggaagtgataaagcagttaaaagagaaaatgaagatagaacgtgctcacatgaggcttcggttcatccttccagtcaatgaaggcaagaagctgaaagaaaagctcaagccactgatcaaggtcatagaaagtgaagattatggccaacagttagaaatcgtatgtctgattgacccgggctgcttccgagaaattgatgagctaataaaaaaggaaactaaaggcaaaggttctttggaagtactcaatctgaaagatgtagaagaaggagatgagaaatttgaatgacacccatcaatctcttcacctctaaaacac

SEQ ID NO: 181309 - DNA, 2415 bp, Homo sapiens
  Payload ID: 15712
  Gene Symbol: SIAH1
  Gene Name: siah E3 ubiquitin protein ligase 1
  Uniprot ID: Q8IUQ4
  ENST ID: ENST00000356721
  CDS Start-End: 425-1366
gcaggcaggctcctgcagtaactcttgagctggctcagggagcgcacttccttctcagccagcgcgtcgccccctgcatccgtggcctccactggagctgggcaggaccctacccagtgaatctggagaaaacaaacttgggagacagacgaaagcttagggcacattggaggacagcgcagctgtggctcccatttttggagatgcagtcgaatttgagctcacagggaggtgtggttgcctcctggggatggaaaggcttcctttctccacctctgtaactggtgcttctgagaagtaaatggtatttggatcctgacctcagacgcgaatttgggtcttctgtgcttaggagcagaaagagcccaggaggggcctgttcctttacttcttgggggaaacgcaatgcgtggcctgacttctcatgacgggaaaggctactccaccttctctgtactcctggaggggagtcttgttcacatgtttaccagcggccaggacaaggaagagaaaagaaatgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcggtaggtggaagctagacacatgaaggtaaataaaaagaaaggctgttaaatacaggaaacagttgcatgtagtaacactaatatatttaaaaataagtcaacagtaaaccactgaaaaaatatatgtatatacacccaagatgggcatcttttgtattaagaaaggaagcattgtaaaataattctgagttttgtgtttgttgtagattgattgtattgttgaaaaagtttgtttttgcgtgggagtgtgtgcctgcgtgggtgtgtgcgtgtttgggtttttttcctttaactgacaagccatcttgagtggtcatgggccactgcttttccctttgtgagtcaatacatagtgctgctgtgtgctttttttgtgtgtatttgctaatttttattaattttagtttttcattaaataaatttgacttttctgtaattcaggtttttcctttttttgtaccattttaaagttagtatcttttgatatgcatatttgtttatggtaaaaaatttataacgtgttcaatattttcttttcccccattaatcagttcattagaaatattttaaaatcagctattttgtgaagccatgagttccagaaagtaaaggtgacatcggaaaaataatcaaaagctatttaaagcatctataaggtgctctctttctgtcttctacagatgagtcacacctttgagcttaatctttgaaaggttagagaataaattgatttttataaatactgcaaatcaggcttttgtttcctttttcagatatcttggacaaatcacatattttaaaatttgttcttgtatttattggttttgcagaagaaggcatcgtcatgcacagtatttgtaattaaaagcaaatcatttgtttaaaaaggcagtttgcaaaaaatgtttttggtcttttataattctcattaaaagaatatctggcaaattaaaaaaa

SEQ ID NO: 181310 - DNA, 3352 bp, Homo sapiens
  Payload ID: 15712
  Gene Symbol: SIAH1
  Gene Name: siah E3 ubiquitin protein ligase 1
  Uniprot ID: Q8IUQ4
  ENST ID: ENST00000380006
  CDS Start-End: 1455-2303
tttcacccccaagacaaatagtggcctgccattttccagcccaggtagcttcctgggaaaagttgcttgttttatctttgactcagcctggctagttacattgtcgattatttcttccagatgatatttacctgttaaataatgtttattactctgctgatgaatgttttcagcaacgctggagaaccctaggctgcaaggggttcttcacctgttgactccatcccccacccccagtatggcatatatctctgccgtgctatcatctttattctttcctttttcattgtctcttcctgactgtcctcctttgttcattatgtctgacacatattgtggattgaaagtagaacagaaagatatactttctctaccagactaaaaagttttgagatggccctccatttctcccatgcctcacttcaccttagttgtgtttttatttatttttatattttcgccaccttcactagcgagtacatcccctcactcttgaggtgggcactgatcagtaggaaataagattaatacctggctggtgataatttggggggaagacttaattagatagagatggataatgggatggcagcagacctttccccttgtgacccttcccctcatttccaaaatacacctctagagtagataattgcttaccattaagaagagttaatggaaggtgatactctgattctttggcattggaactacattcaatccgcggtatcctcggattagttctaggacccccttctccataccaaaacctgaggatgctcaagtccctgatagaaaatggtgtcatatttgtatgtgcatattctcttgtataatttaagtgatctctggattacttaatacaatgtaaacaatatgtaaatagttgttatagactgtattttaaaaattttgtattctttataaatttttctgaatattttcaatccatggctggtgaagtcctcggatgcagaccgtgtggatacagagtgccgattttatacaggagttcacctgtaactccctgtacctatcaacagctgactccaaattagaaagaaatagagtaagggagcctcagggagagtcctagcaaaacggattcgattaaacttcagttccttgtatagtttctttagttgtttatggtccattttctattttagcatttattattctatgtagtctatccaaagacgattaagggagttccacatgttttccggaacattttgaaaagagagcttatccagtgtacagatcctaataaagtgcacattcagtgtaattttatttttttaatatcttttttaatcctatttttcttcctcttttgctcagtaaattttgtatgaaactttaaaaggacttatggcatgtaaacattatttataaagtaagtcatggttataattatttttctcctgcctccttatgtatttatttcagaaatgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcggtaggtggaagctagacacatgaaggtaaataaaaagaaaggctgttaaatacaggaaacagttgcatgtagtaacactaatatatttaaaaataagtcaacagtaaaccactgaaaaaatatatgtatatacacccaagatgggcatcttttgtattaagaaaggaagcattgtaaaataattctgagttttgtgtttgttgtagattgattgtattgttgaaaaagtttgtttttgcgtgggagtgtgtgcctgcgtgggtgtgtgcgtgtttgggtttttttcctttaactgacaagccatcttgagtggtcatgggccactgcttttccctttgtgagtcaatacatagtgctgctgtgtgctttttttgtgtgtatttgctaatttttattaattttagtttttcattaaataaatttgacttttctgtaattcaggtttttcctttttttgtaccattttaaagttagtatcttttgatatgcatatttgtttatggtaaaaaatttataacgtgttcaatattttcttttcccccattaatcagttcattagaaatattttaaaatcagctattttgtgaagccatgagttccagaaagtaaaggtgacatcggaaaaataatcaaaagctatttaaagcatctataaggtgctctctttctgtcttctacagatgagtcacacctttgagcttaatctttgaaaggttagagaataaattgatttttataaatactgcaaatcaggcttttgtttcctttttcagatatcttggacaaatcacatattttaaaatttgttcttgtatttattggttttgcagaagaaggcatcgtcatgcacagtatttgtaattaaaagcaaatcatttgtttaaaaaggcagtttgcaaaaaatgtttttggtcttttataattctcattaaaagaatatctggcaaattaaaaaaa

SEQ ID NO: 181311 - DNA, 2147 bp, Homo sapiens
  Payload ID: 15712
  Gene Symbol: SIAH1
  Gene Name: siah E3 ubiquitin protein ligase 1
  Uniprot ID: Q8IUQ4
  ENST ID: ENST00000394725
  CDS Start-End: 250-1098
cagtgtgtggtatttagcgggggcgcgcggcgggctcgaggacgcgcgaaacggcggcggcggcggcggccaggggggagccggggcggccgttgcggggcgcgctctcgagaggcggcggcggcccagggtgtcccgtcggtctcggcgccgggaagaggcggtggcgctgcccgcggtggcgggggttggcgacggagcgcgttggtgccaggaccggggtccgaggcgcgctctccgcccacagaaatgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcggtaggtggaagctagacacatgaaggtaaataaaaagaaaggctgttaaatacaggaaacagttgcatgtagtaacactaatatatttaaaaataagtcaacagtaaaccactgaaaaaatatatgtatatacacccaagatgggcatcttttgtattaagaaaggaagcattgtaaaataattctgagttttgtgtttgttgtagattgattgtattgttgaaaaagtttgtttttgcgtgggagtgtgtgcctgcgtgggtgtgtgcgtgtttgggtttttttcctttaactgacaagccatcttgagtggtcatgggccactgcttttccctttgtgagtcaatacatagtgctgctgtgtgctttttttgtgtgtatttgctaatttttattaattttagtttttcattaaataaatttgacttttctgtaattcaggtttttcctttttttgtaccattttaaagttagtatcttttgatatgcatatttgtttatggtaaaaaatttataacgtgttcaatattttcttttcccccattaatcagttcattagaaatattttaaaatcagctattttgtgaagccatgagttccagaaagtaaaggtgacatcggaaaaataatcaaaagctatttaaagcatctataaggtgctctctttctgtcttctacagatgagtcacacctttgagcttaatctttgaaaggttagagaataaattgatttttataaatactgcaaatcaggcttttgtttcctttttcagatatcttggacaaatcacatattttaaaatttgttcttgtatttattggttttgcagaagaaggcatcgtcatgcacagtatttgtaattaaaagcaaatcatttgtttaaaaaggcagtttgcaaaaaatgtttttggtcttttataattctcattaaaagaatatctggcaaattaaaaaaa

SEQ ID NO: 181312 - DNA, 2683 bp, Homo sapiens
  Payload ID: 15712
  Gene Symbol: SIAH1
  Gene Name: siah E3 ubiquitin protein ligase 1
  Uniprot ID: Q8IUQ4
  ENST ID: ENST00000568007
  CDS Start-End: 1596-2444
gggcagtgtggatggcatgcagtgggatggtgaaggatggggccagaggaaggaaggacatgcccgcccagctgtgtttgggatgctgcctccctggagaggggtcatgaagcctagcaggcagtggagcccaggtaatggtggaccttgaggggaacgccagtgggaaacttagacccatgaactccagactgtacattgaggccatcagtttcaaatgtttactttttggtatttgctattccaagctgaacacagggaggtgggtgagttggaagcttgtttgtgcttggaagcttgtttgtgctggatgtactttagcaggacttccccggactacagggggcttctgagccactgggctccccagagtgatgagagacctgctgtgtagactactcctgaaagactttcatgaaggcacaaaagcaacaggtttgctgagtggtgctgcccgtgccccataaggagaacggtgtatactgtttccacacgatgcagcaagccaagctccaggctgcacacttggggtctttaaaggatgcctcattagagtaaaatgggacttacttttttttttataactcaattttattctgagcccctgttatgctaggtggcagaaatgtcatctcaggcaatgttgggggcctgcccctttcctcagggcttgctatcgaggaagtcatcgagggcttgcgatcaaggcctggggtcccacctgtcctcacagcttgctgctgggacacctgctcctccgtgccccaggtctagagtctctgctggtgttgggcgcctggcagcgtttcactggggaggcctccttggctccagctcattcctctttctctgtgtctggtgcctgcccagggcctttcccattaaatggtactgggtgctctctggtcatcggctccacagtctggatggatgttttgcctcccatctgaagcttagacaaggcacgagggtcaaggatccccactcaggacccatcaacatctgtattcccccacctggggaagggtgctggttttcttcattatgcaccccccatctttaggagtctataaagcatcaactcaaagtgacaagaagtggacacatattctaagggagctccccaggacaaaaggaagatggaggaaatggtctctgaaggctcaaagcagctccccctgccccgtgtaaagcgctgatgagatggcaatttaaactgctttgatgaccaggtttcattaggatcaagggatgaaaagactgagattgtatacatgtaaataccaagttcagtgagtttccatggcctcttctgtcttaatacaacttaccaaacaatccagacagatttctgcctccactttgttgatttacccagggaagtggggaaagtaagaagtaacttggactcttctagaggagagcaggcacaaactaagccaagaaaagcacgtttgagaattccagaggcagaagttgcttctgggtgcctgacgtcaacgatccagcacttcaagactggtgtgcggcatcctcaggggacactgtgtcctgggcacccctgcagtttaagagaatccactagtttataagaaatgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcgctgctggatacaattttcatggcaataggaactgaagtacttcaaataatgtgagcttaaacatgttacttcattgaaacaaccaaaactacttgatgtttacatctaaaatcctggttaaaataaattttagatttggaaagggaa

SEQ ID NO: 181313 - DNA, 589 bp, Homo sapiens
  Payload ID: 15712
  Gene Symbol: SIAH1
  Gene Name: siah E3 ubiquitin protein ligase 1
  ENST ID: ENST00000563745
  CDS Start-End: 294-589
aagcagctccccctgccccgtgtaaagcgctgatgagatggcaatttaaactgctttgatgaccaggtttcattagggaagtggggaaagtaagaagtaacttggactcttctagaggagagcaggcacaaactaagccaagaaaagcacgtttgagaattccagaggcagaagttgcttctgggtgcctgacgtcaacgatccagcacttcaagactggtgtgcggcatcctcaggggacactgtgtcctgggcacccctgcagtttaagagaatccactagtttataagaaatgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaa

SEQ ID NO: 181314 - DNA, 2517 bp, Homo sapiens
  Payload ID: 15713
  Gene Symbol: SIAH2
  Gene Name: siah E3 ubiquitin protein ligase 2
  Uniprot ID: O43255
  ENST ID: ENST00000312960
  CDS Start-End: 529-1503
ccccgcggggctgcagcgagccaggcatgctcactggcgcaggcccggcccgcagcccgagcaggaagcgccggcgctaggcggccccctgcgctgccagctggagccgggcggagccagcgccccggcgcagggtggctctgccagtccccgcgcgcctgggcggccgcacacgtgtccaggcgtcacgtccgcgcgcgcccccggggcttgcgtcagcggctgttccagaagcgggtgggccagggctctgcgcaccgctggggttcggggcccgggacgccgccgggaggagggcaccgcgcggggtccgacgcggaggcgtgctcggaacgccgggggctgcggagtgcatcagcgcggtccagccctccgcctgccgggcgccgagcgtctccgccgcccggacctgggctgggcgccgtggcgttgcctcggagctcgctgcccgcggggcgcgcaccgccttgacccgggcggccccgcggcaggcaggcgcccgcagttccatggttggttcggagcgcgatgagccgcccgtcctccaccggccccagcgctaataaaccctgcagcaagcagccgccgccgcagccccagcacactccgtccccggctgcgcccccggccgccgccaccatctcggctgcgggccccggctcgtccgcggtgcccgccgcggcggcggtgatctcgggccccggcggcggcggcggggccggcccggtgtccccgcagcaccacgagctgacctcgctcttcgagtgtccggtctgctttgactatgtcctgcctcctattctgcagtgccaggccgggcacctggtgtgtaaccaatgccgccagaagttgagctgctgcccgacgtgcaggggcgccctgacgcccagcatcaggaacctggctatggagaaggtggcctcggcagtcctgtttccctgtaagtatgccaccacgggctgttccctgaccctgcaccatacggagaaaccagaacatgaagacatatgtgaataccgtccctactcctgcccatgtcctggtgcttcctgcaagtggcaggggtccctggaagctgtgatgtcccatctcatgcacgcccacaagagcattaccacccttcagggagaagacatcgtctttctagctacagacattaacttgccaggggctgtcgactgggtgatgatgcagtcatgttttggccatcacttcatgctggtgctggagaaacaagagaagtacgaaggccaccagcagttttttgccatcgtcctgctcattggcacccgcaagcaagccgagaactttgcctacagactggagttgaatgggaaccggcggagattgacctgggaggccacgccccgttcgattcatgacggtgtggctgcggccatcatgaacagcgactgccttgttttcgacacagccatagcacatctttttgcagataatgggaaccttggaatcaatgttactatttctacatgttgtccatgatgtgactttcgtaaaccttcaaaattatttgggcatagtgctctatgtttaataaaggtttttatagatgttttattccatatgtcttcacaagtcaggacccacaattacccgtgttttgtttgaacagcagtgtcccatctggcttcgacccaacaaagttcattaacctgggatgaatggggttggcctgttggtgatttggatgctgttctgtgatctaaaacaactcttattgaattgtatttactccctaaacaacacttgacaggctgttgcacagggcttctatagatcagtgtgttaggaatgggaggccccttcctgcctgccttcccatattggtcccttgacattgacaaaagcacagtgactgtcagcagattcctttacttttgtttgtgggaggtaggaattgttttaatgcattttaaacagtgtttctgaaattggatggctggctaatagacactgaatcacccggagtgcttatcttaaaattgcagatttagggagcctgccaatttaacagtctcatcaggtgattcttttcaacagtaatgtttgagaattactgggttaaattgtgggaaagggtccagattttaaaggtgctttaaggttgccctctgccgatactgtttgtctttctactgtttcatcccctaacttcccccaaccctcaaattaaaactagaactatagatccacatgaacgcacgcctgagatttggccactcacctatgttttgggtggattgcctaggaaagcaagtcatatggccattgatagttctcatgtaattagttttgctcaccactagtacagatgacccgtttacacgtggcttccctcggaagccctcctcaacagtagctggtgtgaaagactaaatcagtagagttggaaaagctttataaccggtgtgtcatatgcttgctatttaaagctgtgtgttggttttgtttttctgccacattcactagttttttaataaatattttccaaaaatg

SEQ ID NO: 181315 - DNA, 427 bp, Homo sapiens
  Payload ID: 15713
  Gene Symbol: SIAH2
  Gene Name: siah E3 ubiquitin protein ligase 2
  ENST ID: ENST00000482706
  CDS Start-End: 178-427
acttcggcgacgcttccccgagagtagcccccctcctcaacccagaaaagacaaccccgcggggctgcagcgagccagtgccaggccgggcacctggtgtgtaaccaatgccgccagaagttgagctgctgcccgacgtgcaggggcgccctgacgcccagcatcaggaacctggctatggagaaggtggcctcggcagtcctgtttccctgtaagtatgccaccacgggctgttccctgaccctgcaccatacggagaaaccagaacatgaagacatatgtgaataccgtccctactcctgcccatgtcctggtgcttcctgcaagtggcaggggtccctggaagctgtgatgtcccatctcatgcacgcccacaagagcattaccacccttcagggagaagacatcgtctttctagctacagaca

SEQ ID NO: 181316 - DNA, 7057 bp, Homo sapiens
  Payload ID: 15714
  Gene Symbol: SIAH3
  Gene Name: siah E3 ubiquitin protein ligase family member 3
  Uniprot ID: Q8IW03
  ENST ID: ENST00000400405
  CDS Start-End: 108-917
aagccgggctggagcggagtgtctcagaggctgcgctccttccagggcccaaggactcacagcttcctccgctgccttcccggaccaacaaccccccaaaagttgtgatgcttttctttacccagtgctttggggctgtattagatctcattcatctccggtttcagcactacaaggctaaacgggttttctccgctgccgggcaacttgtctgtgtcgtcaaccccacacacaacctaaagtatgtgtccagtcggcgcgccgtcactcagagcgctccagagcaaggcagcttccaccctcaccatctctcccaccaccactgccaccaccgccaccaccaccacctccgccaccacgcccacccccaccaccttcaccaccaggaggcggggctgcacgccaacccggtgacgccctgcctgtgcatgtgtcccttgttctcctgccagtgggaaggccgcctggaggtggtggtgccccacctgcggcagatccatagggttgacatcctccagggagccgagatcgtcttcctggccacggacatgcacctccccgcgccggctgattggatcatcatgcactcctgccttggccaccactttctgttggtgctgaggaaacaggagaggcatgaagggcacccccagttctttgccaccatgatgctgattgggacccccacccaggccgactgcttcacctatcgcctggagctcaacagaaaccatcggcgcctcaagtgggaggccacgccccggtctgttcttgagtgcgtggactcggtgattacggacggggactgcctcgtcctcaacacctcgctggcacagctcttctctgacaacggcagccttgccattgggattgccatcaccgcgacagaggtcctcccctcagaagctgaaatgtgaggccaggagccacggatgctccccacacagcctccctaggaaacgcctgggacctcccaataccaggactccagactcctttttattcttctcctttcttttttttttttttaatttttaattattattatttttttgtctcaggtactttgtgagatttagtttttgtctgccatgggcattatattatgtaaacatcctgtaatttaagatcttggtgtgatgtttgtcctgccttgttggtgttgttttatagaatgtttgtaagatttattcagaatagttttttcctgtcacctccaagtcctttctccgctagttttgaaaggatcaaaacaccatcaagcagactgttggggttgaaaggaggcttcgtgtgagaatcatttcttgtttctcttttcagtctatttcagagcaagctaaatctgaacgtgtgcagtcggcaggttggggaaggggcccagctcagagatggatcacatttcagaccatccagacatgactctgacagcttcccaggaacctcaaggtcaaagctgagctagccgggcatgaggagatcgtgtctccaccgcagggctggggactgggctagaggtgtcattgtgtgctgagtgctcaggttgatgctggggctcaggagagtagtcagaggcccaccttcctgtgacgggctcttgtcaccttgttcccaggctgtgccgtcttctcctgctctggaatcaaagtcctcagatttttgatgctttcttaaaaacccctttgccttctgttgagcaagtagtagaaaagaataggcaagatggggggtggggatgaaaagcaacaggaaaaagagaacataaaattaatctcccatctctgagagggcactccctcctcagagagttttattatcaagttataaaatccatcagttcctccctagggtgcagttctttcatatcatgcaaaaagcagaaccaggactcatcatcaaatgcaaagaactcagagggtggcacccaggatctctgacctggcgggctggtcatcacttacaaacctgggaggctctcttccctttcctcactttctaaaatgctcctaccgtcccattcagcacgcagacgtgaccacggctcaagtatgtattcagcacctgttgcagtatgaatgacacagtgacggaaatccatatttcctctgcgcaggctgctttctcttatttggttgtcagaacaattcatcaacatcttcttgtagaagtctctcgtgtatttgaagaaagtcagcatgtttagtcaactttgtcttttctgttctaagttggacacctataagccttcccagtaggacctcttctagctcctttttatcgcatttgtcccccccctctggctgctctccagacactgcagaagtcaggcaccccatccccagcacattcccatgacagccaaatgggcctttggccaaccagacattactctccgtgccctgttcctgcacctcaccccctcggcttggtcctggcaggcatccaagtgactacttagtctcaggcaggttgccctggctggccatctgcaattttttctccaccaaaaataactgatcctgaaacacaacacccttcccccaacaactgggttaattctccagccacttttggtgccaacttacacccccacgcaccagaagggaggtgccagtcgatacaagatttaataacagaggctgctctggtcacacagtaatcgctgggcccctggggctgagactgcattccgtcagagccctgagaggggcaaaaaacattgccacagatggaggcacatgtcagatgctgcagtcgcaaaaaaggattggggcctgcgcattctttgagctctcagatgccctgccagggcaccagccaccctcctccaatcacacagatgcccaagaacacctgaggctggtccgtctgtgcgtggaaagactggctgtcttcctcctcactgcatccccaatccccttcccagaacctaagacccccttggctgtaagtcttatgcctttagaagccacaggtcctctcctggtttttgagactcaaccactttgaaagcatttgtgtagcatcacaggtgctccagatcaacaaacaaaaacctcactaagaatataactaacattcacagggccttagggctcctgcagacatcacctttgccttctggttgtgccaagttacctgagccacactgggaatgacttcaggttattttcactgcacacaagactgtattatgaataagtgatcccagatgggagcttatatttttgttcctagaaagctttaggacaaagcatgggaaatgtattattatcttccatctatggtgctccccaaaaggcctctccatatccatatgtgaagaactggagaagaaggagcaaactaacaaccaagaattgggaataggaaatggtaccagcagtttgtatttgagcttcacagttcctgaagggctctttgatttgagtctcaggttaatcctcattagtatcctcaatatactaacagaatagaggttctaagacatgaagtgatcttttcaaggtcacacatcaggtggttagaccacaaccaaaacccagatcaactgactgcaaacttggtgttcttgaagtaagactgatccgaaatattcagcagtcttgccagcttaccagtggactgaggacctgagaatcaactgagtctttgtcctgggatagttgagggagcagggagagaaagactggagtagatttgcttttagaagcatctctgctttaagaactaggccagggatggtggctcacgtccataatcccaggactttgggaggccaaggaaggaggattgcttgagctcaggagtttgagaccagcctgggcaatatagcgagacttcatttctacaaaaaaaaaaatcagctgggcatggtgacacaagcctatagtcttaactactcggaggccaagacagggggatggcttgagcccaggaggttgaggtcacagtgagctgtgattgcaccacttgtaactccagcctgggcaacagagtgagaccctatctctttagaaaaaaaaaaaaagcactagtccacctggaagcagggggcccaggaagtgggtgggctgcagatggaggcttcagtgcgccaggccctttctgaatccctttgcccacacccaggtttctcaccttagagtcccaggagtccctgcacagaacgctgggatctggttgcctcattcacaccaaggtgcaagagttaatgactcactctctaaggagtaattgccttttaaaagaaggcctagagagacagcgcacttaacagtgaaaaatgagttaccagtatctgaacttcaggcatctgccagaggtttttttcaggaggtgtggagagaggagcattcctccccttgaggctgagcctacatacatggttgacgccgaaatggaggtcaggccacacgaagattgtctttaacaattggtatctgcatgaatctgtacctggtaaaccccatcactagctgtggctactctggacattttaggaatagatcagcatagtaaccataatagtactcatggctaccacttattgaggcttttctatatgatccagtaggctgcgtactttgaatatagtagatcatgtaatccccataacaaccttagcaagcaggtgctctttattgtattcatgttacgggtgggaaacgtaagctaagagaatttagccaacttgcttaagatcacccagctagcaaatggcagagctgggcctgggaccgggtacgtatggcttctgaccaacagcaaccatgtcatttctatgaacatatggacccaaggctcagaaggaccgagtcataaagtgtgaatggcatagaggccttttagtgctttcatactcaatatggccttttagctcccctttttctccctcttttttcaacccaagacctagtggagtactagagctgcttgtattctggttgttaatctttcaggaattttgcaagctgattgttaattaagtacagtcagtattaaaaatgatatacatttacaattaaataaattatatttaaagcaaaggtcaaaagtacttaaaactcatcacttcctaattatttcactactctttttattctctatgctcctggggttatttacatctatcacatctgtatgatgaacatactatataataatgtgctgcaccgcatcttccagctccacatttagtgacgtcatggtgattgcttgaaattagccatggtggaagtattcataccatggaaattagcaaatgctactagacagggatttttctccctagaaagccagttgttaagcacttaacagtataatcatccctcagtatccttgggggattggttccaggaatctcgtggacactaaaatctgaagatgctcaagtcccttatataaaacggcatagtatttgtatataacctacgcaatcctcccatatactttaaataatctctagagtacttataatacctaatacaatgtaaatgctatgtcaatagtttttatactgcattatttcttattgttgtattatttcttttttttttcctgaatattcttgattcacagttggtggaatccacaggtgtggaacatgtggatacagagggttgacttaataccactgcctagacattgctgatgagcacagcagggtgggagaggggactttggaaggagaagcaaggccctggaaggccgtactgacaagggcataaatgacagccaagccagcggaacagcaaattgttggggaaacacgaactcttctggagaagagactctgaggcttaagcagcttcaagagcattttctgccacagagcaccctctgctttctccccggacacttccctattgctgttagtgtggaaagttctatttggtggctttcatggaaaaattgggctccgcaaactcagcctattggctatcccaatccaaaaagcaaaaccagctctataaagctcaaatttcctgttacttgttcttacaggtcaccctccctacctctttcttacatgctggccaaaacctaaagaaatgttttactttgaaattagaaattggaaatatctaccattcaagagacacagcaagcagtggtgtcaaacaccacataagatgcattatcacaaaagtgggacccccgtaaagcatgaagctgagggacagaaaacataatgagccaaggaatgtcacatgaagaacagggccccgggccttactttcctacttggctacctcacttttttgcaacccagtaaggaccctgttcacaatccatagcctacccagaccaatactctttctaaatctggggcacagtttccactaggacaagagtcactggaaacttccagctaagtccattgaagcaggcagaatcttcaaggtcaatagtgcatcagttactctgatcccagtggtttcagtggaagggatggaagaagtgagggttgctgaagtttctacttggatgcatttctaagggaaaggggaagggatcatgggtgggaccccaaagagttaggctttgattgaggttcagctgcaaatagcatcatgagtggcgtctcctagtcagattgttaaatttcagatttttttgttcataagattttcttcaggaattggtgagttccccattgtgttcacctggaaaatagccagctgaagaaaaacttcactgaaaagaaatctgagagatctagtgtagataaacattaatttccccccaaatcaggtcatcacatgaactacctgggttagaatttgtcttttccaatattttctgaaagtatttcaccttggctactatactataaatactcctcaacctttttcagtcttttttttagggtattgagataagaaagagaaaggaaattgagaagcattttacttgccctgaattaatgtatatataattttctatgctttcttataatgttaaagacaataacttggacaaactcaaactgctacttcatctctgccctctcatagaaaatgtcattaaattgcatttgatattgtttccttcg

SEQ ID NO: 181317 - DNA, 5583 bp, Homo sapiens
  Payload ID: 15715
  Gene Symbol: SIAE
  Gene Name: sialic acid acetylesterase
  Uniprot ID: Q9HAT2
  ENST ID: ENST00000263593
  CDS Start-End: 174-1745
aaaaaaaaaaaaaaactacggcggccgagaaggggcgagtacagcccagtcctgaggtcgcgggaggctgcgaggactgcaaaagggtggagtcggcctcgcccccgcccaggccccgcccctgccgggaacccactttcccagtcctaggcggcggtcagatccttgcaagcatggtcgcgccggggcttgtactcgggctggtgctgccattaatcctgtgggccgacagaagtgcaggtattggttttcgctttgcttcatacatcaataatgatatggtgctgcagaaggagcctgctggggcagtgatatggggcttcggtacacctggagccacagtgaccgtgaccctgcgccaaggtcaggaaaccatcatgaagaaagtgaccagtgtgaaagctcactctgatacgtggatggtggtactggatcctatgaagcctggaggacctttcgaagtgatggcacaacagactttggagaaaataaacttcaccctgagagttcatgacgtcctgtttggagatgtctggctctgtagtgggcagagtaacatgcagatgactgtgttacagatatttaatgctacaagggagttgtctaacactgcggcatatcagtctgtccgcatcctctctgtctctcccattcaagcagagcaggagctggaggaccttgttgcggttgacttgcagtggtctaagcccacctcagaaaacttaggccatggatatttcaagtacatgtcagcagtgtgctggctctttggacgtcacctttatgacactctgcagtatcccatcgggctgatcgcctccagctggggcgggacacccattgaagcctggtcatctggacggtcactgaaagcctgtggggtccctaaacaagggtccattccatacgattctgtaactggtcccagtaagcactctgttctctggaatgccatgatccatccactgtgcaatatgactctgaaaggggtagtatggtaccagggggagtccaatataaattataacacggatctgtacaattgcacattccctgcactcatcgaagactggcgtgaaaccttccaccgtggttcccaggggcagacggagcgtttcttcccatttggacttgtccagttatcttcagatttgtctaagaagagctcagacgatggatttccccagatccgttggcatcaaacagcagacttcggctatgtccccaacccaaagatgcccaatactttcatggctgtagctatggatctctgtgatagagactcgccttttggcagcatccaccctcgagataaacagactgtggcttatcggctgcatttgggggcccgtgctctggcttatggtgagaagaatttgacctttgaaggaccactgcctgagaagatagaactcttggctcacaaggggctgctcaatctcacatattaccagcaaatccaggtgcagaaaaaggacaacaagatatttgagatctcctgttgcagtgaccatcgatgcaagtggcttccagcttctatgaacaccgtctccacccagtccctgaccctggcgatcgattcttgtcatggcactgtggttgctctccgctatgcttggaccacgtggccttgtgaatataagcagtgtcccctataccaccccagtagtgccctgccagcccctcccttcattgctttcattacagaccagggtcctggacatcagagcaatgttgctaaatgactgtttcagtatgatcagaacttagatataaggatgggtccttcagattttagcatttaggagtttcaataataaccattgcttttaaaggaaattaatagaaagcctcattgaatggctttcagctagcacatggctgtttctatattctgatgagcccaggcttataggtaacttgaaatgcttgctttttgttccctagttggtctaagggtctgtattggactaattctgaactacagacaaattggacctcaatgtcatttacttccctcatattaatgggagtgaaatgtctaatacttttgcccctttttatccagagttgtgggaatctcaggattggaagagattttaaaggccacataggccagctagtgttcatgtgttctttataaaatttctcccatccaagtactaaccaggcccgaccctgcttagcttccgagatcagatgagatcaggcgcgttcagggtgatatggccgtagacgtctttacaaaattcctgacaggtggttactgaatctctctatgaactttccattcaaaactttccaagtttttccttatgtggaaccgaaatctttctttctcccgtgaaactttactactatcagataattgaagacagatctctttgtattctcttcaagcccaaaccaattctgttccttcaatctaaatagtggtaatatgaatgtttaagaaatgaaataagaaacatgtgcaggcactttggaaggtgctaagtgactgccctaaggaatgaaaagcaagggccaggtgggagtagcccagcgaaggcacttgggctgccaggaacaggaggcgtgggaaactctggcttaggaaaacatgaacacaggggcaacagaggcaaactgttgttcgagttaaatataaatctcaggctctttaaaggtaaaaggtttaaggataatccatttggaagaagaaaagagtgaggctgaaagtaaagccacatgacaagcatataaaaaaaaatgcagatgatacaaatatgaaagaggccttcagtgtttgtttattaagaatcttaatgcagtttactgatggattaaaaacagctaacattgtctgaaaattatgttacctataagaagttggaaataaataaaagcataatcactagtgatgtgtatgtatttatatccacttgcaaactgtccttgaagcatgtgaaaaggagtaagaatactatctatgggtagctttcctccccttaatgtgaaaaatgagaactaaagcaaaaagcatcactcactgtacatatacaatgtattttacgtagtgtaaaaaatatggtttagatagtgaatatattaatgaaatcatatgtaaatttatttttagtggctgaataatttaaaacattatgtggaattcactatgtttcccccaatttaggaactttttactgtgtgaaaatgaaatttataatactctgtagggtgaatgatggtttttgctttagttctacccctctgtagagttccaaggggttctggtgtagctccaaacagcaggaataactttgtcagtgccaagattttatttagttaaaaaacaaaaaatctacacactttacaaggaacgttggctcccctgaggacttcctagcattcaactcgttcagttaacccctattgcccatgctttgacctctcatgcatctggccccatagaaaccatgaaccttgtaacagattgatgcctgagaaaaagtcaatctacccgtccactcctccactcccaatacacatacccccatgggctgttctaattcgggggcagccagaggtagccaagaactctaagtccagattcctttcacctccaggaacctagagtacatagtgtgaaaaatacggttcaggcaatgattatgttaatgacgccatgcacattcatttttagtggctgagtaatttaaaacatgatgtgggaattcactgcatttccccaaatgtaagaactttttagttttaaaatgaaatttatagtcactgtagaaaatttggacactaaagtataagcaagtaaaaatcacccccaaattcatcattcagagaaacactattttgctgaaccattcacttgacttgagttatataattttatacagtacatattattttgtaatctgtgtttttgacttacttactttaccaaaataattttcttatgtaaataatagaatatagatttagagtgtttcagtttgtggaagcctcattttatttaaccaatttcctattaatggacatatagatttttaacaattttctactattaaaataatactgtaatgaatatcacatgcaaacatcataccacactcgtccagttatttcttagggttcttaacatggaagaggataaatatatatttaaaatttagatatctacagcttaaccctcccaaaggattaaacaacttacattctcaccaaggtagtcctttttttgccctcaccctcattgacactggatgttgtcaaatttaaaaaaaatccttaacaatctgatagatgaaaagatagtttaagtatactaaggcagtgtttttcaaggtgtttttgtttttgtttttgagttggagttttgctctgttgcccaggctggagtgcagtggcgcggtctcggctcactgcaacctctgcctcccgggttcaagcgattcttcctgcctcagcctcccgagtagctgggactacaggcgcgtgccaccacgcctggctaattttttgtatttttattagagaccgacttagccaggatggtctcgatctcctgacctcttgatccacccgcctcagcctcccaaagtgctgggattacaggcgtgagccaccgtgcccagcttttcaagtttcttaaatccatgatccatagtaaaaacattttacacatatcttcatacaagtatatgtatatgtggtatacgtacacactatagttgtatatgcattatagctgaaaaaccagttcaacctttctacatgtggtatgttccaaaaattttaaatgtctttctaaaatgaggctcttttaatacgggtattactcaggctgtaatagtgggaaaatatttgttatatgataaaagcagcatatatcatttctgtgtaaatgccagtatgctcaagccatttatgcagagaaaaaaagaaaaacactgcattaacattttaagcagtccccttcccgatttgctattatacaaagtttgtttcttttacattgtaaagtgtatacaacttataaaaagactatactcaaaatcataaaataccagttaacttagcttctcagtttacagtggccagtgtggtgtgctctaaacactgctgcctgatccctccctctgctggtcagatttattactataaagtaccaatcccatttgtgttgtcctcaattggcaattatgaatggcagtgcattaaccattcaattctcaccactccatccccattcttctacttctgggtccttttgtccctccctttccagacagcccttggtaacctgctgctgggtaactaaggcatcccacaggtagtgttgaggtgttaggtgatagagtaaacctctaccttaatgctattaacagggtccaaaaatccagttgcatggaacatggagttatattattacatggctaatgaaaagacaggactaagtctgttatagagtatgggactaacccccaattatatgtgaatttgtgttatcatatggtttcagtgtactgagctaaaaagcacattatctgaggtgcaatacaaaggttaaagaggttaaagatcccc

SEQ ID NO: 181318 - DNA, 2921 bp, Homo sapiens
  Payload ID: 15715
  Gene Symbol: SIAE
  Gene Name: sialic acid acetylesterase
  Uniprot ID: Q9HAT2
  ENST ID: ENST00000545756
  CDS Start-End: 293-1759
agttaccttccacgctgtatgtccgtgagaaatacaatgaagacggtctgaataatgaactggtaatcttcgataatatgaaacgaatttaagagaacatatcaaagagaaggctctcaaaataggctgctgcaaaagctggtatattgtccggttgctctctcagaatctcgcgtgtcagcccttcaagaagattcccaaatccttgtggaattcggtagtgggtgttggagaatggaatcgacatcttcttggtattggttttcgctttgcttcatacatcaataatgatatggtgctgcagaaggagcctgctggggcagtgatatggggcttcggtacacctggagccacagtgaccgtgaccctgcgccaaggtcaggaaaccatcatgaagaaagtgaccagtgtgaaagctcactctgatacgtggatggtggtactggatcctatgaagcctggaggacctttcgaagtgatggcacaacagactttggagaaaataaacttcaccctgagagttcatgacgtcctgtttggagatgtctggctctgtagtgggcagagtaacatgcagatgactgtgttacagatatttaatgctacaagggagttgtctaacactgcggcatatcagtctgtccgcatcctctctgtctctcccattcaagcagagcaggagctggaggaccttgttgcggttgacttgcagtggtctaagcccacctcagaaaacttaggccatggatatttcaagtacatgtcagcagtgtgctggctctttggacgtcacctttatgacactctgcagtatcccatcgggctgatcgcctccagctggggcgggacacccattgaagcctggtcatctggacggtcactgaaagcctgtggggtccctaaacaagggtccattccatacgattctgtaactggtcccagtaagcactctgttctctggaatgccatgatccatccactgtgcaatatgactctgaaaggggtagtatggtaccagggggagtccaatataaattataacacggatctgtacaattgcacattccctgcactcatcgaagactggcgtgaaaccttccaccgtggttcccaggggcagacggagcgtttcttcccatttggacttgtccagttatcttcagatttgtctaagaagagctcagacgatggatttccccagatccgttggcatcaaacagcagacttcggctatgtccccaacccaaagatgcccaatactttcatggctgtagctatggatctctgtgatagagactcgccttttggcagcatccaccctcgagataaacagactgtggcttatcggctgcatttgggggcccgtgctctggcttatggtgagaagaatttgacctttgaaggaccactgcctgagaagatagaactcttggctcacaaggggctgctcaatctcacatattaccagcaaatccaggtgcagaaaaaggacaacaagatatttgagatctcctgttgcagtgaccatcgatgcaagtggcttccagcttctatgaacaccgtctccacccagtccctgaccctggcgatcgattcttgtcatggcactgtggttgctctccgctatgcttggaccacgtggccttgtgaatataagcagtgtcccctataccaccccagtagtgccctgccagcccctcccttcattgctttcattacagaccagggtcctggacatcagagcaatgttgctaaatgactgtttcagtatgatcagaacttagatataaggatgggtccttcagattttagcatttaggagtttcaataataaccattgcttttaaaggaaattaatagaaagcctcattgaatggctttcagctagcacatggctgtttctatattctgatgagcccaggcttataggtaacttgaaatgcttgctttttgttccctagttggtctaagggtctgtattggactaattctgaactacagacaaattggacctcaatgtcatttacttccctcatattaatgggagtgaaatgtctaatacttttgcccctttttatccagagttgtgggaatctcaggattggaagagattttaaaggccacataggccagctagtgttcatgtgttctttataaaatttctcccatccaagtactaaccaggcccgaccctgcttagcttccgagatcagatgagatcaggcgcgttcagggtgatatggccgtagacgtctttacaaaattcctgacaggtggttactgaatctctctatgaactttccattcaaaactttccaagtttttccttatgtggaaccgaaatctttctttctcccgtgaaactttactactatcagataattgaagacagatctctttgtattctcttcaagcccaaaccaattctgttccttcaatctaaatagtggtaatatgaatgtttaagaaatgaaataagaaacatgtgcaggcactttggaaggtgctaagtgactgccctaaggaatgaaaagcaagggccaggtgggagtagcccagcgaaggcacttgggctgccaggaacaggaggcgtgggaaactctggcttaggaaaacatgaacacaggggcaacagaggcaaactgttgttcgagttaaatataaatctcaggctctttaaaggtaaaaggtttaaggataatccatttggaagaagaaaagagtgaggctgaaagtaaagccacatgacaagcatataaaaaaaaatgcagatgatacaaatatgaaagaggccttcagtgtttgtttattaagaatcttaatgcagtttactgatggattaaaaacagctaacattgtctgaaaattatgttacctataagaagttggaaataaataaaagcataatcactagtgatgtg

SEQ ID NO: 181319 - DNA, 1980 bp, Homo sapiens
  Payload ID: 15715
  Gene Symbol: SIAE
  Gene Name: sialic acid acetylesterase
  Uniprot ID: Q9HAT2
  ENST ID: ENST00000618733
  CDS Start-End: 410-1876
ggagtgcccaggatggagtgcagtggctattcacaggtttaatcatagctcactaccgtcttgaatccctgggctcaagtgatcctcctgcctcagcccctgagtagctggtactaaagttaccttccacgctgtatgtccgtgagaaatacaatgaagacggtctgaataatgaactggtaatcttcgataatatgaaacgaatttaagagaacatatcaaagagaaggctctcaaaataggctgctgcaaaagctggtatattgtccggttgctctctcagaatctcgcgtgtcagcccttcaagaagattcccaaatccttgtggaattcggtagtgggtgttggagaatggaatcgacatcttcttggtattggttttcgctttgcttcatacatcaataatgatatggtgctgcagaaggagcctgctggggcagtgatatggggcttcggtacacctggagccacagtgaccgtgaccctgcgccaaggtcaggaaaccatcatgaagaaagtgaccagtgtgaaagctcactctgatacgtggatggtggtactggatcctatgaagcctggaggacctttcgaagtgatggcacaacagactttggagaaaataaacttcaccctgagagttcatgacgtcctgtttggagatgtctggctctgtagtgggcagagtaacatgcagatgactgtgttacagatatttaatgctacaagggagttgtctaacactgcggcatatcagtctgtccgcatcctctctgtctctcccattcaagcagagcaggagctggaggaccttgttgcggttgacttgcagtggtctaagcccacctcagaaaacttaggccatggatatttcaagtacatgtcagcagtgtgctggctctttggacgtcacctttatgacactctgcagtatcccatcgggctgatcgcctccagctggggcgggacacccattgaagcctggtcatctggacggtcactgaaagcctgtggggtccctaaacaagggtccattccatacgattctgtaactggtcccagtaagcactctgttctctggaatgccatgatccatccactgtgcaatatgactctgaaaggggtagtatggtaccagggggagtccaatataaattataacacggatctgtacaattgcacattccctgcactcatcgaagactggcgtgaaaccttccaccgtggttcccaggggcagacggagcgtttcttcccatttggacttgtccagttatcttcagatttgtctaagaagagctcagacgatggatttccccagatccgttggcatcaaacagcagacttcggctatgtccccaacccaaagatgcccaatactttcatggctgtagctatggatctctgtgatagagactcgccttttggcagcatccaccctcgagataaacagactgtggcttatcggctgcatttgggggcccgtgctctggcttatggtgagaagaatttgacctttgaaggaccactgcctgagaagatagaactcttggctcacaaggggctgctcaatctcacatattaccagcaaatccaggtgcagaaaaaggacaacaagatatttgagatctcctgttgcagtgaccatcgatgcaagtggcttccagcttctatgaacaccgtctccacccagtccctgaccctggcgatcgattcttgtcatggcactgtggttgctctccgctatgcttggaccacgtggccttgtgaatataagcagtgtcccctataccaccccagtagtgccctgccagcccctcccttcattgctttcattacagaccagggtcctggacatcagagcaatgttgctaaatgactgtttcagtatgatcagaacttagatataaggatgggtccttcagattttagcatttaggagtttcaataataaccattgcttttaaaggaaattaatagaaa

SEQ ID NO: 181320 - DNA, 6720 bp, Homo sapiens
  Payload ID: 15716
  Gene Symbol: SIGLEC1
  Gene Name: sialic acid binding Ig-like lectin 1, sialoadhesin
  Uniprot ID: Q9BZZ2
  ENST ID: ENST00000344754
  CDS Start-End: 1-5130
atgggcttcttgcccaagcttctcctcctggcctcattcttcccagcaggccaggcctcatggggcgtctccagtccccaggacgtgcagggtgtgaaggggtcttgcctgcttatcccctgcatcttcagcttccctgccgacgtggaggtgcccgacggcatcacggccatctggtactacgactactcgggccagcggcaggtggtgagccactcggcggaccccaagctggtggaggcccgcttccgcggccgcaccgagttcatggggaaccccgagcacagggtgtgcaacctgctgctgaaggacctgcagcccgaggactctggttcctacaacttccgcttcgagatcagtgaggtcaaccgctggtcagatgtgaaaggcaccttggtcacagtaacagaggagcccagggtgcccaccattgcctccccggtggagcttctcgagggcacagaggtggacttcaactgctccactccctacgtatgcctgcaggagcaggtcagactgcagtggcaaggccaggaccctgctcgctctgtcaccttcaacagccagaagtttgagcccaccggcgtcggccacctggagaccctccacatggccatgtcctggcaggaccacggccggatcctgcgctgccagctctccgtggccaatcacagggctcagagcgagattcacctccaagtgaagtatgcccccaagggtgtgaagatcctcctcagcccctcggggaggaacatccttccaggtgagctggtcacactcacctgccaggtgaacagcagctaccctgcagtcagttccattaagtggctcaaggatggggtacgcctccaaaccaagactggtgtgctgcacctgccccaggcagcctggagcgatgctggcgtctacacctgccaagctgagaacggcgtgggctctttggtctcaccccccatcagcctccacatcttcatggctgaggtccaggtgagcccagcaggtcccatcctggagaaccagacagtgacactagtctgcaacacacccaatgaggcacccagtgatctccgctacagctggtacaagaaccatgtcctgctggaggatgcccactcccataccctccggctgcacttggccactagggctgatactggcttctacttctgtgaggtgcagaacgtccatggcagcgagcgctcgggccctgtcagcgtggtagtcaaccacccgcctctcactccagtcctgacagccttcctggagacccaggcgggacttgtgggcatccttcactgctctgtggtcagtgagcccctggccacactggtgctgtcacatgggggtcatatcctggcctccacctccggggacagtgatcacagcccacgcttcagtggtacctctggtcccaactccctgcgcctggagatccgagacctggaggaaactgacagtggggagtacaagtgctcagccaccaactcccttggaaatgcaacctccaccctggacttccatgccaatgccgcccgtctcctcatcagcccggcagccgaggtggtggaaggacaggcagtgacactgagctgcagaagcggcctaagccccacacctgatgcccgcttctcctggtacctgaatggagccctgcttcacgagggtcccggcagcagcctcctgctccccgcggcctccagcactgacgccggctcataccactgccgggcccgggacggccacagtgccagtggcccctcttcgccagctgttctcactgtgctctacccccctcgacaaccaacattcaccaccaggctggaccttgatgccgctggggccggggctggacggcgaggcctccttttgtgccgtgtggacagcgacccccccgccaggctgcagctgctccacaaggaccgtgttgtggccacttccctgccatcagggggtggctgcagcacctgtgggggctgttccccacgcatgaaggtcaccaaagcccccaacttgctgcgtgtggagattcacaaccctttgctggaagaggagggcttgtacctctgtgaggccagcaatgccctgggcaacgcctccacctcagccaccttcaatggccaggccactgtcctggccattgcaccatcacacacacttcaggagggcacagaagccaacttgacttgcaacgtgagccgggaagctgctggcagccctgctaacttctcctggttccgaaatggggtgctgtgggcccagggtcccctggagaccgtgacactgctgcccgtggccagaactgatgctgccctttacgcctgccgcatcctgactgaggctggtgcccagctctccactcccgtgctcctgagtgtactctatcccccggaccgtccaaagctgtcagccctcctagacatgggccagggccacatggctctgttcatctgcactgtggacagccgccccctggccttgctggccttgttccatggggagcacctcctggccaccagcctgggtccccaggtcccatcccatggtcggttccaggctaaagctgaggccaactccctgaagttagaggtccgagaactgggccttggggactctggcagctaccgctgtgaggccacaaatgttcttggatcatccaacacctcactcttcttccaggtccgaggagcctgggtccaggtgtcaccatcacctgagctccaagagggccaggctgtggtcctgagctgccaggtacacacaggagtcccagaggggacctcatatcgttggtatcgggatggccagcccctccaggagtcgacctcggccacgctccgctttgcagccataactttgacacaagctggggcctatcattgccaagcccaggccccaggctcagccaccacgagcctagctgcacccatcagcctccacgtgtcctatgccccacgccacgtcacactcactaccctgatggacacaggccctggacgactgggcctcctcctgtgccgtgtggacagtgaccctccggcccagctgcggctgctccacggggatcgccttgtggcctccaccctacaaggtgtggggggacccgaaggcagctctcccaggctgcatgtggctgtggcccccaacacactgcgtctggagatccacggggctatgctggaggatgagggtgtctatatctgtgaggcctccaacaccctgggccaggcctcggcctcagctgacttcgacgctcaagctgtgaatgtgcaggtgtggcccggggctaccgtgcgggaggggcagctggtgaacctgacctgccttgtgtggaccactcacccggcccagctcacctacacatggtaccaggatgggcagcagcgcctggatgcccactccatccccctgcccaacgtcacagtcagggatgccacctcctaccgctgcggtgtgggcccccctggtcgggcaccccgcctctccagacctatcaccttggacgtcctctacgcgccccgcaacctgcgcctgacctacctcctggagagccatggcgggcagctggccctggtactgtgcactgtggacagccgcccgcccgcccagctggccctcagccacgccggtcgcctcttggcctcctcgacagcagcctctgtccccaacaccctgcgcctggagctgcgagggccacagcccagggatgagggtttctacagctgctctgcccgcagccctctgggccaggccaacacgtccctggagctgcggctggagggtgtgcgggtgatcctggctccggaggctgccgtgcctgaaggtgcccccatcacagtgacctgtgcggaccctgctgcccacgcacccacactctatacttggtaccacaacggtcgttggctgcaggagggtccagctgcctcactctcattcctggtggccacgcgggctcatgcaggcgcctactcttgccaggcccaggatgcccagggcacccgcagctcccgtcctgctgccctgcaagtcctctatgcccctcaggacgctgtcctgtcctccttccgggactccagggccagatccatggctgtgatacagtgcactgtggacagtgagccacctgctgagctggccctatctcatgatggcaaggtgctggccacgagcagcggggtccacagcttggcatcagggacaggccatgtccaggtggcccgaaacgccctacggctgcaggtgcaagatgtgcctgcaggtgatgacacctatgtttgcacagcccaaaacttgctgggctcaatcagcaccatcgggcggttgcaggtagaaggtgcacgcgtggtggcagagcctggcctggacgtgcctgagggcgctgccctgaacctcagctgccgcctcctgggtggccctgggcctgtgggcaactccacctttgcatggttctggaatgaccggcggctgcacgcggagcctgtgcccactctcgccttcacccacgtggctcgtgctcaagctgggatgtaccactgcctggctgagctccccactggggctgctgcctctgctccagtcatgctccgtgtgctctaccctcccaagacgcccaccatgatggtcttcgtggagcctgagggtggcctccggggcatcctggattgccgagtggacagcgagccgctcgccagcctgactctccaccttggcagtcgactggtggcctccagtcagccccagggtgctcctgcagagccacacatccatgtcctggcttcccccaatgccctgagggtggacatcgaggcgctgaggcccagcgaccaaggggaatacatctgttctgcctcaaatgtcctgggctctgcctctacctccacctactttggggtcagagccctgcaccgcctgcatcagttccagcagctgctctgggtcctgggactgctggtgggcctcctgctcctgctgttgggcctgggggcctgctacacctggagaaggaggcgtgtttgtaagcagagcatgggcgagaattcggtggagatggcttttcagaaagagaccacgcagctcattgatcctgatgcagccacatgtgagacctcaacctgtgccccacccctgggctgaccagtggtgttgcctgccctccggaggagaaagtggccagaatctgtgatgactccagcctatgaatgtgaatgaggcagtgttgagtcctgcccgcctctacgaaaacagctctgtgacatctgactttttatgacctggccccaagcctcttgcccccccaaaaatgggtggtgagaggtctgcccaggagggtgttgaccctggaggacactgaagagcactgagctgatctcgctctctcttctctggatctcctcccttctctccatttctccctcaaaggaagccctgccctttcacatccttctcctcgaaagtcaccctggactttggttggattgcagcatcctgcatcctcagaggctcaccaaggcattctgtattcaacagagtatcagtcagcctgctctaacaagagaccaaatacagtgacttcaacatgatagaattttatttttctctcccacgctagtctggctgttacgatggtttatgatgttggggctcaggatccttctatcttccttttctctatccctaaaatgatgcctttgattgtgaggctcaccatggccccgctttgtccacatgccctccagccagaagaaggaagagtggaggtagaagcacacccatgcccatggtggacgcaactcagaagctgcacaggacttttccactcacttcccattggctggagtattgtcacatggctactgcaagctacaagggagactgggaaatgtagtttttattttgagtccagaggacatttggaattggacttccaaaggactcccaactgtgagctcatccctgagacttttgacattgttgggaatgccaccagcaggccatgttttgtctcagtgcccatctactgagggccagggtgtgcccctggccattctggttgtgggcttcctggaagaggtgatcactctcacactaagactgaggaaataaaaaaggtttggtgttttcctagggagagagcatgccaggcagtggagttgcctaagcagacatccttgtgccagatttggcccctgaaagaagagatgccctcattcccaccaccaccccccctacccccagggactgggtactaccttactggcccttacaagagtggagggcagacacagatgttgtcagcatccttattcctgctccagatgcatctctgttcatgactgtgtgagctcctgtccttttcctggagaccctgtgtcgggctgttaaagagaatgagttaccaagaaggaatgacgtgcccctgcgaatcagggaccaacaggagagagctcttgagtgggctagtgactccccctgcagcctggtggagatggtgtgaggagcgaagagccctctgctctaggatttgggttgaaaaacagagagagaagtggggagttgccacaggagctaacacgctgggaggcagttgggggcgggtgaactttgtgtagccgaggccgcaccctccctcattccaggctcattcattttcatgctccattgccagactcttgctgggagcccgtccagaatgtcctcccaataaaactccatcctatgacgcaa

SEQ ID NO: 181321 - DNA, 4326 bp, Homo sapiens
  Payload ID: 15716
  Gene Symbol: SIGLEC1
  Gene Name: sialic acid binding Ig-like lectin 1, sialoadhesin
  ENST ID: ENST00000419548
  CDS Start-End: 1-1390
gctggccctggtactgtgcactgtggacagccgcccgcccgcccagctggccctcagccacgccggtcgcctcttggcctcctcgacagcagcctctgtccccaacaccctgcgcctggagctgcgagggccacagcccagggatgagggtttctacagctgctctgcccgcagccctctgggccaggccaacacgtccctggagctgcggctggagggtgtgcgggtgatcctggctccggaggctgccgtgcctgaaggtgcccccatcacagtgacctgtgcggaccctgctgcccacgcacccacactctatacttggtaccacaacggtcgttggctgcaggagggtccagctgcctcactctcattcctggtggccacgcgggctcatgcaggcgcctactcttgccaggcccaggatgcccagggcacccgcagctcccgtcctgctgccctgcaagtcctctatgcccctcaggacgctgtcctgtcctccttccgggactccagggccagatccatggctgtgatacagtgcactgtggacagtgagccacctgctgagctggccctatctcatgatggcaaggtgctggccacgagcagcggggtccacagcttggcatcagggacaggccatgtccaggtggcccgaaacgccctacggctgcaggtgcaagatgtgcctgcaggtgatgacacctatgtttgcacagcccaaaacttgctgggctcaatcagcaccatcgggcggttgcaggtagaaggtgcacgcgtggtggcagagcctggcctggacgtgcctgagggcgctgccctgaacctcagctgccgcctcctgggtggccctgggcctgtgggcaactccacctttgcatggttctggaatgaccggcggctgcacgcggagcctgtgcccactctcgccttcacccacgtggctcgtgctcaagctgggatgtaccactgcctggctgagctccccactggggctgctgcctctgctccagtcatgctccgtgtgctctaccctcccaagacgcccaccatgatggtcttcgtggagcctgagggtggcctccggggcatcctggattgccgagtggacagcgagccgctcgccagcctgactctccaccttggcagtcgactggtggcctccagtcagccccagggtgctcctgcagagccacacatccatgtcctggcttcccccaatgccctgagggtggacatcgaggcgctgaggcccagcgaccaaggggaatacatctgttctgcctcaaatgtcctgggctctgcctctacctccacctactttggggtcagaggtgaggggagggggctccatctcccaggccactctgcacaaaagcccagctcttaggcccaaaggcttccttccctgtatccctcctgctgcagcatgatttgcctgtcgactctaaactgattgctcggggcacccttgtgtggagagcttcagcgataaagcaaaagttagaaggtgtcatcttgggtgggtccccttggaaggaagcactgggggcctgcagctgtggctgctctgagtcccgctctgtgttccagccctgcaccgcctgcatcagttccagcagctgctctgggtcctgggactgctggtgggcctcctgctcctgctgttgggcctgggggcctgctacacctggaggtgggtctggagctgggagtgggccagaagattggggtaaggcagcccacctcgtcttctccccaaattcccccaggtcctttaggacctcctattaagttcacaggctgcctacttcccagactgcccctccaaattggaaatcccttctagaattgtccctaaatcctccttgctgtagtttccttctttcctcctctctgccctggctgtgctaaagcaagggctagggaggaagacagaggaagcacccactctccatgaggttcccacgctcttgtggtctggagccagcctgtggggagcgggagaggaatgggggcaggaggtggggaggggagaggctctctgagtccactccgggccttgcagaaggaggcgtgtttgtaagcagagcatgggcgagaattcggtggagatggcttttcagaaagagaccacgcaggtatccattcaacacacacgggcagatataatacccagctaacccacagtgccaactggcatctggagactgctgtcatttagaggatggtgcctgggaccaaggggaggttggggagagtgtgcagggaaccaggagcccctcaggagataggagagccctgttctgctcggggcagagggaatccctgtgtcagctggcggctggcttagaggactaggggagactttctggacttggcagcatcccctccatttccaagacacgtatgttctgactcccccacctttgttctgaggcctcttccccactcccaagcctgcccgtcacctgggcagaagtgaaagtcagtttctcctcccctgtggtgtgtcccttctgcagctgattcacctggtaggccagggctccaagtcacacttccagccatgcacactcccaccaatcctcttgggaccccacctgaggctgggggcctgggggcctgccctggctcccagaggcctcctgtgaccagggttttctctgtgggaagctcattgatcctgatgcagccacatgtgagacctcaacctgtgccccacccctgggctgaccagtggtgttgcctgccctccggaggagaaagtggccagaatctgtgatgactccagcctatgaatgtgaatgaggcagtgttgagtcctgcccgcctctacgaaaacagctctgtgacatctgactttttatgacctggccccaagcctcttgcccccccaaaaatgggtggtgagaggtctgcccaggagggtgttgaccctggaggacactgaagagcactgagctgatctcgctctctcttctctggatctcctcccttctctccatttctccctcaaaggaagccctgccctttcacatccttctcctcgaaagtcaccctggactttggttggattgcagcatcctgcatcctcagaggctcaccaaggcattctgtattcaacagagtatcagtcagcctgctctaacaagagaccaaatacagtgacttcaacatgatagaattttatttttctctcccacgctagtctggctgttacgatggtttatgatgttggggctcaggatccttctatcttccttttctctatccctaaaatgatgcctttgattgtgaggctcaccatggccccgctttgtccacatgccctccagccagaagaaggaagagtggaggtagaagcacacccatgcccatggtggacgcaactcagaagctgcacaggacttttccactcacttcccattggctggagtattgtcacatggctactgcaagctacaagggagactgggaaatgtagtttttattttgagtccagaggacatttggaattggacttccaaaggactcccaactgtgagctcatccctgagacttttgacattgttgggaatgccaccagcaggccatgttttgtctcagtgcccatctactgagggccagggtgtgcccctggccattctggttgtgggcttcctggaagaggtgatcactctcacactaagactgaggaaataaaaaaggtttggtgttttcctagggagagagcatgccaggcagtggagttgcctaagcagacatccttgtgccagatttggcccctgaaagaagagatgccctcattcccaccaccaccccccctacccccagggactgggtactaccttactggcccttacaagagtggagggcagacacagatgttgtcagcatccttattcctgctccagatgcatctctgttcatgactgtgtgagctcctgtccttttcctggagaccctgtgtcgggctgttaaagagaatgagttaccaagaaggaatgacgtgcccctgcgaatcagggaccaacaggagagagctcttgagtgggctagtgactccccctgcagcctggtggagatggtgtgaggagcgaagagccctctgctctaggatttgggttgaaaaacagagagagaagtggggagttgccacaggagctaacacgctgggaggcagttgggggcgggtgaactttgtgtagccgaggccgcaccctccctcattccaggctcattcattttcatgctccattgccagactcttgctgggagcccgtccagaatgtcctcccaataaaactccatcctatgacgcaa

SEQ ID NO: 181322 - DNA, 3109 bp, Homo sapiens
  Payload ID: 15717
  Gene Symbol: SIGLEC10
  Gene Name: sialic acid binding Ig-like lectin 10
  Uniprot ID: Q96LC7
  ENST ID: ENST00000353836
  CDS Start-End: 223-2031
gcccccaggagacccagaggacaactgggcaaggtgggccggagagtgtgggggaaggcaaaggagttctgtgagctcagcgtctgaagctcatttcatgcatcaggccccagggctcagcttccgccttcggcttccccttctgccaagagccctgagccactcacagcacgaccagagaacaggcctgtctcaggcaggccctgcgcctcctatgcggagatgctactgccactgctgctgtcctcgctgctgggcgggtcccaggctatggatgggagattctggatacgagtgcaggagtcagtgatggtgccggagggcctgtgcatctctgtgccctgctctttctcctacccccgacaggactggacagggtctaccccagcttatggctactggttcaaagcagtgactgagacaaccaagggtgctcctgtggccacaaaccaccagagtcgagaggtggaaatgagcacccggggccgattccagctcactggggatcccgccaaggggaactgctccttggtgatcagagacgcgcagatgcaggatgagtcacagtacttctttcgggtggagagaggaagctatgtgagatataatttcatgaacgatgggttctttctaaaagtaacagccctgactcagaagcctgatgtctacatccccgagaccctggagcccgggcagccggtgacggtcatctgtgtgtttaactgggcctttgaggaatgtccacccccttctttctcctggacgggggctgccctctcctcccaaggaaccaaaccaacgacctcccacttctcagtgctcagcttcacgcccagaccccaggaccacaacaccgacctcacctgccatgtggacttctccagaaagggtgtgagcgcacagaggaccgtccgactccgtgtggcctatgcccccagagaccttgttatcagcatttcacgtgacaacacgccagccctggagccccagccccagggaaatgtcccatacctggaagcccaaaaaggccagttcctgcggctcctctgtgctgctgacagccagccccctgccacactgagctgggtcctgcagaacagagtcctctcctcgtcccatccctggggccctagacccctggggctggagctgcccggggtgaaggctggggattcagggcgctacacctgccgagcggagaacaggcttggctcccagcagcgagccctggacctctctgtgcagtatcctccagagaacctgagagtgatggtttcccaagcaaacaggacagtcctggaaaaccttgggaacggcacgtctctcccagtactggagggccaaagcctgtgcctggtctgtgtcacacacagcagccccccagccaggctgagctggacccagaggggacaggttctgagcccctcccagccctcagaccccggggtcctggagctgcctcgggttcaagtggagcacgaaggagagttcacctgccacgctcggcacccactgggctcccagcacgtctctctcagcctctccgtgcactataagaagggactcatctcaacggcattctccaacggagcgtttctgggaatcggcatcacggctcttcttttcctctgcctggccctgatcatcatgaagattctaccgaagagacggactcagacagaaaccccgaggcccaggttctcccggcacagcacgatcctggattacatcaatgtggtcccgacggctggccccctggctcagaagcggaatcagaaagccacaccaaacagtcctcggacccctcttccaccaggtgctccctccccagaatcaaagaagaaccagaaaaagcagtatcagttgcccagtttcccagaacccaaatcatccactcaagccccagaatcccaggagagccaagaggagctccattatgccacgctcaacttcccaggcgtcagacccaggcctgaggcccggatgcccaagggcacccaggcggattatgcagaagtcaagttccaatgagggtctcttaggctttaggactgggacttcggctagggaggaaggtagagtaagaggttgaagataacagagtgcaaagtttccttctctccctctctctctctctttctctctctctctctctttctctctcttttaaaaaaacatctggccagggcacagtggctcacgcctgtaatcccagcactttgggaggttgaggtgggcagatcgcctgaggtcgggagttcgagaccagcctggccaacttggtgaaaccccgtctctactaaaaatacaaaaattagctgggcatggtggcaggcgcctgtaatcctacctacttgggaagctgaggcaggagaatcacttgaacctgggagacggaggttgcagtgagccaagatcacaccattgcacgccagcctgggcaacaaagcgagactccatctcaaaaaaaaaatcctccaaatgggttgggtgtctgtaatcccagcactttgggaggctaaggtgggtggattgcttgagcccaggagttcgagaccagcctgggcaacatggtgaaaccccatctctacaaaaaatacaaaacatagctgggcttggtggtgtgtgcctgtagtcccagctgtcagacatttaaaccagagcaactccatctggaataggagctgaataaaatgaggctgagacctactgggctgcattctcagacagtggaggcattctaagtcacaggatgagacaggaggtccgtacaagatacaggtcataaagactttgctgataaaacagattgcagtaaagaagccaaccaaatcccaccaaaaccaagttggccacgagagtgacctctggtcgtcctcactgctacactcctgacagcaccatgacagtttacaaatgccatggcaacatcaggaagttacccgatatgtcccaaaagggggaggaatgaataatccaccccttgtttagcaaataagcaagaaataaccataaaagtgggcaaccagcagctctaggcgctgctcttgtctatggagtagccattcttttgttcctttactttcttaataaacttgctttcacctta

SEQ ID NO: 181323 - DNA, 2256 bp, Homo sapiens
  Payload ID: 15717
  Gene Symbol: SIGLEC10
  Gene Name: sialic acid binding Ig-like lectin 10
  Uniprot ID: Q96LC7
  ENST ID: ENST00000339313
  CDS Start-End: 118-2211
ggccccagggctcagcttccgccttcggcttccccttctgccaagagccctgagccactcacagcacgaccagagaacaggcctgtctcaggcaggccctgcgcctcctatgcggagatgctactgccactgctgctgtcctcgctgctgggcgggtcccaggctatggatgggagattctggatacgagtgcaggagtcagtgatggtgccggagggcctgtgcatctctgtgccctgctctttctcctacccccgacaggactggacagggtctaccccagcttatggctactggttcaaagcagtgactgagacaaccaagggtgctcctgtggccacaaaccaccagagtcgagaggtggaaatgagcacccggggccgattccagctcactggggatcccgccaaggggaactgctccttggtgatcagagacgcgcagatgcaggatgagtcacagtacttctttcgggtggagagaggaagctatgtgagatataatttcatgaacgatgggttctttctaaaagtaacagccctgactcagaagcctgatgtctacatccccgagaccctggagcccgggcagccggtgacggtcatctgtgtgtttaactgggcctttgaggaatgtccacccccttctttctcctggacgggggctgccctctcctcccaaggaaccaaaccaacgacctcccacttctcagtgctcagcttcacgcccagaccccaggaccacaacaccgacctcacctgccatgtggacttctccagaaagggtgtgagcgcacagaggaccgtccgactccgtgtggcctatgcccccagagaccttgttatcagcatttcacgtgacaacacgccagccctggagccccagccccagggaaatgtcccatacctggaagcccaaaaaggccagttcctgcggctcctctgtgctgctgacagccagccccctgccacactgagctgggtcctgcagaacagagtcctctcctcgtcccatccctggggccctagacccctggggctggagctgcccggggtgaaggctggggattcagggcgctacacctgccgagcggagaacaggcttggctcccagcagcgagccctggacctctctgtgcagtatcctccagagaacctgagagtgatggtttcccaagcaaacaggacagtcctggaaaaccttgggaacggcacgtctctcccagtactggagggccaaagcctgtgcctggtctgtgtcacacacagcagccccccagccaggctgagctggacccagaggggacaggttctgagcccctcccagccctcagaccccggggtcctggagctgcctcgggttcaagtggagcacgaaggagagttcacctgccacgctcggcacccactgggctcccagcacgtctctctcagcctctccgtgcactactccccgaagctgctgggcccctcctgctcctgggaggctgagggtctgcactgcagctgctcctcccaggccagcccggccccctctctgcgctggtggcttggggaggagctgctggaggggaacagcagccaggactccttcgaggtcacccccagctcagccgggccctgggccaacagctccctgagcctccatggagggctcagctccggcctcaggctccgctgtgaggcctggaacgtccatggggcccagagtggatccatcctgcagctgccagataagaagggactcatctcaacggcattctccaacggagcgtttctgggaatcggcatcacggctcttcttttcctctgcctggccctgatcatcatgaagattctaccgaagagacggactcagacagaaaccccgaggcccaggttctcccggcacagcacgatcctggattacatcaatgtggtcccgacggctggccccctggctcagaagcggaatcagaaagccacaccaaacagtcctcggacccctcttccaccaggtgctccctccccagaatcaaagaagaaccagaaaaagcagtatcagttgcccagtttcccagaacccaaatcatccactcaagccccagaatcccaggagagccaagaggagctccattatgccacgctcaacttcccaggcgtcagacccaggcctgaggcccggatgcccaagggcacccaggcggattatgcagaagtcaagttccaatgagggtctcttaggctttaggactgggacttcggctagggaggaagg

SEQ ID NO: 181324 - DNA, 2126 bp, Homo sapiens
  Payload ID: 15717
  Gene Symbol: SIGLEC10
  Gene Name: sialic acid binding Ig-like lectin 10
  Uniprot ID: Q96LC7
  ENST ID: ENST00000439889
  CDS Start-End: 157-2076
ttctgtgagctcagcgtctgaagctcatttcatgcatcaggccccagggctcagcttccgccttcggcttccccttctgccaagagccctgagccactcacagcacgaccagagaacaggcctgtctcaggcaggccctgcgcctcctatgcggagatgctactgccactgctgctgtcctcgctgctgggcgggtcccaggctatggatgggagattctggatacgagtgcaggagtcagtgatggtgccggagggcctgtgcatctctgtgccctgctctttctcctacccccgacaggactggacagggtctaccccagcttatggctactggttcaaagcagtgactgagacaaccaagggtgctcctgtggccacaaaccaccagagtcgagaggtggaaatgagcacccggggccgattccagctcactggggatcccgccaaggggaactgctccttggtgatcagagacgcgcagatgcaggatgagtcacagtacttctttcgggtggagagaggaagctatgtgagatataatttcatgaacgatgggttctttctaaaagtaacagtgctcagcttcacgcccagaccccaggaccacaacaccgacctcacctgccatgtggacttctccagaaagggtgtgagcgcacagaggaccgtccgactccgtgtggcctatgcccccagagaccttgttatcagcatttcacgtgacaacacgccagccctggagccccagccccagggaaatgtcccatacctggaagcccaaaaaggccagttcctgcggctcctctgtgctgctgacagccagccccctgccacactgagctgggtcctgcagaacagagtcctctcctcgtcccatccctggggccctagacccctggggctggagctgcccggggtgaaggctggggattcagggcgctacacctgccgagcggagaacaggcttggctcccagcagcgagccctggacctctctgtgcagtatcctccagagaacctgagagtgatggtttcccaagcaaacaggacagtcctggaaaaccttgggaacggcacgtctctcccagtactggagggccaaagcctgtgcctggtctgtgtcacacacagcagccccccagccaggctgagctggacccagaggggacaggttctgagcccctcccagccctcagaccccggggtcctggagctgcctcgggttcaagtggagcacgaaggagagttcacctgccacgctcggcacccactgggctcccagcacgtctctctcagcctctccgtgcactactccccgaagctgctgggcccctcctgctcctgggaggctgagggtctgcactgcagctgctcctcccaggccagcccggccccctctctgcgctggtggcttggggaggagctgctggaggggaacagcagccaggactccttcgaggtcacccccagctcagccgggccctgggccaacagctccctgagcctccatggagggctcagctccggcctcaggctccgctgtgaggcctggaacgtccatggggcccagagtggatccatcctgcagctgccagataagaagggactcatctcaacggcattctccaacggagcgtttctgggaatcggcatcacggctcttcttttcctctgcctggccctgatcatcatgaagattctaccgaagagacggactcagacagaaaccccgaggcccaggttctcccggcacagcacgatcctggattacatcaatgtggtcccgacggctggccccctggctcagaagcggaatcagaaagccacaccaaacagtcctcggacccctcttccaccaggtgctccctccccagaatcaaagaagaaccagaaaaagcagtatcagttgcccagtttcccagaacccaaatcatccactcaagccccagaatcccaggagagccaagaggagctccattatgccacgctcaacttcccaggcgtcagacccaggcctgaggcccggatgcccaagggcacccaggcggattatgcagaagtcaagttccaatgagggtctcttaggctttaggactgggacttcggctagggaggaaggtagag

SEQ ID NO: 181325 - DNA, 2442 bp, Homo sapiens
  Payload ID: 15717
  Gene Symbol: SIGLEC10
  Gene Name: sialic acid binding Ig-like lectin 10
  Uniprot ID: Q96LC7
  ENST ID: ENST00000442846
  CDS Start-End: 1-1365
atgctactgccactgctgctgtcctcgctgctgggcgggtcccaggctatggatgggagattctggatacgagtgcaggagtcagtgatggtgccggagggcctgtgcatctctgtgccctgctctttctcctacccccgacaggactggacagggtctaccccagcttatggctactggttcaaagcagtgactgagacaaccaagggtgctcctgtggccacaaaccaccagagtcgagaggtggaaatgagcacccggggccgattccagctcactggggatcccgccaaggggaactgctccttggtgatcagagacgcgcagatgcaggatgagtcacagtacttctttcgggtggagagaggaagctatgtgagatataatttcatgaacgatgggttctttctaaaagtaacagtgctcagcttcacgcccagaccccaggaccacaacaccgacctcacctgccatgtggacttctccagaaagggtgtgagcgcacagaggaccgtccgactccgtgtggcctatgcccccagagaccttgttatcagcatttcacgtgacaacacgccagatcctccagagaacctgagagtgatggtttcccaagcaaacaggacagtcctggaaaaccttgggaacggcacgtctctcccagtactggagggccaaagcctgtgcctggtctgtgtcacacacagcagccccccagccaggctgagctggacccagaggggacaggttctgagcccctcccagccctcagaccccggggtcctggagctgcctcgggttcaagtggagcacgaaggagagttcacctgccacgctcggcacccactgggctcccagcacgtctctctcagcctctccgtgcactataagaagggactcatctcaacggcattctccaacggagcgtttctgggaatcggcatcacggctcttcttttcctctgcctggccctgatcatcatgaagattctaccgaagagacggactcagacagaaaccccgaggcccaggttctcccggcacagcacgatcctggattacatcaatgtggtcccgacggctggccccctggctcagaagcggaatcagaaagccacaccaaacagtcctcggacccctcttccaccaggtgctccctccccagaatcaaagaagaaccagaaaaagcagtatcagttgcccagtttcccagaacccaaatcatccactcaagccccagaatcccaggagagccaagaggagctccattatgccacgctcaacttcccaggcgtcagacccaggcctgaggcccggatgcccaagggcacccaggcggattatgcagaagtcaagttccaatgagggtctcttaggctttaggactgggacttcggctagggaggaaggtagagtaagaggttgaagataacagagtgcaaagtttccttctctccctctctctctctctttctctctctctctctctttctctctcttttaaaaaaacatctggccagggcacagtggctcacgcctgtaatcccagcactttgggaggttgaggtgggcagatcgcctgaggtcgggagttcgagaccagcctggccaacttggtgaaaccccgtctctactaaaaatacaaaaattagctgggcatggtggcaggcgcctgtaatcctacctacttgggaagctgaggcaggagaatcacttgaacctgggagacggaggttgcagtgagccaagatcacaccattgcacgccagcctgggcaacaaagcgagactccatctcaaaaaaaaaatcctccaaatgggttgggtgtctgtaatcccagcactttgggaggctaaggtgggtggattgcttgagcccaggagttcgagaccagcctgggcaacatggtgaaaccccatctctacaaaaaatacaaaacatagctgggcttggtggtgtgtgcctgtagtcccagctgtcagacatttaaaccagagcaactccatctggaataggagctgaataaaatgaggctgagacctactgggctgcattctcagacagtggaggcattctaagtcacaggatgagacaggaggtccgtacaagatacaggtcataaagactttgctgataaaacagattgcagtaaagaagccaaccaaatcccaccaaaaccaagttggccacgagagtgacctctggtcgtcctcactgctacactcctgacagcaccatgacagtttacaaatgccatggcaacatcaggaagttacccgatatgtcccaaaagggggaggaatgaataatccaccccttgtttagcaaataagcaagaaataaccataaaagtgggcaaccagcagctctaggcgctgctcttgtctatggagtagccattcttttgttcctttactttcttaataaacttgctttcacctt

SEQ ID NO: 181326 - DNA, 2768 bp, Homo sapiens
  Payload ID: 15717
  Gene Symbol: SIGLEC10
  Gene Name: sialic acid binding Ig-like lectin 10
  Uniprot ID: Q96LC7
  ENST ID: ENST00000441969
  CDS Start-End: 56-1690
agcacgaccagagaacaggcctgtctcaggcaggccctgcgcctcctatgcggagatgctactgccactgctgctgtcctcgctgctgggcgggtcccaggctatggatgggagattctggatacgagtgcaggagtcagtgatggtgccggagggcctgtgcatctctgtgccctgctctttctcctacccccgacaggactggacagggtctaccccagcttatggctactggttcaaagcagtgactgagacaaccaagggtgctcctgtggccacaaaccaccagagtcgagaggtggaaatgagcacccggggccgattccagctcactggggatcccgccaaggggaactgctccttggtgatcagagacgcgcagatgcaggatgagtcacagtacttctttcgggtggagagaggaagctatgtgagatataatttcatgaacgatgggttctttctaaaagtaacagtgctcagcttcacgcccagaccccaggaccacaacaccgacctcacctgccatgtggacttctccagaaagggtgtgagcgcacagaggaccgtccgactccgtgtggcctatgcccccagagaccttgttatcagcatttcacgtgacaacacgccagccctggagccccagccccagggaaatgtcccatacctggaagcccaaaaaggccagttcctgcggctcctctgtgctgctgacagccagccccctgccacactgagctgggtcctgcagaacagagtcctctcctcgtcccatccctggggccctagacccctggggctggagctgcccggggtgaaggctggggattcagggcgctacacctgccgagcggagaacaggcttggctcccagcagcgagccctggacctctctgtgcagtatcctccagagaacctgagagtgatggtttcccaagcaaacaggacagtcctggaaaaccttgggaacggcacgtctctcccagtactggagggccaaagcctgtgcctggtctgtgtcacacacagcagccccccagccaggctgagctggacccagaggggacaggttctgagcccctcccagccctcagaccccggggtcctggagctgcctcgggttcaagtggagcacgaaggagagttcacctgccacgctcggcacccactgggctcccagcacgtctctctcagcctctccgtgcactataagaagggactcatctcaacggcattctccaacggagcgtttctgggaatcggcatcacggctcttcttttcctctgcctggccctgatcatcatgaagattctaccgaagagacggactcagacagaaaccccgaggcccaggttctcccggcacagcacgatcctggattacatcaatgtggtcccgacggctggccccctggctcagaagcggaatcagaaagccacaccaaacagtcctcggacccctcttccaccaggtgctccctccccagaatcaaagaagaaccagaaaaagcagtatcagttgcccagtttcccagaacccaaatcatccactcaagccccagaatcccaggagagccaagaggagctccattatgccacgctcaacttcccaggcgtcagacccaggcctgaggcccggatgcccaagggcacccaggcggattatgcagaagtcaagttccaatgagggtctcttaggctttaggactgggacttcggctagggaggaaggtagagtaagaggttgaagataacagagtgcaaagtttccttctctccctctctctctctctttctctctctctctctctttctctctcttttaaaaaaacatctggccagggcacagtggctcacgcctgtaatcccagcactttgggaggttgaggtgggcagatcgcctgaggtcgggagttcgagaccagcctggccaacttggtgaaaccccgtctctactaaaaatacaaaaattagctgggcatggtggcaggcgcctgtaatcctacctacttgggaagctgaggcaggagaatcacttgaacctgggagacggaggttgcagtgagccaagatcacaccattgcacgccagcctgggcaacaaagcgagactccatctcaaaaaaaaaatcctccaaatgggttgggtgtctgtaatcccagcactttgggaggctaaggtgggtggattgcttgagcccaggagttcgagaccagcctgggcaacatggtgaaaccccatctctacaaaaaatacaaaacatagctgggcttggtggtgtgtgcctgtagtcccagctgtcagacatttaaaccagagcaactccatctggaataggagctgaataaaatgaggctgagacctactgggctgcattctcagacagtggaggcattctaagtcacaggatgagacaggaggtccgtacaagatacaggtcataaagactttgctgataaaacagattgcagtaaagaagccaaccaaatcccaccaaaaccaagttggccacgagagtgacctctggtcgtcctcactgctacactcctgacagcaccatgacagtttacaaatgccatggcaacatcaggaagttacccgatatgtcccaaaagggggaggaatgaataatccaccccttgtttagcaaataagcaagaaataaccataaaagtgggcaaccagcagctctaggcgctgctcttgtctatggagtagccattcttttgttcctttactttcttaataaacttgctttcacctta

SEQ ID NO: 181327 - DNA, 1776 bp, Homo sapiens
  Payload ID: 15717
  Gene Symbol: SIGLEC10
  Gene Name: sialic acid binding Ig-like lectin 10
  Uniprot ID: Q96LC7
  ENST ID: ENST00000436984
  CDS Start-End: 62-1726
actcacagcacgaccagagaacaggcctgtctcaggcaggccctgcgcctcctatgcggagatgctactgccactgctgctgtcctcgctgctgggcgggtcccaggctatggatgggagattctggatacgagtgcaggagtcagtgatggtgccggagggcctgtgcatctctgtgccctgctctttctcctacccccgacaggactggacagggtctaccccagcttatggctactggttcaaagcagtgactgagacaaccaagggtgctcctgtggccacaaaccaccagagtcgagaggtggaaatgagcacccggggccgattccagctcactggggatcccgccaaggggaactgctccttggtgatcagagacgcgcagatgcaggatgagtcacagtacttctttcgggtggagagaggaagctatgtgagatataatttcatgaacgatgggttctttctaaaagtaacaggaaccaaaccaacgacctcccacttctcagtgctcagcttcacgcccagaccccaggaccacaacaccgacctcacctgccatgtggacttctccagaaagggtgtgagcgcacagaggaccgtccgactccgtgtggcctatgcccccagagaccttgttatcagcatttcacgtgacaacacgccagccctggagccccagccccagggaaatgtcccatacctggaagcccaaaaaggccagttcctgcggctcctctgtgctgctgacagccagccccctgccacactgagctgggtcctgcagaacagagtcctctcctcgtcccatccctggggccctagacccctggggctggagctgcccggggtgaaggctggggattcagggcgctacacctgccgagcggagaacaggcttggctcccagcagcgagccctggacctctctgtgcagtatcctccagagaacctgagagtgatggtttcccaagcaaacaggacagtcctggaaaaccttgggaacggcacgtctctcccagtactggagggccaaagcctgtgcctggtctgtgtcacacacagcagccccccagccaggctgagctggacccagaggggacaggttctgagcccctcccagccctcagaccccggggtcctggagctgcctcgggttcaagtggagcacgaaggagagttcacctgccacgctcggcacccactgggctcccagcacgtctctctcagcctctccgtgcactataagaagggactcatctcaacggcattctccaacggagcgtttctgggaatcggcatcacggctcttcttttcctctgcctggccctgatcatcatgaagattctaccgaagagacggactcagacagaaaccccgaggcccaggttctcccggcacagcacgatcctggattacatcaatgtggtcccgacggctggccccctggctcagaagcggaatcagaaagccacaccaaacagtcctcggacccctcttccaccaggtgctccctccccagaatcaaagaagaaccagaaaaagcagtatcagttgcccagtttcccagaacccaaatcatccactcaagccccagaatcccaggagagccaagaggagctccattatgccacgctcaacttcccaggcgtcagacccaggcctgaggcccggatgcccaagggcacccaggcggattatgcagaagtcaagttccaatgagggtctcttaggctttaggactgggacttcggctagggaggaaggtagag

SEQ ID NO: 181328 - DNA, 1841 bp, Homo sapiens
  Payload ID: 15717
  Gene Symbol: SIGLEC10
  Gene Name: sialic acid binding Ig-like lectin 10
  ENST ID: ENST00000525998
  CDS Start-End: 62-1600
actcacagcacgaccagagaacaggcctgtctcaggcaggccctgcgcctcctatgcggagatgctactgccactgctgctgtcctcgctgctgggcgggtcccaggctatggatgggagattctggatacgagtgcaggagtcagtgatggtgccggagggcctgtgcatctctgtgccctgctctttctcctacccccgacaggactggacagggtctaccccagcttatggctactggttcaaagcagtgactgagacaaccaagggtgctcctgtggccacaaaccaccagagtcgagaggtggaaatgagcacccggggccgattccagctcactggggatcccgccaaggggaactgctccttggtgatcagagacgcgcagatgcaggatgagtcacagtacttctttcgggtggagagaggaagctatgtgagatataatttcatgaacgatgggttctttctaaaagtaacagccctgactcagaagcctgatgtctacatccccgagaccctggagcccgggcagccggtgacggtcatctgtgtgtttaactgggcctttgaggaatgtccacccccttctttctcctggacgggggctgccctctcctcccaaggaaccaaaccaacgacctcccacttctcagtgctcagcttcacgcccagaccccaggaccacaacaccgacctcacctgccatgtggacttctccagaaagggtgtgagcgcacagaggaccgtccgactccgtgtggcctatgcccccagagaccttgttatcagcatttcacgtgacaacacgccagatcctccagagaacctgagagtgatggtttcccaagcaaacaggacagtcctggaaaaccttgggaacggcacgtctctcccagtactggagggccaaagcctgtgcctggtctgtgtcacacacagcagccccccagccaggctgagctggacccagaggggacaggttctgagcccctcccagccctcagaccccggggtcctggagctgcctcgggttcaagtggagcacgaaggagagttcacctgccacgctcggcacccactgggctcccagcacgtctctctcagcctctccgtgcactataagaagggactcatctcaacggcattctccaacggagcgtttctgggaatcggcatcacggctcttcttttcctctgcctggccctgatcatcatgaagattctaccgaagagacggactcagacagaaaccccgaggcccaggttctcccggcacagcacgatcctggattacatcaatgtggtcccgacggctggccccctggctcagaagcggaatcagaaagccacaccaaacagtcctcggacccctcttccaccaggtgctccctccccagaatcaaagaagaaccagaaaaagcagtatcagttgcccagtttcccagaacccaaatcatccactcaagccccagaatcccaggagagccaagaggagctccattatgccacgctcaacttcccaggcgtcagacccaggcctgaggcccggatgcccaagggcacccaggcggattatgcagaagtcaagttccaatgagggtctcttaggctttaggactgggacttcggctagggaggaaggtagagtaagaggttgaagataacagagtgcaaagtttccttctctccctctctctctctctttctctctctctctctctttctctctcttttaaaaaaacatctggccagggcacagtggctcacgcctgtaatcccagcactttgggaggttgaggtgggcagatcgcctgaggtcgggagttcgagaccagcct

SEQ ID NO: 181329 - DNA, 561 bp, Homo sapiens
  Payload ID: 15717
  Gene Symbol: SIGLEC10
  Gene Name: sialic acid binding Ig-like lectin 10
  ENST ID: ENST00000530476
  CDS Start-End: 3-561
ctatgcggagatgctactgccactgctgctgtcctcgctgctgggcggactggacagggtctaccccagcttatggctactggttcaaagcagtgactgagacaaccaagggtgctcctgtggccacaaaccaccagagtcgagaggtggaaatgagcacccggggccgattccagctcactggggatcccgccaaggggaactgctccttggtgatcagagacgcgcagatgcaggatgagtcacagtacttctttcgggtggagagaggaagctatgtgagatataatttcatgaacgatgggttctttctaaaagtaacagccctgactcagaagcctgatgtctacatccccgagaccctggagcccgggcagccggtgacggtcatctgtgtgtttaactgggcctttgaggaatgtccacccccttctttctcctggacgggggctgccctctcctcccaaggaaccaaaccaacgacctcccacttctcagtgctcagcttcacgcccagaccccaggaccacaacaccgacctcacctgccatgtggacttct

SEQ ID NO: 181330 - DNA, 596 bp, Homo sapiens
  Payload ID: 15717
  Gene Symbol: SIGLEC10
  Gene Name: sialic acid binding Ig-like lectin 10
  ENST ID: ENST00000529627
  CDS Start-End: 131-596
atttcatgcatcaggccccagggctcagcttccgccttcggcttccccttctgccaagagccctgagccactcacagcacgaccagagaacaggcctgtctcaggcaggccctgcgcctcctatgcggagatgctactgccactgctgctgtcctcgctgctgggcgtgctcagcttcacgcccagaccccaggaccacaacaccgacctcacctgccatgtggacttctccagaaagggtgtgagcgcacagaggaccgtccgactccgtgtggcctatgcccccagagaccttgttatcagcatttcacgtgacaacacgccagccctggagccccagccccagggaaatgtcccatacctggaagcccaaaaaggccagttcctgcggctcctctgtgctgctgacagccagccccctgccacactgagctgggtcctgcagaacagagtcctctcctcgtcccatccctggggccctagacccctggggctggagctgcccggggtgaaggctggggattcagggcgctacacctgccgagcggagaacaggcttggctcccagcagcgagccctggacctctctgtgcagt

SEQ ID NO: 181331 - DNA, 2479 bp, Homo sapiens
  Payload ID: 15718
  Gene Symbol: SIGLEC11
  Gene Name: sialic acid binding Ig-like lectin 11
  Uniprot ID: Q96RL6
  ENST ID: ENST00000426971
  CDS Start-End: 1-1809
atggtcccgggacaggcccagccccagagcccagagatgctgctgctgcccctgctgctgcccgtgctgggggcggggtccctgaacaaggatcccagttacagtcttcaagtgcagaggcaggtgccggtgccggagggcctgtgtgtcatcgtgtcttgcaacctctcctacccccgggatggctgggacgagtctactgctgcttatggctactggttcaaaggacggaccagcccaaagacgggtgctcctgtggccactaacaaccagagtcgagaggtggaaatgagcacccgggaccgattccagctcactggggatcccggcaaagggagctgctccttggtgatcagagacgcgcagagggaggatgaggcatggtacttctttcgggtggagagaggaagccgtgtgagacatagtttcctgagcaatgcgttctttctaaaagtaacagccctgactaagaagcctgatgtctacatccccgagaccctggagcccgggcagccggtgacggtcatctgtgtgtttaactgggctttcaagaaatgtccagccccttctttctcctggacgggggctgccctctcccctagaagaaccagaccaagcacctcccacttctcagtgctcagcttcacgcccagcccccaggaccacgacaccgacctcacctgccatgtggacttctccagaaagggtgtgagcgcacagaggaccgtccgactccgtgtggcctatgcccccaaagaccttattatcagcatttcacatgacaacacgtcagccctggaactccagggaaacgtcatatatctggaagttcagaaaggccagttcctgcggctcctctgtgctgctgacagccagccccctgccacgctgagctgggtcctgcaggacagagtcctctcctcgtcccacccctggggccccagaaccctggggctggagctgcgtggggtaagggccggggattcagggcgctacacctgccgagcggagaacaggcttggctcccagcagcaagccctggacctctctgtgcagtatcctccagagaacctgagagtgatggtttcccaagcaaacaggacagtcctggaaaacctcgggaacggcacatccctcccggtcctggagggccaaagcctgcgcctggtctgtgtcacccacagcagccccccagccaggctgagctggacccggtggggacagaccgtgggcccctcccagccctcagaccccggggtcctggagctgccacccattcaaatggagcacgaaggagagttcacctgccacgctcagcaccctctgggctcccagcacgtctctctcagcctctccgtgcactggaagctggagcatgggggaggacttggcctgggggctgccctgggagctggcgtcgctgccctgctcgctttctgttcctgccttgtcgtcttcagggtgaagatctgcaggaaggaagctcgcaagagggcagcagctgagcaggacgtgccctccaccctgggacccatctcccagggtcaccagcatgaatgctcggcaggcagctcccaagaccacccgcccccaggtgcagccacctacaccccggggaagggggaagagcaggagctccactatgcctccctcagcttccagggcctgaggctctgggagcctgcggaccaggaggcccccagcaccaccgagtactcggagatcaagatccacacaggacagcccctgaggggcccaggctttgggcttcaattggagagggagatgtcagggatggttccaaagtgaagaggtctccatggcaacaggacaccagcaagtgtgtgggagtcgcactggtgtgacggccagaactggactcagatttcagccccatccccaatgaagagcttgagtttgaagattatactttttttgagacagggtctgactctgtcctccaggccagagtccagtggtgcaatctcagctcactgtagcctcaacctgccaggttgaagtgagcctcccatttcagcctcccaagtagctgggactacaattgtgagccaccatgccaggctcattgttatatttttagtagagacagggttttgccatgtttccctggctggtctcagactcctgggctcaagcaatctgcccgcctctgcctcccaaagtgctgggattacagacgtgagccaccacagctggctgaagattatactttcaattcagagcgagtttgaagatgacactttgaggcatcgtgtctatggttcattactacagaagcttctctggatgtgtaaagcacaggaaaccaggcagaggaggcacagggtgctctccagaacgagaagccagctcctggagttgtttgctgcaactgccattccccgttgatgaccatgctcttccttcagaagagggagagtgagaggaccaagtccaagtggttcccatttgaacattt

SEQ ID NO: 181332 - DNA, 825 bp, Homo sapiens
  Payload ID: 15718
  Gene Symbol: SIGLEC11
  Gene Name: sialic acid binding Ig-like lectin 11
  ENST ID: ENST00000426296
  CDS Start-End: 1-181
gctgctggaggggaacagcagtcagggctccttcgaggtcacccccagctcagccgggccctgggccaacagctccctgagcctccatggagggctcagctccggcctcaggctccgctgtaaggcctggaacgtccacggggcccagagtggctctgtcttccagctgctaccagggtgaagatctgcaggaaggaagctcgcaagagggcagcagctgagcaggacgtgccctccaccctgggacccatctcccagggtcaccagcatgaatgctcggcaggcagctcccaagaccacccgcccccaggtgcagccacctacaccccggggaagggggaagagcaggagctccactatgcctccctcagcttccagggcctgaggctctgggagcctgcggaccaggaggcccccagcaccaccgagtactcggagatcaagatccacacaggacagcccctgaggggcccaggctttgggcttcaattggagagggagatgtcagggatggttccaaagtgaagaggtctccatggcaacaggacaccagcaagtgtgtgggagtcgcactggtgtgacggccagaactggactcagatttcagccccatccccaatgaagagcttgagtttgaagattatactttttttgagacagggtctgactctgtcctccaggccagagtccagtggtgcaatctcagctcactgtagcctcaacctgccaggttgaagtgagcctcccatttcagcctcccaagtagctgggactacaattgtgagccaccatgccaggctcattgttatatttttagtagagaca

SEQ ID NO: 181333 - DNA, 3173 bp, Homo sapiens
  Payload ID: 15718
  Gene Symbol: SIGLEC11
  Gene Name: sialic acid binding Ig-like lectin 11
  Uniprot ID: Q96RL6
  ENST ID: ENST00000447370
  CDS Start-End: 92-2188
cgaggctcctcctctgtggatggtcactgcccctccaccaggcttcctgctggaggagtttccttcccagccaggccggcccagaagccagatggtcccgggacaggcccagccccagagcccagagatgctgctgctgcccctgctgctgcccgtgctgggggcggggtccctgaacaaggatcccagttacagtcttcaagtgcagaggcaggtgccggtgccggagggcctgtgtgtcatcgtgtcttgcaacctctcctacccccgggatggctgggacgagtctactgctgcttatggctactggttcaaaggacggaccagcccaaagacgggtgctcctgtggccactaacaaccagagtcgagaggtggaaatgagcacccgggaccgattccagctcactggggatcccggcaaagggagctgctccttggtgatcagagacgcgcagagggaggatgaggcatggtacttctttcgggtggagagaggaagccgtgtgagacatagtttcctgagcaatgcgttctttctaaaagtaacagccctgactaagaagcctgatgtctacatccccgagaccctggagcccgggcagccggtgacggtcatctgtgtgtttaactgggctttcaagaaatgtccagccccttctttctcctggacgggggctgccctctcccctagaagaaccagaccaagcacctcccacttctcagtgctcagcttcacgcccagcccccaggaccacgacaccgacctcacctgccatgtggacttctccagaaagggtgtgagcgcacagaggaccgtccgactccgtgtggcctatgcccccaaagaccttattatcagcatttcacatgacaacacgtcagccctggaactccagggaaacgtcatatatctggaagttcagaaaggccagttcctgcggctcctctgtgctgctgacagccagccccctgccacgctgagctgggtcctgcaggacagagtcctctcctcgtcccacccctggggccccagaaccctggggctggagctgcgtggggtaagggccggggattcagggcgctacacctgccgagcggagaacaggcttggctcccagcagcaagccctggacctctctgtgcagtatcctccagagaacctgagagtgatggtttcccaagcaaacaggacagtcctggaaaacctcgggaacggcacatccctcccggtcctggagggccaaagcctgcgcctggtctgtgtcacccacagcagccccccagccaggctgagctggacccggtggggacagaccgtgggcccctcccagccctcagaccccggggtcctggagctgccacccattcaaatggagcacgaaggagagttcacctgccacgctcagcaccctctgggctcccagcacgtctctctcagcctctccgtgcactaccctccacagctgctgggcccctcctgctcctgggaggctgagggtctgcactgcagctgctcctcccaggccagcccggccccctctctgcgctggtggcttggggaggagctgctggaggggaacagcagtcagggctccttcgaggtcacccccagctcagccgggccctgggccaacagctccctgagcctccatggagggctcagctccggcctcaggctccgctgtaaggcctggaacgtccacggggcccagagtggctctgtcttccagctgctaccagggaagctggagcatgggggaggacttggcctgggggctgccctgggagctggcgtcgctgccctgctcgctttctgttcctgccttgtcgtcttcagggtgaagatctgcaggaaggaagctcgcaagagggcagcagctgagcaggacgtgccctccaccctgggacccatctcccagggtcaccagcatgaatgctcggcaggcagctcccaagaccacccgcccccaggtgcagccacctacaccccggggaagggggaagagcaggagctccactatgcctccctcagcttccagggcctgaggctctgggagcctgcggaccaggaggcccccagcaccaccgagtactcggagatcaagatccacacaggacagcccctgaggggcccaggctttgggcttcaattggagagggagatgtcagggatggttccaaagtgaagaggtctccatggcaacaggacaccagcaagtgtgtgggagtcgcactggtgtgacggccagaactggactcagatttcagccccatccccaatgaagagcttgagtttgaagattatactttttttgagacagggtctgactctgtcctccaggccagagtccagtggtgcaatctcagctcactgtagcctcaacctgccaggttgaagtgagcctcccatttcagcctcccaagtagctgggactacaattgtgagccaccatgccaggctcattgttatatttttagtagagacagggttttgccatgtttccctggctggtctcagactcctgggctcaagcaatctgcccgcctctgcctcccaaagtgctgggattacagacgtgagccaccacagctggctgaagattatactttcaattcagagcgagtttgaagatgacactttgaggcatcgtgtctatggttcattactacagaagcttctctggatgtgtaaagcacaggaaaccaggcagaggaggcacagggtgctctccagaacgagaagccagctcctggagttgtttgctgcaactgccattccccgttgatgaccatgctcttccttcagaagagggagagtgagaggaccaagtccaagtggttcccatttgaacatttaaaaaaaaaaaaaaggctgggcatggtggctcacgcctgtaatctcaacactttgggaggctgaagtgggtggatcacaagtcaggagttcaagaccagcctgggcaagatggtgaaaccccatctctactaaaaatacaaaaattagccgggcatggtggcgggcgcctaaaatcccagctactcgggagactaggcagagaattggttgaacccgggaggtggaggttgcagtgagccgagatcgtcccactgcactccagcctgggcaacagagtgagactctgtttctaaataaataaatgaataaataaa

SEQ ID NO: 181334 - DNA, 2121 bp, Homo sapiens
  Payload ID: 15719
  Gene Symbol: SIGLEC12
  Gene Name: sialic acid binding Ig-like lectin 12 (gene/pseudogene)
  Uniprot ID: Q96PQ1
  ENST ID: ENST00000291707
  CDS Start-End: 57-1844
gaagaaccctgaggaacagacttacctcagcaaccctggcacctccaacccgacacatgctactgctgctgctactgctgccacccctgctctgtgggagagtgggggctaaggaacagaaggattacctgctgacaatgcagaagtccgtgacggtgcaggagggcctgtgtgtctctgtgctttgctccttctcctacccccaaaatggctggactgcctccgatccagttcatggctactggttccgggcaggggaccatgtaagccggaacattccagtggccacaaacaacccagctcgagcagtgcaggaggagactcgggaccgattccacctccttggggacccacagaacaaggattgtaccctgagcatcagagacaccagagagagtgatgcagggacatacgtcttttgtgtagagagaggaaatatgaaatggaattataaatatgaccagctctctgtgaatgtgacagcgtcccaggacctactgtcaagatacaggctggaggtgccagagtcggtgactgtgcaggagggtctgtgtgtctctgtgccctgcagtgtcctttacccccattacaactggactgcctctagccctgtttatggatcctggttcaaggaaggggccgatataccatgggatattccagtggccacaaacaccccaagtggaaaagtgcaagaggatacccacggtcgattcctcctccttggggacccacagaccaacaactgctccctgagcatcagagatgccaggaagggggattcagggaagtactacttccaggtggagagaggaagcaggaaatggaactacatatatgacaagctctctgtgcatgtgacagccctgactcacatgcccaccttctccatcccggggaccctggagtctggccaccccaggaacctgacctgctctgtgccctgggcctgtgaacaggggacgccccccacgatcacctggatgggggcctccgtgtcctccctggaccccactatcactcgctcctcgatgctcagcctcatcccacagccccaggaccatggcaccagcctcacctgtcaggtgaccttgcctggggccggcgtgaccatgaccagggctgtccgactcaacatatcctatcctcctcagaacttgaccatgactgtcttccaaggagatggcacagcatccacaaccttgaggaatggctcggccctttcagtcctggagggccagtccctgcaccttgtctgtgctgtcgacagcaatccccctgccaggctgagctggacctgggggagcctgaccctgagcccctcacagtcctcgaaccttggggtgctggagctgcctcgagtgcatgtgaaggatgaaggggaattcacctgccgagctcagaaccctctaggctcccagcacatttccctgagcctctccctgcaaaacgagtacacaggcaaaatgaggcctatatcaggagtgacgctaggggcattcgggggagctggagccacagccctggtcttcctgtacttctgcatcatcttcgttgtagtgaggtcctgcaggaagaaatcggcaaggccagcagtgggcgtgggggatacaggcatggaggacgcaaacgctgtcaggggctcagcctctcagggacccctgattgaatccccggcagatgacagccccccacaccatgctccgccagccctggccaccccctccccagaggaaggagagatccagtatgcatccctcagcttccacaaagcgaggcctcagtacccacaggaacaggaggccatcggctatgagtactccgagatcaacatccccaagtgagaaactgcagagactcaggcctgtttgagggctcacgacccctgcagcaaagaagcccgagactgattcctttagaattaacagccctccatgctgtgcaacaggacatcagaacttattcctcttgtcaaactgaaaatgcgtgcctgatgaccaaactctccctttctccatccaatcggtccacactccccgcccccggcctctggtacccaccattctcttctctacttctctgaggtcgactattttaggttccaaatatagtgagatcgta

SEQ ID NO: 181335 - DNA, 1791 bp, Homo sapiens
  Payload ID: 15719
  Gene Symbol: SIGLEC12
  Gene Name: sialic acid binding Ig-like lectin 12 (gene/pseudogene)
  ENST ID: ENST00000596742
  CDS Start-End: 40-504
agacttacctcagcaaccctggcacctccaacccgacacatgctactgctgctgctactgctgccacccctgctctgtgggagagtgggggctaaggaacagaaggattacctgctgacaatgcagaagtccgtgacggtgcaggagggcctgtgtgtctctgtgctttgctccttctcctacccccaaaatggctggactgcctccgatccagttcatggctactggttccgggcaggggaccatgtaagccggaacattccagtggccacaaacaacccagctcgagcagtgcaggaggagactcgggaccgattccacctccttggggacccacagaacaaggattgtaccctgagcatcagagacaccagagagagtgatgcagggacatacgtcttttgtgtagagagaggaaatatgaaatggaattataaatatgaccagctctctgtgaatgtgacaggtggagagaggaagcaggaaatggaactacatatatgacaagctctctgtgcatgtgacagccctgactcacatgcccaccttctccatcccggggaccctggagtctggccaccccaggaacctgacctgctctgtgccctgggcctgtgaacaggggacgccccccacgatcacctggatgggggcctccgtgtcctccctggaccccactatcactcgctcctcgatgctcagcctcatcccacagccccaggaccatggcaccagcctcacctgtcaggtgaccttgcctggggccggcgtgaccatgaccagggctgtccgactcaacatatcctatcctcctcagaacttgaccatgactgtcttccaaggagatggcacagcatccacaaccttgaggaatggctcggccctttcagtcctggagggccagtccctgcaccttgtctgtgctgtcgacagcaatccccctgccaggctgagctggacctgggggagcctgaccctgagcccctcacagtcctcgaaccttggggtgctggagctgcctcgagtgcatgtgaaggatgaaggggaattcacctgccgagctcagaaccctctaggctcccagcacatttccctgagcctctccctgcaaaacgagtacacaggcaaaatgaggcctatatcaggagtgacgctaggggcattcgggggagctggagccacagccctggtcttcctgtacttctgcatcatcttcgttgtagtgaggtcctgcaggaagaaatcggcaaggccagcagtgggcgtgggggatacaggcatggaggacgcaaacgctgtcaggggctcagcctctcagggacccctgattgaatccccggcagatgacagccccccacaccatgctccgccagccctggccaccccctccccagaggaaggagagatccagtatgcatccctcagcttccacaaagcgaggcctcagtacccacaggaacaggaggccatcggctatgagtactccgagatcaacatccccaagtgagaaactgcagagactcaggcctgtttgagggctcacgacccctgcagcaaagaagcccgagactgattcctttagaattaacagccctccatgctgtgcaacaggacatcagaacttattcctcttgtcaaactgaaaatgcgtgcctgatgaccaaactctccctttctccatccaatcggtccacactccccgcccccggcctctggtacccaccattctcttctctacttctctgaggtcgactattttaggttccaaatatagtgagatcgtagagtgtt

SEQ ID NO: 181336 - DNA, 1434 bp, Homo sapiens
  Payload ID: 15719
  Gene Symbol: SIGLEC12
  Gene Name: sialic acid binding Ig-like lectin 12 (gene/pseudogene)
  Uniprot ID: Q96PQ1
  ENST ID: ENST00000598614
  CDS Start-End: 1-1434
atgctgctgcccctgctatgggcaaatgaagagagggacagtgggggctgggctgaccctcgtttctccacagcgtcccaggacctactgtcaagatacaggctggaggtgccagagtcggtgactgtgcaggagggtctgtgtgtctctgtgccctgcagtgtcctttacccccattacaactggactgcctctagccctgtttatggatcctggttcaaggaaggggccgatataccatgggatattccagtggccacaaacaccccaagtggaaaagtgcaagaggatacccacggtcgattcctcctccttggggacccacagaccaacaactgctccctgagcatcagagatgccaggaagggggattcagggaagtactacttccaggtggagagaggaagcaggaaatggaactacatatatgacaagctctctgtgcatgtgacagccctgactcacatgcccaccttctccatcccggggaccctggagtctggccaccccaggaacctgacctgctctgtgccctgggcctgtgaacaggggacgccccccacgatcacctggatgggggcctccgtgtcctccctggaccccactatcactcgctcctcgatgctcagcctcatcccacagccccaggaccatggcaccagcctcacctgtcaggtgaccttgcctggggccggcgtgaccatgaccagggctgtccgactcaacatatcctatcctcctcagaacttgaccatgactgtcttccaaggagatggcacagcatccacaaccttgaggaatggctcggccctttcagtcctggagggccagtccctgcaccttgtctgtgctgtcgacagcaatccccctgccaggctgagctggacctgggggagcctgaccctgagcccctcacagtcctcgaaccttggggtgctggagctgcctcgagtgcatgtgaaggatgaaggggaattcacctgccgagctcagaaccctctaggctcccagcacatttccctgagcctctccctgcaaaacgagtacacaggcaaaatgaggcctatatcaggagtgacgctaggggcattcgggggagctggagccacagccctggtcttcctgtacttctgcatcatcttcgttgtagtgaggtcctgcaggaagaaatcggcaaggccagcagtgggcgtgggggatacaggcatggaggacgcaaacgctgtcaggggctcagcctctcagggacccctgattgaatccccggcagatgacagccccccacaccatgctccgccagccctggccaccccctccccagaggaaggagagatccagtatgcatccctcagcttccacaaagcgaggcctcagtacccacaggaacaggaggccatcggctatgagtactccgagatcaacatccccaagtga

SEQ ID NO: 181337 - DNA, 2035 bp, Homo sapiens
  Payload ID: 15720
  Gene Symbol: SIGLEC14
  Gene Name: sialic acid binding Ig-like lectin 14
  Uniprot ID: Q08ET2
  ENST ID: ENST00000360844
  CDS Start-End: 43-1233
agccggacctgggactgggctggggccctggcggatggagacatgctgcccctgctgctgctgcccctgctgtggggggggtccctgcaggagaagccagtgtacgagctgcaagtgcagaagtcggtgacggtgcaggagggcctgtgcgtccttgtgccctgctccttctcttacccctggagatcctggtattcctctcccccactctacgtctactggttccgggacggggagatcccatactacgctgaggttgtggccacaaacaacccagacagaagagtgaagccagagacccagggccgattccgcctccttggggatgtccagaagaagaactgctccctgagcatcggagatgccagaatggaggacacgggaagctatttcttccgcgtggagagaggaagggatgtaaaatatagctaccaacagaataagctgaacttggaggtgacagccctgatagagaaacccgacatccactttctggagcctctggagtccggccgccccacaaggctgagctgcagccttccaggatcctgtgaagcgggaccacctctcacattctcctggacggggaatgccctcagccccctggaccccgagaccacccgctcctcggagctcaccctcacccccaggcccgaggaccatggcaccaacctcacctgtcaggtgaaacgccaaggagctcaggtgaccacggagagaactgtccagctcaatgtctcctatgctccacagaacctcgccatcagcatcttcttcagaaatggcacaggcacagccctgcggatcctgagcaatggcatgtcggtgcccatccaggagggccagtccctgttcctcgcctgcacagttgacagcaacccccctgcctcactgagctggttccgggagggaaaagccctcaatccttcccagacctcaatgtctgggaccctggagctgcctaacataggagctagagagggaggggaattcacctgccgggttcagcatccgctgggctcccagcacctgtccttcatcctttctgtgcagagaagctcctcttcctgcatatgtgtaactgagaaacagcagggctcctggcccctcgtcctcaccctgatcaggggggctctcatgggggctggcttcctcctcacctatggcctcacctggatctactataccaggtgtggaggcccccagcagagcagggctgagaggcctggctgagcccctcccgctcaagacagaactgaggtgtggacacttagccctgtgggacacatgcaggacatcactgtcagcttctttctggaagctcacatcccactgactacccctcttttccttcctgccccataccccttctacttattcccctctgcttgtgagtcttgccccaccacacctgcatccccatctgcaccccatcccctctccacctgcccttctcttccctctccatccaccatctccagccctgtgaagggaatgtactttcggtcttatacccccattacccattacccaaaagttaccttttttttttttttttttttttgagacagagtctcactctgttgcacaggctggagttcagtggcacaatctccgttcactgcaacctccacctctggggttcaagcaattctcctgcctcagcctccctagtagctgggattacaggtgcctgccaccacatccagttaattttttttttttgtatgttagtagagatggggttttaccatgttggccaggtctcgaactcctgacctcaagcaatccactgcattggcctcccaaagtgctggcattacaggtatgagccaccgtgcctggctgccaaaagttaccttcttaacacttgaatttctggtctcctcagcttccctatccatataggcacagagaggcagcatttgttttccagttaaaactctacctcattgtgattattatccaatacaattgttacaaaataagtaaaacttttatgaaacaatacaacataactgattttactctttaa

SEQ ID NO: 181338 - DNA, 1573 bp, Homo sapiens
  Payload ID: 15721
  Gene Symbol: SIGLEC15
  Gene Name: sialic acid binding Ig-like lectin 15
  Uniprot ID: Q6ZMC9
  ENST ID: ENST00000389474
  CDS Start-End: 218-1204
acatgactaaactccacggggcttgaatgatcagacctcaggctgccaggcttcctgtccccagttcctccggctcccgcagagcccacagggacctgcagatctgagtgccctgcccacccccgcccgccttccttcccccaccacgcctgggagggccctcactggggaggtggccgagagcgggtctggcctggggtgttcagatgctcacagcatggaaaagtccatctggctgctggcctgcttggcgtgggttctcccgacaggctcatttgtgagaactaaaatagatactacggagaacttgctcaacacagaggtgcacagctcgccagcgcagcgctggtccatgcaggtgccacccgaggtgagcgcggaggcaggcgacgcggcagtgctgccctgcaccttcacgcacccgcaccgccactacgacgggccgctgacggccatctggcgcgcgggcgagccctatgcgggcccgcaggtgttccgctgcgctgcggcgcggggcagcgagctctgccagacggcgctgagcctgcacggccgcttccggctgctgggcaacccgcgccgcaacgacctctcgctgcgcgtcgagcgcctcgccctggctgacgaccgccgctacttctgccgcgtcgagttcgccggcgacgtccatgaccgctacgagagccgccacggcgtccggctgcacgtgacagccgcgccgcggatcgtcaacatctcggtgctgcccagtccggctcacgccttccgcgcgctctgcactgccgaaggggagccgccgcccgccctcgcctggtccggcccggccctgggcaacagcttggcagccgtgcggagcccgcgtgagggtcacggccacctagtgaccgccgaactgcccgcactgacccatgacggccgctacacgtgtacggccgccaacagcctgggccgctccgaggccagcgtctacctgttccgcttccatggcgccagcggggcctcgacggtcgccctcctgctcggcgctctcggcttcaaggcgctgctgctgctcggggtcctggccgcccgcgctgcccgccgccgcccagagcatctggacaccccggacaccccaccacggtcccaggcccaggagtccaattatgaaaatttgagccagatgaacccccggagcccaccagccaccatgtgctcaccgtgaggagtccctcagccaccaacatccatttcagcactgtaaagaacaaaggccagtgcgaggcttggctggcacagccagtcctggttctcgggcaccttggcagcccccagctgggtggctcctcccctgctcaaggtcaagaccctgctcaaggaggctcatctggcctcctatgtggacaaccatttcggagctccctgatatttttgccagcatttcgtaaatgtgcatacgtctgtgtgtgtgtgtgtgtgtgagagagagagagagagagtacacgcattagcttgagcgtgaaacttccagaaatgttcccttgccctttcttacctagaacacctgctatagtaaagcagacaggaaactgtt

SEQ ID NO: 181339 - DNA, 1054 bp, Homo sapiens
  Payload ID: 15721
  Gene Symbol: SIGLEC15
  Gene Name: sialic acid binding Ig-like lectin 15
  Uniprot ID: Q6ZMC9
  ENST ID: ENST00000546268
  CDS Start-End: 493-1017
aggctacatcgggactctgaagagcagcactctggggtgggcacaggccccacagcagggtcagcctgtggccctgcctctccatcagctcaggctcatttgtgagaactaaaatagatactacggagaacttgctcaacacagaggtgcacagctcgccagcgcagcgctggtccatgcaggtgccacccgaggtgagcgcggaggcaggcgacgcggcagtgctgccctgcaccttcacgcacccgcaccgccactacgacgggccgctgacggccatctggcgcgcgggcgagccctatgcgggcccgcaggtgttccgctgcgctgcggcgcggggcagcgagctctgccagacggcgctgagcctgcacggccgcttccggctgctgggcaacccgcgccgcaacgacctctcgctgcgcgtcgagcgcctcgccctggctgacgaccgccgctacttctgccgcgtcgagttcgccggcgacgtccatgaccgctacgagagccgccacggcgtccggctccgcgccgcggatcgtcaacatctcggtgctgcccagtccggctcacgccttccgcgcgctctgcactgccgaaggggagccgccgcccgccctcgcctggtccggcccggccctgggcaacagcttggcagccgtgcggagcccgcgtgagggtcacggccacctagtgaccgccgaactgcccgcactgacccatgacggccgctacacgtgtacggccgccaacagcctgggccgctccgaggccagcgtctacctgttccgcttccatggcgccagcggggcctcgacggtcgccctcctgctcggcgctctcggcttcaaggcgctgctgctgctcggggtcctggccgcccgcgctgcccgccgccgcccagagcatctggacaccccggacaccccaccacggtcccaggcccaggagtccaattatgaaaatttgagccagatgaacccccggagcccaccagccaccatgtgctcaccgtgaggagtccctcagccaccaacatccatttcagcactgt

SEQ ID NO: 181340 - DNA, 674 bp, Homo sapiens
  Payload ID: 15721
  Gene Symbol: SIGLEC15
  Gene Name: sialic acid binding Ig-like lectin 15
  ENST ID: ENST00000587418
  CDS Start-End: 1-523
cggcgacgtccatgaccgctacgagagccgccacggcgtccggctgcacgtgacagccgcgccgcggatcgtcaacatctcggtgctgcccagtccggctcacgccttccgcgcgctctgcactgccgaaggggagccgccgcccgccctcgcctggtccggcccggccctgggcaacagcttggcagccgtgcggagcccgcgtgagggtcacggccacctagtgaccgccgaactgcccgcactgacccatgacggccgctacacgtgtacggccgccaacagcctgggccgctccgaggccagcgtctacctgttccgcttccatggcgccagcggggcctcgacggtcgccctcctgctcggcgctctcggcttcaaggcgctgctgctgctcggggtcctggccgcccgcgctgcccgccgccgcccagagcatctggacaccccggacaccccaccacgtcccacaacctgtcctgtgtccctgtttgctgatttactgtcgcaccaacgcccctgaatctgaaagccgaccgttgttcagtcatttaacaaatacttattgagtacctactgcataccaggcactggtactaaagacacagcaagatccctgacctcacagaactcatatcctattgtggagaattttaataaatatggaaacacgc

SEQ ID NO: 181341 - DNA, 2384 bp, Homo sapiens
  Payload ID: 15722
  Gene Symbol: SIGLEC5
  Gene Name: sialic acid binding Ig-like lectin 5
  Uniprot ID: O15389
  ENST ID: ENST00000570106
  CDS Start-End: 1-1656
atgctgcccctgctgctgctgcccctgctgtggggggggtccctgcaggagaagccagtgtacgagctgcaagtgcagaagtcggtgacggtgcaggagggcctgtgcgtccttgtgccctgctccttctcttacccctggagatcctggtattcctctcccccactctacgtctactggttccgggacggggagatcccatactacgctgaggttgtggccacaaacaacccagacagaagagtgaagccagagacccagggccgattccgcctccttggggatgtccagaagaagaactgctccctgagcatcggagatgccagaatggaggacacgggaagctatttcttccgcgtggagagaggaagggatgtaaaatatagctaccaacagaataagctgaacttggaggtgacagccctgatagagaaacccgacatccactttctggagcctctggagtccggccgccccacaaggctgagctgcagccttccaggatcctgtgaagcgggaccacctctcacattctcctggacggggaatgccctcagccccctggaccccgagaccacccgctcctcggagctcaccctcacccccaggcccgaggaccatggcaccaacctcacctgtcagatgaaacgccaaggagctcaggtgaccacggagagaactgtccagctcaatgtctcctatgctccacagaccatcaccatcttcaggaacggcatagccctagagatcctgcaaaacacctcataccttccggtcctggagggccaggctctgcggctgctctgtgatgctcccagcaacccccctgcacacctgagctggttccagggctcccctgccctgaacgccacccccatctccaataccgggatcttggagcttcgtcgagtaaggtctgcagaagaaggaggcttcacctgccgcgctcagcacccgctgggcttcctgcaaatttttctgaatctctcagtttactccctcccacagttgctgggcccctcctgctcctgggaggctgagggtctgcactgcagatgctcctttcgagcccggccggccccctccctgtgctggcggcttgaggagaagccgctggaggggaacagcagccagggctcattcaaggtcaactccagctcagctgggccctgggccaacagctccctgatcctccacggggggctcagctccgacctcaaagtcagctgcaaggcctggaacatctatgggtcccagagcggctctgtcctgctgctgcaagggagatcgaacctcgggacaggagtggttcctgcagcccttggtggtgctggtgtcatggccctgctctgtatctgtctgtgcctcatcttctttttaatagtgaaagcccgcaggaagcaagcagctgggagaccagagaaaatggatgatgaagaccccattatgggtaccatcacctcgggttccaggaagaagccctggccagacagccccggagatcaagcatctcctcctggggatgcccctcccttggaagaacaaaaggagctccattatgcctcccttagtttttctgagatgaagtcgagggagcctaaggaccaggaggccccaagcaccacggagtactcggagatcaagacaagcaagtgaggatttgcccagagttcagtcctggctggaggagccacagcctgtctgggggaaaggacaagtcagggaccacttgctgaagcacgaagagcccttgtggcaatgttaacattaactgatgtttaagtgctccaagcagatggaattagagaggtgggctcaaatctaggccctggcactgtcatcaagcaattcactgcatccctctgtgcctcagtttcccattctgtaaatcagagatcatgcatgctacctcaaaggttgttgtgaacattaaagaaatcaacacatggaaatcaaccaacatgggtcctggaacagggcgttgtgctcagtgctttctggtctctcttccttgaatagaaaggtcctgctggcaagttctctcaaggctggggatgaccaggcacaaaaaacagggcagcaatatgttggtgtcactccccttcccaaaactcttcgaagactccctaggaaagaccagcccctcagcctggcacttggttcatgatgtgggatcttatatccttgccagagtcatatctttgcccacttttacctgcaatccttgcatcatattcctttggctccagtccttcatttatgagacccataggaatccttccaacagccaaagagttgagtctaactctttcctgcccaaacccattcacggccccctggccttagacaatatatcacaagcatctcccctgacacataaagtc

SEQ ID NO: 181342 - DNA, 2360 bp, Homo sapiens
  Payload ID: 15722
  Gene Symbol: SIGLEC5
  Gene Name: sialic acid binding Ig-like lectin 5
  Uniprot ID: O15389
  ENST ID: ENST00000534261
  CDS Start-End: 401-2056
atctttctatcccagatgctccacagaacctcgccatcagcatcttcttcagaaatggcacaggcacagccccctgaggatctcactcatgactgaaacatcatttgaggggtgatcacctccagatcctcagctggacaagcctcacatcgtctgggggcctcagtatcttcacctgcggcgtccagtcggggtgggagcagaatggcttcccagcccccgcctcaccccaacagcacgtgatgcccaagttccccttctgtgcgcgtccacagctctcactcaccctccggcttcctgtcggggctttctcagccccaccccacgtttggacatttggagcatttccttccctgacagccggacctgggactgggctggggccctggcggatggagacatgctgcccctgctgctgctgcccctgctgtggggggggtccctgcaggagaagccagtgtacgagctgcaagtgcagaagtcggtgacggtgcaggagggcctgtgcgtccttgtgccctgctccttctcttacccctggagatcctggtattcctctcccccactctacgtctactggttccgggacggggagatcccatactacgctgaggttgtggccacaaacaacccagacagaagagtgaagccagagacccagggccgattccgcctccttggggatgtccagaagaagaactgctccctgagcatcggagatgccagaatggaggacacgggaagctatttcttccgcgtggagagaggaagggatgtaaaatatagctaccaacagaataagctgaacttggaggtgacagccctgatagagaaacccgacatccactttctggagcctctggagtccggccgccccacaaggctgagctgcagccttccaggatcctgtgaagcgggaccacctctcacattctcctggacggggaatgccctcagccccctggaccccgagaccacccgctcctcggagctcaccctcacccccaggcccgaggaccatggcaccaacctcacctgtcagatgaaacgccaaggagctcaggtgaccacggagagaactgtccagctcaatgtctcctatgctccacagaccatcaccatcttcaggaacggcatagccctagagatcctgcaaaacacctcataccttccggtcctggagggccaggctctgcggctgctctgtgatgctcccagcaacccccctgcacacctgagctggttccagggctcccctgccctgaacgccacccccatctccaataccgggatcttggagcttcgtcgagtaaggtctgcagaagaaggaggcttcacctgccgcgctcagcacccgctgggcttcctgcaaatttttctgaatctctcagtttactccctcccacagttgctgggcccctcctgctcctgggaggctgagggtctgcactgcagatgctcctttcgagcccggccggccccctccctgtgctggcggcttgaggagaagccgctggaggggaacagcagccagggctcattcaaggtcaactccagctcagctgggccctgggccaacagctccctgatcctccacggggggctcagctccgacctcaaagtcagctgcaaggcctggaacatctatgggtcccagagcggctctgtcctgctgctgcaagggagatcgaacctcgggacaggagtggttcctgcagcccttggtggtgctggtgtcatggccctgctctgtatctgtctgtgcctcatcttctttttaatagtgaaagcccgcaggaagcaagcagctgggagaccagagaaaatggatgatgaagaccccattatgggtaccatcacctcgggttccaggaagaagccctggccagacagccccggagatcaagcatctcctcctggggatgcccctcccttggaagaacaaaaggagctccattatgcctcccttagtttttctgagatgaagtcgagggagcctaaggaccaggaggccccaagcaccacggagtactcggagatcaagacaagcaagtgaggatttgcccagagttcagtcctggctggaggagccacagcctgtctgggggaaaggacaagtcagggaccacttgctgaagcacgaagagcccttgtggcaatgttaacattaactgatgtttaagtgctccaagcagatggaattagagaggtgggctcaaatctaggccctggcactgtcatcaagcaattcactgcatccctctgtgcctcagtttcccattctgtaaatcagagatcatgcatgctacctcaaaggttgttgtgaacattaaagaaatcaacacatggaaatcaaccaa

SEQ ID NO: 181343 - DNA, 1940 bp, Homo sapiens
  Payload ID: 15723
  Gene Symbol: SIGLEC6
  Gene Name: sialic acid binding Ig-like lectin 6
  Uniprot ID: O43699
  ENST ID: ENST00000346477
  CDS Start-End: 70-1383
cgcgctcctccccagccacccgttcctccccgcagtccttcccctccactcccttccccttctctgctcatgcagggagcccaggaagcctccgcctcagagatgctaccgctgctgctgcccctgctgtgggcaggggccctggctcaggagcggagattccagctggaggggccagagtcactgacggtgcaggagggtctgtgcgtcctcgtaccctgcagattgcccactacccttccagcctcgtactatggttatggctactggttcctggaaggggctgatgttccagtggccacaaacgacccagacgaagaagtgcaggaggagacccggggccgattccacctcctctgggatcccagaaggaagaactgctccctgagcatcagagatgcccggaggagggacaatgctgcatacttctttcggttgaagtccaaatggatgaaatacggttatacatcttccaagctctctgtgcgtgtgatggccctgacccacaggcccaacatctccatcccagggaccctggagtctggccatcccagcaatctgacctgctctgtgccctgggtctgtgagcaggggacgccccccatcttctcctggatgtcagctgcccccacctccctgggccccaggaccacccagtcctcggtgctcacaatcaccccacggccccaggaccacagcaccaacctcacctgtcaggtgacgttccctggagccggtgtgaccatggagagaaccatccagctcaatgtctcctccttcaaaatcctgcaaaacacctcgtccctccctgtcctggagggccaggctctgcggctgctctgtgatgctgacggcaacccccctgcacacctgagctggttccagggcttccccgccctgaacgccacccccatctccaataccggggtcctggagctgcctcaagtagggtctgcagaagaaggagatttcacctgccgtgctcagcatcctctgggctccctgcaaatctctctgagtctctttgtgcattggaaaccagaaggcagggctggtggtgtcctgggagcagtctggggagctagcatcacaaccctggttttcctctgtgtttgcttcatcttcagagtgaagactagaaggaagaaagcagcccagccagtgcaaaacacggatgatgtgaaccccgtcatggtctcaggctccaggggtcatcagcaccagttccagacaggcatagtttcagaccaccctgctgaggctggccccatctcagaagatgagcaggagctccactacgctgtcctacacttccacaaggtgcaacctcaggaaccaaaggtcaccgacactgagtactcagaaatcaagatacacaagtgaggaattgtccaaagccataaccttgattggagagaacatggtacctctcagtgtattggttactagggctgccacagcaatgtaccacaaaccgagtgacataaacacagaactttattttcgtatagtttcagatgttagaggtctgagaacaaggtgttatcagggttggtcccttctaaggcctctcttgttggcttgtagatggctgtctcctccttgtgtcttcacatggtctttcctctgagtgtgtttgtgtcctaatcttctcttcttataaagacactagtcatattggattagggcctccccatgacctaatttaaataaattaactatttaaagaccctccaaatacagtaaccttctgagatattgagatttaggacttccaacatatgaattttagaagggaacaatttagcccataacactgtgtccaattcttttaaaattaatgtttttgttgtaaatggactatataaataccttcgtatatatggcagaccacaggacttctgtccaagagaactgagttcaactccatctatgccagc

SEQ ID NO: 181344 - DNA, 1746 bp, Homo sapiens
  Payload ID: 15723
  Gene Symbol: SIGLEC6
  Gene Name: sialic acid binding Ig-like lectin 6
  Uniprot ID: O43699
  ENST ID: ENST00000343300
  CDS Start-End: 209-1270
gcgggacacagtctcttctcctctgctcttctttgggcaggtctctgggtctcaaagtttccgtctgctctgtgcagagggagtggagctccgagggcttgtggcttcgcagttcctcttctgtgaacagccgagatcacgcgctcctccccagccacccgttcctccccgcagtccttcccctccactcccttccccttctctgctcatgcagggagcccaggaagcctccgcctcagagatgctaccgctgctgctgcccctgctgtgggcaggggccctggctcaggagcggagattccagctggaggggccagagtcactgacggtgcaggagggtctgtgcgtcctcgtaccctgcagattgcccactacccttccagcctcgtactatggttatggctactggttcctggaaggggctgatgttccagtggccacaaacgacccagacgaagaagtgcaggaggagacccggggccgattccacctcctctgggatcccagaaggaagaactgctccctgagcatcagagatgcccggaggagggacaatgctgcatacttctttcggttgaagtccaaatggatgaaatacggttatacatcttccaagctctctgtgcgtgtgatggccctgacccacaggcccaacatctccatcccagggaccctggagtctggccatcccagcaatctgacctgctctgtgccctgggtctgtgagcaggggacgccccccatcttctcctggatgtcagctgcccccacctccctgggccccaggaccacccagtcctcggtgctcacaatcaccccacggccccaggaccacagcaccaacctcacctgtcaggtgacgttccctggagccggtgtgaccatggagagaaccatccagctcaatgtctcctatgctccacagaaagtggccatcagcatcttccaaggaaacagcgcagccttcaaaatcctgcaaaacacctcgtccctccctgtcctggagggccaggctctgcggctgctctgtgatgctgacggcaacccccctgcacacctgagctggttccagggcttccccgccctgaacgccacccccatctccaataccggggtcctggagctgcctcaagtagggtctgcagaagaaggagatttcacctgccgtgctcagcatcctctgggctccctgcaaatctctctgagtctctttgtgcattggtcatcagcaccagttccagacaggcatagtttcagaccaccctgctgaggctggccccatctcagaagatgagcaggagctccactacgctgtcctacacttccacaaggtgcaacctcaggaaccaaaggtcaccgacactgagtactcagaaatcaagatacacaagtgaggaattgtccaaagccataaccttgattggagagaacatggtacctctcagtgtattggttactagggctgccacagcaatgtaccacaaaccgagtgacataaacacagaactttattttcgtatagtttcagatgttagaggtctgagaacaaggtgttatcagggttggtcccttctaaggcctctcttgttggcttgtagatggctgtctcctccttgtgtcttcacatggtctttcctctgagtgtgtttgtgtcctaatcttctcttcttataaagacactagtcatattggattagggcctccccatgacctaatttaaataaattaactatttaaagaccctcc

SEQ ID NO: 181345 - DNA, 1811 bp, Homo sapiens
  Payload ID: 15723
  Gene Symbol: SIGLEC6
  Gene Name: sialic acid binding Ig-like lectin 6
  Uniprot ID: O43699
  ENST ID: ENST00000359982
  CDS Start-End: 147-1316
gtctgctctgtgcagagggagtggagctccgagggcttgtggcttcgcagttcctcttctgtgaacagccgagatcacgcgctcctccccagccacccgttcctccccgcagtccttcccctccactcccttccccttctctgctcatgcagggagcccaggaagcctccgcctcagagatgctaccgctgctgctgcccctgctgtgggcaggggccctggctcaggagcggagattccagctggaggggccagagtcactgacggtgcaggagggtctgtgcgtcctcgtaccctgcagattgcccactacccttccagcctcgtactatggttatggctactggttcctggaaggggctgatgttccagtggccacaaacgacccagacgaagaagtgcaggaggagacccggggccgattccacctcctctgggatcccagaaggaagaactgctccctgagcatcagagatgcccggaggagggacaatgctgcatacttctttcggttgaagtccaaatggatgaaatacggttatacatcttccaagctctctgtgcgtgtgatggccctgacccacaggcccaacatctccatcccagggaccctggagtctggccatcccagcaatctgacctgctctgtgccctgggtctgtgagcaggggacgccccccatcttctcctggatgtcagctgcccccacctccctgggccccaggaccacccagtcctcggtgctcacaatcaccccacggccccaggaccacagcaccaacctcacctgtcaggtgacgttccctggagccggtgtgaccatggagagaaccatccagctcaatgtctcctggatgttgaggcggccacctctttccaccccagatgctccacagaaagtggccatcagcatcttccaaggaaacagcgcagccttcaaaatcctgcaaaacacctcgtccctccctgtcctggagggccaggctctgcggctgctctgtgatgctgacggcaacccccctgcacacctgagctggttccagggcttccccgccctgaacgccacccccatctccaataccggggtcctggagctgcctcaagtagggtctgcagaagaaggagatttcacctgccgtgctcagcatcctctgggctccctgcaaatctctctgagtctctttgtgcattggaaaccagaaggcagggctggtggtgtcctgggagcagtctggggagctagcatcacaaccctggttttcctctgtgtttgcttcatcttcagggtcatcagcaccagttccagacaggcatagtttcagaccaccctgctgaggctggccccatctcagaagatgagcaggagctccactacgctgtcctacacttccacaaggtgcaacctcaggaaccaaaggtcaccgacactgagtactcagaaatcaagatacacaagtgaggaattgtccaaagccataaccttgattggagagaacatggtacctctcagtgtattggttactagggctgccacagcaatgtaccacaaaccgagtgacataaacacagaactttattttcgtatagtttcagatgttagaggtctgagaacaaggtgttatcagggttggtcccttctaaggcctctcttgttggcttgtagatggctgtctcctccttgtgtcttcacatggtctttcctctgagtgtgtttgtgtcctaatcttctcttcttataaagacactagtcatattggattagggcctccccatgacctaatttaaataaattaactatttaaagaccctcc

SEQ ID NO: 181346 - DNA, 1391 bp, Homo sapiens
  Payload ID: 15723
  Gene Symbol: SIGLEC6
  Gene Name: sialic acid binding Ig-like lectin 6
  Uniprot ID: O43699
  ENST ID: ENST00000391797
  CDS Start-End: 156-1184
aaagtttccgtctgctctgtgcagagggagtggagctccgagggcttgtggcttcgcagttcctcttctgtgaacagccgagatcacgcgctcctccccagccacccgttcctccccgcagtccttcccctccactcccttccccttctctgctcatgcagggagcccaggaagcctccgcctcagagatgctaccgctgctgctgcccctgctgtgggcaggggccctggctcaggagcggagattccagctggaggggccagagtcactgacggtgcaggagggtctgtgcgtcctcgtaccctgcagattgcccactacccttccagcctcgtactatggttatggctactggttcctggaaggggctgatgttccagtggccacaaacgacccagacgaagaagtgcaggaggagacccggggccgattccacctcctctgggatcccagaaggaagaactgctccctgagcatcagagatgcccggaggagggacaatgctgcatacttctttcggttgaagtccaaatggatgaaatacggttatacatcttccaagctctctgtgcgtgtgatggggaccctggagtctggccatcccagcaatctgacctgctctgtgccctgggtctgtgagcaggggacgccccccatcttctcctggatgtcagctgcccccacctccctgggccccaggaccacccagtcctcggtgctcacaatcaccccacggccccaggaccacagcaccaacctcacctgtcaggtgacgttccctggagccggtgtgaccatggagagaaccatccagctcaatgtctcctatgctccacagaaagtggccatcagcatcttccaaggaaacagcgcagccttcaaaatcctgcaaaacacctcgtccctccctgtcctggagggccaggctctgcggctgctctgtgatgctgacggcaacccccctgcacacctgagctggttccagggcttccccgccctgaacgccacccccatctccaataccggggtcctggagctgcctcaagtagggtctgcagaagaaggagatttcacctgccgtgctcagcatcctctgggctccctgcaaatctctctgagtctctttgtgcattggtcatcagcaccagttccagacaggcatagtttcagaccaccctgctgaggctggccccatctcagaagatgagcaggagctccactacgctgtcctacacttccacaaggtgcaacctcaggaaccaaaggtcaccgacactgagtactcagaaatcaagatacacaagtgaggaattgtccaaagccataaccttgattggagagaacatggtacctctcagtgtattggttactagggctgccacagcaatgt

SEQ ID NO: 181347 - DNA, 1852 bp, Homo sapiens
  Payload ID: 15723
  Gene Symbol: SIGLEC6
  Gene Name: sialic acid binding Ig-like lectin 6
  Uniprot ID: O43699
  ENST ID: ENST00000425629
  CDS Start-End: 156-1517
aaagtttccgtctgctctgtgcagagggagtggagctccgagggcttgtggcttcgcagttcctcttctgtgaacagccgagatcacgcgctcctccccagccacccgttcctccccgcagtccttcccctccactcccttccccttctctgctcatgcagggagcccaggaagcctccgcctcagagatgctaccgctgctgctgcccctgctgtgggcaggggccctggctcaggagcggagattccagctggaggggccagagtcactgacggtgcaggagggtctgtgcgtcctcgtaccctgcagattgcccactacccttccagcctcgtactatggttatggctactggttcctggaaggggctgatgttccagtggccacaaacgacccagacgaagaagtgcaggaggagacccggggccgattccacctcctctgggatcccagaaggaagaactgctccctgagcatcagagatgcccggaggagggacaatgctgcatacttctttcggttgaagtccaaatggatgaaatacggttatacatcttccaagctctctgtgcgtgtgatggccctgacccacaggcccaacatctccatcccagggaccctggagtctggccatcccagcaatctgacctgctctgtgccctgggtctgtgagcaggggacgccccccatcttctcctggatgtcagctgcccccacctccctgggccccaggaccacccagtcctcggtgctcacaatcaccccacggccccaggaccacagcaccaacctcacctgtcaggtgacgttccctggagccggtgtgaccatggagagaaccatccagctcaatgtctcctatgctccacagaaagtggccatcagcatcttccaaggaaacagcgcagccttcaaaatcctgcaaaacacctcgtccctccctgtcctggagggccaggctctgcggctgctctgtgatgctgacggcaacccccctgcacacctgagctggttccagggcttccccgccctgaacgccacccccatctccaataccggggtcctggagctgcctcaagtagggtctgcagaagaaggagatttcacctgccgtgctcagcatcctctgggctccctgcaaatctctctgagtctctttgtgcattggaaaccagaaggcagggctggtggtgtcctgggagcagtctggggagctagcatcacaaccctggttttcctctgtgtttgcttcatcttcagagtgaagactagaaggaagaaagcagcccagccagtgcaaaacacggatgatgtgaaccccgtcatggtctcaggctccaggggtcatcagcaccagttccagacaggcatagtttcagaccaccctgctgaggctggccccatctcagaagatgagcaggagctccactacgctgtcctacacttccacaaggtgcaacctcaggaaccaaaggtcaccgacactgagtactcagaaatcaagatacacaagtgaggaattgtccaaagccataaccttgattggagagaacatggtacctctcagtgtattggttactagggctgccacagcaatgtaccacaaaccgagtgacataaacacagaactttattttcgtatagtttcagatgttagaggtctgagaacaaggtgttatcagggttggtcccttctaaggcctctcttgttggcttgtagatggctgtctcctccttgtgtcttcacatggtctttcctctgagtgtgtttgtgtcctaatcttctcttcttataaagacactagtcatattggattagggcctccccatgacctaatttaaataaattaa

SEQ ID NO: 181348 - DNA, 1713 bp, Homo sapiens
  Payload ID: 15723
  Gene Symbol: SIGLEC6
  Gene Name: sialic acid binding Ig-like lectin 6
  Uniprot ID: O43699
  ENST ID: ENST00000436458
  CDS Start-End: 156-1361
aaagtttccgtctgctctgtgcagagggagtggagctccgagggcttgtggcttcgcagttcctcttctgtgaacagccgagatcacgcgctcctccccagccacccgttcctccccgcagtccttcccctccactcccttccccttctctgctcatgcagggagcccaggaagcctccgcctcagagatgctaccgctgctgctgcccctgctgtgggcagcctcgtactatggttatggctactggttcctggaaggggctgatgttccagtggccacaaacgacccagacgaagaagtgcaggaggagacccggggccgattccacctcctctgggatcccagaaggaagaactgctccctgagcatcagagatgcccggaggagggacaatgctgcatacttctttcggttgaagtccaaatggatgaaatacggttatacatcttccaagctctctgtgcgtgtgatggccctgacccacaggcccaacatctccatcccagggaccctggagtctggccatcccagcaatctgacctgctctgtgccctgggtctgtgagcaggggacgccccccatcttctcctggatgtcagctgcccccacctccctgggccccaggaccacccagtcctcggtgctcacaatcaccccacggccccaggaccacagcaccaacctcacctgtcaggtgacgttccctggagccggtgtgaccatggagagaaccatccagctcaatgtctcctccttcaaaatcctgcaaaacacctcgtccctccctgtcctggagggccaggctctgcggctgctctgtgatgctgacggcaacccccctgcacacctgagctggttccagggcttccccgccctgaacgccacccccatctccaataccggggtcctggagctgcctcaagtagggtctgcagaagaaggagatttcacctgccgtgctcagcatcctctgggctccctgcaaatctctctgagtctctttgtgcattggaaaccagaaggcagggctggtggtgtcctgggagcagtctggggagctagcatcacaaccctggttttcctctgtgtttgcttcatcttcagagtgaagactagaaggaagaaagcagcccagccagtgcaaaacacggatgatgtgaaccccgtcatggtctcaggctccaggggtcatcagcaccagttccagacaggcatagtttcagaccaccctgctgaggctggccccatctcagaagatgagcaggagctccactacgctgtcctacacttccacaaggtgcaacctcaggaaccaaaggtcaccgacactgagtactcagaaatcaagatacacaagtgaggaattgtccaaagccataaccttgattggagagaacatggtacctctcagtgtattggttactagggctgccacagcaatgtaccacaaaccgagtgacataaacacagaactttattttcgtatagtttcagatgttagaggtctgagaacaaggtgttatcagggttggtcccttctaaggcctctcttgttggcttgtagatggctgtctcctccttgtgtcttcacatggtctttcctctgagtgtgtttgtgtcctaatcttctcttcttataaagacactagtcatattggattagggcctccccatgacctaatttaaataaattaactatttaaagaccctcc

SEQ ID NO: 181349 - DNA, 1469 bp, Homo sapiens
  Payload ID: 15724
  Gene Symbol: SIGLEC7
  Gene Name: sialic acid binding Ig-like lectin 7
  Uniprot ID: Q9Y286
  ENST ID: ENST00000305628
  CDS Start-End: 64-1188
cctgagagaagaaccctgaggaacagacgttccctcgcggccctggcacctccaaccccagatatgctgctgctgctgctgctgcccctgctctgggggagggagagggtggaaggacagaagagtaaccggaaggattactcgctgacgatgcagagttccgtgaccgtgcaagagggcatgtgtgtccatgtgcgctgctccttctcctacccagtggacagccagactgactctgacccagttcatggctactggttccgggcagggaatgatataagctggaaggctccagtggccacaaacaacccagcttgggcagtgcaggaggaaactcgggaccgattccacctccttggggacccacagaccaaaaattgcaccctgagcatcagagatgccagaatgagtgatgcggggagatacttctttcgtatggagaaaggaaatataaaatggaattataaatatgaccagctctctgtgaacgtgacagaccctcctcagaacttgactgtgactgtcttccaaggagaaggcacagcatccacagctctggggaacagctcatctctttcagtcctagagggccagtctctgcgcttggtctgtgctgttgacagcaatccccctgccaggctgagctggacctggaggagtctgaccctgtacccctcacagccctcaaaccctctggtactggagctgcaagtgcacctgggggatgaaggggaattcacctgtcgagctcagaactctctgggttcccagcacgtttccctgaacctctccctgcaacaggagtacacaggcaaaatgaggcctgtatcaggagtgttgctgggggcggtcgggggagctggagccacagccctggtcttcctctccttctgtgtcatcttcattgtagtgaggtcctgcaggaagaaatcggcaaggccagcagcggacgtgggagacataggcatgaaggatgcaaacaccatcaggggctcagcctctcagggtaacctgactgagtcctgggcagatgataacccccgacaccatggcctggctgcccactcctcaggggaggaaagagagatccagtatgcacccctcagctttcataagggggagcctcaggacctatcaggacaagaagccaccaacaatgagtactcagagatcaagatccccaagtaagaaaatgcagaggctcgggcttgtttgagggttcacgacccctccagcaaaggagtctgaggctgattccagtagaattagcagccctcaatgctgtgcaacaagacatcagaacttattcctcttgtctaactgaaaatgcatgcctgatgaccaaactctccctttccccatccaatcggtccacactccccgccctggcctctggtacccaccattctcctctgtacttctctaaggatgactactttagattccgaatatagtgagattgtaacgtg

SEQ ID NO: 181350 - DNA, 1754 bp, Homo sapiens
  Payload ID: 15724
  Gene Symbol: SIGLEC7
  Gene Name: sialic acid binding Ig-like lectin 7
  Uniprot ID: Q9Y286
  ENST ID: ENST00000317643
  CDS Start-End: 70-1473
gcagttcctgagagaagaaccctgaggaacagacgttccctcgcggccctggcacctccaaccccagatatgctgctgctgctgctgctgcccctgctctgggggagggagagggtggaaggacagaagagtaaccggaaggattactcgctgacgatgcagagttccgtgaccgtgcaagagggcatgtgtgtccatgtgcgctgctccttctcctacccagtggacagccagactgactctgacccagttcatggctactggttccgggcagggaatgatataagctggaaggctccagtggccacaaacaacccagcttgggcagtgcaggaggaaactcgggaccgattccacctccttggggacccacagaccaaaaattgcaccctgagcatcagagatgccagaatgagtgatgcggggagatacttctttcgtatggagaaaggaaatataaaatggaattataaatatgaccagctctctgtgaacgtgacagccttgacccacaggcccaacatccttatccccggtaccctggagtctggctgcttccagaatctgacctgctctgtgccctgggcctgtgagcaggggacgccccctatgatctcctggatggggacctctgtgtcccccctgcacccctccaccacccgctcctcagtgctcaccctcatcccacagccccagcaccacggcaccagcctcacctgtcaggtgaccttgcctggggccggcgtgaccacgaacaggaccatccaactcaatgtgtcctaccctcctcagaacttgactgtgactgtcttccaaggagaaggcacagcatccacagctctggggaacagctcatctctttcagtcctagagggccagtctctgcgcttggtctgtgctgttgacagcaatccccctgccaggctgagctggacctggaggagtctgaccctgtacccctcacagccctcaaaccctctggtactggagctgcaagtgcacctgggggatgaaggggaattcacctgtcgagctcagaactctctgggttcccagcacgtttccctgaacctctccctgcaacaggagtacacaggcaaaatgaggcctgtatcaggagtgttgctgggggcggtcgggggagctggagccacagccctggtcttcctctccttctgtgtcatcttcattgtagtgaggtcctgcaggaagaaatcggcaaggccagcagcggacgtgggagacataggcatgaaggatgcaaacaccatcaggggctcagcctctcagggtaacctgactgagtcctgggcagatgataacccccgacaccatggcctggctgcccactcctcaggggaggaaagagagatccagtatgcacccctcagctttcataagggggagcctcaggacctatcaggacaagaagccaccaacaatgagtactcagagatcaagatccccaagtaagaaaatgcagaggctcgggcttgtttgagggttcacgacccctccagcaaaggagtctgaggctgattccagtagaattagcagccctcaatgctgtgcaacaagacatcagaacttattcctcttgtctaactgaaaatgcatgcctgatgaccaaactctccctttccccatccaatcggtccacactccccgccctggcctctggtacccaccattctcctctgtacttctctaaggatgactactttagattccgaatatagtgagattgtaacgtg

SEQ ID NO: 181351 - DNA, 713 bp, Homo sapiens
  Payload ID: 15724
  Gene Symbol: SIGLEC7
  Gene Name: sialic acid binding Ig-like lectin 7
  Uniprot ID: Q9Y286
  ENST ID: ENST00000536156
  CDS Start-End: 1-438
atgctgctgctgctgctgctgcccctgctctgggggagggagagggtggaaggacagaagagtaaccggaaggattactcgctgacgatgcagagttccgtgaccgtgcaagagggcatgtgtgtccatgtgcgctgctccttctcctacccagtggacagccagactgactctgacccagttcatggctactggttccgggcagggaatgatataagctggaaggctccagtggccacaaacaacccagcttgggcagtgcaggaggaaactcgggaccgattccacctccttggggacccacagaccaaaaattgcaccctgagcatcagagatgccagaatgagtgatgcggggagatacttctttcgtatggagaaaggaaatataaaatggaattataaatatgaccagctctctgtgaacgtgacagagtgaggtcctgcaggaagaaatcggcaaggccagcagcggacgtgggagacataggcatgaaggatgcaaacaccatcaggggctcagcctctcagggtaacctgactgagtcctgggcagatgataacccccgacaccatggcctggctgcccactcctcaggggaggaaagagagatccagtatgcacccctcagctttcataagggggagcctcaggacctatcaggacaagaagccaccaacaatgagtactcagagatcaagatccccaagtaa

SEQ ID NO: 181352 - DNA, 627 bp, Homo sapiens
  Payload ID: 15724
  Gene Symbol: SIGLEC7
  Gene Name: sialic acid binding Ig-like lectin 7
  ENST ID: ENST00000601682
  CDS Start-End: 72-627
ccgcagttcctgagagaagaaccctgaggaacagacgttccctcgcggccctggcacctccaaccccagatatgctgctgctgctgctgctgcccctgctctgggggagggagagggtggaaggacagaagagtaaccggaaggattactcgctgacgatgcagagttccgtgaccgtgcaagagggcatgtgtgtccatgtgcgctgctccttctcctacccagtggacagccagactgactctgacccagttcatggctactggttccgggcagggaatgatataagctggaaggctccagtggccacaaacaacccagcttgggcagtgcaggaggaaactcgggaccgattccacctccttggggacccacagaccaaaaattgcaccctgagcatcagagatgccagaatgagtgatgcggggagatacttctttcgtatggagaaaggaaatataaaatggaattataaatatgaccagctctctgtgaacgtgacagccccagcaccacggcaccagcctcacctgtcaggtgaccttgcctggggccggcgtgaccacgaacaggaccatccaactcaatgtgtcctgtctccatgtctttctgtcccagaccctcctc

SEQ ID NO: 181353 - DNA, 616 bp, Homo sapiens
  Payload ID: 15724
  Gene Symbol: SIGLEC7
  Gene Name: sialic acid binding Ig-like lectin 7
  Uniprot ID: Q9Y286
  ENST ID: ENST00000600577
  CDS Start-End: 1-438
atgctgctgctgctgctgctgcccctgctctgggggagggagagggtggaaggacagaagagtaaccggaaggattactcgctgacgatgcagagttccgtgaccgtgcaagagggcatgtgtgtccatgtgcgctgctccttctcctacccagtggacagccagactgactctgacccagttcatggctactggttccgggcagggaatgatataagctggaaggctccagtggccacaaacaacccagcttgggcagtgcaggaggaaactcgggaccgattccacctccttggggacccacagaccaaaaattgcaccctgagcatcagagatgccagaatgagtgatgcggggagatacttctttcgtatggagaaaggaaatataaaatggaattataaatatgaccagctctctgtgaacgtgacagggtaacctgactgagtcctgggcagatgataacccccgacaccatggcctggctgcccactcctcaggggaggaaagagagatccagtatgcacccctcagctttcataagggggagcctcaggacctatcaggacaagaagccaccaacaatgagtactcagagatcaagatccccaagtaa

SEQ ID NO: 181354 - DNA, 2949 bp, Homo sapiens
  Payload ID: 15725
  Gene Symbol: SIGLEC8
  Gene Name: sialic acid binding Ig-like lectin 8
  Uniprot ID: Q9NYZ4
  ENST ID: ENST00000321424
  CDS Start-End: 68-1567
agtttctgagagaagaaccctgaggaacagacgttccctggcggccctggcgccttcaaacccagacatgctgctgctgctgctgctgctgcccctgctctgggggacaaaggggatggagggagacagacaatatggggatggttacttgctgcaagtgcaggagctggtgacggtgcaggagggcctgtgtgtccatgtgccctgctccttctcctacccccaggatggctggactgactctgacccagttcatggctactggttccgggcaggagacagaccataccaagacgctccagtggccacaaacaacccagacagagaagtgcaggcagagacccagggccgattccaactccttggggacatttggagcaacgactgctccctgagcatcagagacgccaggaagagggataaggggtcatatttctttcggctagagagaggaagcatgaaatggagttacaaatcacagttgaattacaaaactaagcagctgtctgtgtttgtgacagccctgacccataggcctgacatcctcatcctagggaccctagagtctggccactccaggaacctgacctgctctgtgccctgggcctgtaagcaggggacaccccccatgatctcctggattggggcctccgtgtcctccccgggccccactactgcccgctcctcagtgctcacccttaccccaaagccccaggaccacggcaccagcctcacctgtcaggtgaccttgcctgggacaggtgtgaccacgaccagtaccgtccgcctcgatgtgtcctaccctccttggaacttgaccatgactgtcttccaaggagatgccacagcatccacagccctgggaaatggctcatctctttcagtccttgagggccagtctctgcgcctggtctgtgctgtcaacagcaatccccctgccaggctgagctggacccgggggagcctgaccctgtgcccctcacggtcctcaaaccctgggctgctggagctgcctcgagtgcacgtgagggatgaaggggaattcacctgccgagctcagaacgctcagggctcccagcacatttccctgagcctctccctgcagaatgagggcacaggcacctcaagacctgtatcacaagtgacactggcagcagtcgggggagctggagccacagccctggccttcctgtccttctgcatcatcttcatcatagtgaggtcctgcaggaagaaatcggcaaggccagcagcgggcgtgggggatacaggcatggaagatgcaaaggccatcaggggctcggcctctcagggacccctgactgaatcctggaaagatggcaaccccctgaagaagcctcccccagctgttgccccctcgtcaggggaggaaggagagctccattatgcaaccctcagcttccataaagtgaagcctcaggacccgcagggacaggaggccactgacagtgaatactcggagatcaagatccacaagcgagaaactgcagagactcaggcctgtttgaggaatcacaacccctccagcaaagaagtcagaggctgattctcatagaacaagaaccctctagagccccatgctatgcagtaggtcaccagggctccctcctcctgtctaaccaaaacttggaccaatgtctcccctttccccggctaccagggacccatccctgcctctagcttctactacccaccattctcctctcgacctctctgaggttgactattttagattccacatagagatgaggtcatgtggtacttgcctctctgtgtgtggctcattttacacaaaaaaatatcccctaggttcatccatgttctctcaaatgacagaatcaagcactgaatatttttttttctttgagagatggagtttcgctctgttgcccaggctggagtgcagtggttcaatctctgctcactgcaacctccacctcctgggttcaaacgattctcctgcctcagcttcccaagtagctggtactacaggcgtgtgtcaccacgcccagctaatttttgtattttttagtagagacggggtttcactataagtgggccaggctagtctcaaactcctgacctcaagtgatctgcctgccttggcctcccaaagtgctgggatttcaggcatgagccaccgcacccagcttgcattgaatattttcaaggagctaaaagaagattttaaatggtctcacaaaaacagataaatatttgcacagatgggtgtgctaatcattgtgccttgatggttccacgatgtatccgggtgtggaaatctcactgggtctctctcaaggccactcggctactcaggacagggctggaatttaaagcctgtccgattctgaggtctcttctctcatctagcactgagtcaagcaatcagcaggctgggcaccccttagccataagttttcaggaaataaattccttgagggcattgacttttacaaaagagggagcagcaatggcctagagtctcaggaacaagacaggtgcactgaggagatgaaggccgggaccccctgcccaacctgtatggcgggtctgtacttattttgtttacccccaatttaaaacgtttttttttattgcaggttgtttgtttgatatggtttggctgtgtccccacccaaatcttatctagaattgtaatcagaattataatccccatgtgttgggggagggacctggtgggaggtgataggatcatgggggtggttcccccatgctgttctgatagtgagtgagttatcacgagatctgatggttttgtaagtggtggtttcccctgctcttctctcttgcctgccaccatgtaagatgtgcctggttccccttccgccatgattgtaagtttcctgaggcctcccccgccatgtggaactgtgagtcaattacacctctttcatttataaatta

SEQ ID NO: 181355 - DNA, 1293 bp, Homo sapiens
  Payload ID: 15725
  Gene Symbol: SIGLEC8
  Gene Name: sialic acid binding Ig-like lectin 8
  Uniprot ID: Q9NYZ4
  ENST ID: ENST00000340550
  CDS Start-End: 70-1290
tcagtttctgagagaagaaccctgaggaacagacgttccctggcggccctggcgccttcaaacccagacatgctgctgctgctgctgctgctgcccctgctctgggggacaaaggggatggagggagacagacaatatggggatggttacttgctgcaagtgcaggagctggtgacggtgcaggagggcctgtgtgtccatgtgccctgctccttctcctacccccaggatggctggactgactctgacccagttcatggctactggttccgggcaggagacagaccataccaagacgctccagtggccacaaacaacccagacagagaagtgcaggcagagacccagggccgattccaactccttggggacatttggagcaacgactgctccctgagcatcagagacgccaggaagagggataaggggtcatatttctttcggctagagagaggaagcatgaaatggagttacaaatcacagttgaattacaaaactaagcagctgtctgtgtttgtgacagaccctccttggaacttgaccatgactgtcttccaaggagatgccacagcatccacagccctgggaaatggctcatctctttcagtccttgagggccagtctctgcgcctggtctgtgctgtcaacagcaatccccctgccaggctgagctggacccgggggagcctgaccctgtgcccctcacggtcctcaaaccctgggctgctggagctgcctcgagtgcacgtgagggatgaaggggaattcacctgccgagctcagaacgctcagggctcccagcacatttccctgagcctctccctgcagaatgagggcacaggcacctcaagacctgtatcacaagtgacactggcagcagtcgggggagctggagccacagccctggccttcctgtccttctgcatcatcttcatcatagtgaggtcctgcaggaagaaatcggcaaggccagcagcgggcgtgggggatacaggcatggaagatgcaaaggccatcaggggctcggcctctcagggacccctgactgaatcctggaaagatggcaaccccctgaagaagcctcccccagctgttgccccctcgtcaggggaggaaggagagctccattatgcaaccctcagcttccataaagtgaagcctcaggacccgcagggacaggaggccactgacagtgaatactcggagatcaagatccacaagcgagaaactgcagagactcaggcctgtttgaggaatcacaacccctccagcaaagaagtcagaggctgattc

SEQ ID NO: 181356 - DNA, 1528 bp, Homo sapiens
  Payload ID: 15725
  Gene Symbol: SIGLEC8
  Gene Name: sialic acid binding Ig-like lectin 8
  ENST ID: ENST00000430817
  CDS Start-End: 66-1238
tttctgagagaagaaccctgaggaacagacgttccctggcggccctggcgccttcaaacccagacatgctgctgctgctgctgctgctgcccctgctctgggggacaaaggggatggagggagacagacaatatggggatggttacttgctgcaagtgcaggagctggtgacggtgcaggagggcctgtgtgtccatgtgccctgctccttctcctacccccaggatggctggactgactctgacccagttcatggctactggttccgggcaggagacagaccataccaagacgctccagtggccacaaacaacccagacagagaagtgcaggcagagacccagggccgattccaactccttggggacatttggagcaacgactgctccctgagcatcagagacgccaggaagagggataaggggtcatatttctttcggctagagagaggaagcatgaaatggagttacaaatcacagttgaattacaaaactaagcagctgtctgtgtttgtgacagcatccacagccctgggaaatggctcatctctttcagtccttgagggccagtctctgcgcctggtctgtgctgtcaacagcaatccccctgccaggctgagctggacccgggggagcctgaccctgtgcccctcacggtcctcaaaccctgggctgctggagctgcctcgagtgcacgtgagggatgaaggggaattcacctgccgagctcagaacgctcagggctcccagcacatttccctgagcctctccctgcagaatgagggcacaggcacctcaagacctgtatcacaagtgacactggcagcagtcgggggagctggagccacagccctggccttcctgtccttctgcatcatcttcatcatagtgaggtcctgcaggaagaaatcggcaaggccagcagcgggcgtgggggatacaggcatggaagatgcaaaggccatcaggggctcggcctctcagggacccctgactgaatcctggaaagatggcaaccccctgaagaagcctcccccagctgttgccccctcgtcaggggaggaaggagagctccattatgcaaccctcagcttccataaagtgaagcctcaggacccgcagggacaggaggccactgacagtgaatactcggagatcaagatccacaagcgagaaactgcagagactcaggcctgtttgaggaatcacaacccctccagcaaagaagtcagaggctgattctcatagaacaagaaccctctagagccccatgctatgcaatgtgcctggttccccttccgccatgattgtaagtttcctgaggcctcccccgccatgtggaactgtgagtcaattacacctctttcatttataaattactcagtctcaggtatttcttaatagcagtgtgaaaacaggctaacacattgttctttgaaatttaaaaatagcgttagcttttcagttgaatcacgcagctcttacatgtgccatgccatgagtgttgccaaacatgcacccctgtgtaa

SEQ ID NO: 181357 - DNA, 1690 bp, Homo sapiens
  Payload ID: 15726
  Gene Symbol: SIGLEC9
  Gene Name: sialic acid binding Ig-like lectin 9
  Uniprot ID: Q9Y336
  ENST ID: ENST00000250360
  CDS Start-End: 68-1459
agttcctgagagaagaaccctgaggaacagacgttccctcgcggccctggcacctctaaccccagacatgctgctgctgctgctgcccctgctctgggggagggagagggcggaaggacagacaagtaaactgctgacgatgcagagttccgtgacggtgcaggaaggcctgtgtgtccatgtgccctgctccttctcctacccctcgcatggctggatttaccctggcccagtagttcatggctactggttccgggaaggggccaatacagaccaggatgctccagtggccacaaacaacccagctcgggcagtgtgggaggagactcgggaccgattccacctccttggggacccacataccaagaattgcaccctgagcatcagagatgccagaagaagtgatgcggggagatacttctttcgtatggagaaaggaagtataaaatggaattataaacatcaccggctctctgtgaatgtgacagccttgacccacaggcccaacatcctcatcccaggcaccctggagtccggctgcccccagaatctgacctgctctgtgccctgggcctgtgagcaggggacaccccctatgatctcctggatagggacctccgtgtcccccctggacccctccaccacccgctcctcggtgctcaccctcatcccacagccccaggaccatggcaccagcctcacctgtcaggtgaccttccctggggccagcgtgaccacgaacaagaccgtccatctcaacgtgtcctacccgcctcagaacttgaccatgactgtcttccaaggagacggcacagtatccacagtcttgggaaatggctcatctctgtcactcccagagggccagtctctgcgcctggtctgtgcagttgatgcagttgacagcaatccccctgccaggctgagcctgagctggagaggcctgaccctgtgcccctcacagccctcaaacccgggggtgctggagctgccttgggtgcacctgagggatgcagctgaattcacctgcagagctcagaaccctctcggctctcagcaggtctacctgaacgtctccctgcagagcaaagccacatcaggagtgactcagggggtggtcgggggagctggagccacagccctggtcttcctgtccttctgcgtcatcttcgttgtagtgaggtcctgcaggaagaaatcggcaaggccagcagcgggcgtgggagatacgggcatagaggatgcaaacgctgtcaggggttcagcctctcaggggcccctgactgaaccttgggcagaagacagtcccccagaccagcctcccccagcttctgcccgctcctcagtgggggaaggagagctccagtatgcatccctcagcttccagatggtgaagccttgggactcgcggggacaggaggccactgacaccgagtactcggagatcaagatccacagatgagaaactgcagagactcaccctgattgagggatcacagcccctccaggcaagggagaagtcagaggctgattcttgtagaattaacagccctcaacgtgatgagctatgataacactatgaattatgtgcagagtgaaaagcacacaggctttagagtcaaagtatctcaaacctgaatccacactgtgccctcccttttatttttttaactaaaagacagacaaattccta

SEQ ID NO: 181358 - DNA, 1960 bp, Homo sapiens
  Payload ID: 15726
  Gene Symbol: SIGLEC9
  Gene Name: sialic acid binding Ig-like lectin 9
  Uniprot ID: Q9Y336
  ENST ID: ENST00000440804
  CDS Start-End: 68-1507
agttcctgagagaagaaccctgaggaacagacgttccctcgcggccctggcacctctaaccccagacatgctgctgctgctgctgcccctgctctgggggagggagagggcggaaggacagacaagtaaactgctgacgatgcagagttccgtgacggtgcaggaaggcctgtgtgtccatgtgccctgctccttctcctacccctcgcatggctggatttaccctggcccagtagttcatggctactggttccgggaaggggccaatacagaccaggatgctccagtggccacaaacaacccagctcgggcagtgtgggaggagactcgggaccgattccacctccttggggacccacataccaagaattgcaccctgagcatcagagatgccagaagaagtgatgcggggagatacttctttcgtatggagaaaggaagtataaaatggaattataaacatcaccggctctctgtgaatgtgacagccttgacccacaggcccaacatcctcatcccaggcaccctggagtccggctgcccccagaatctgacctgctctgtgccctgggcctgtgagcaggggacaccccctatgatctcctggatagggacctccgtgtcccccctggacccctccaccacccgctcctcggtgctcaccctcatcccacagccccaggaccatggcaccagcctcacctgtcaggtgaccttccctggggccagcgtgaccacgaacaagaccgtccatctcaacgtgtcctacccgcctcagaacttgaccatgactgtcttccaaggagacggcacagtatccacagtcttgggaaatggctcatctctgtcactcccagagggccagtctctgcgcctggtctgtgcagttgatgcagttgacagcaatccccctgccaggctgagcctgagctggagaggcctgaccctgtgcccctcacagccctcaaacccgggggtgctggagctgccttgggtgcacctgagggatgcagctgaattcacctgcagagctcagaaccctctcggctctcagcaggtctacctgaacgtctccctgcagagcaaagccacatcaggagtgactcagggggtggtcgggggagctggagccacagccctggtcttcctgtccttctgcgtcatcttcgttgtagtgaggtcctgcaggaagaaatcggcaaggccagcagcgggcgtgggagatacgggcatagaggatgcaaacgctgtcaggggttcagcctctcagatcttgaatcattttattggatttcctacattccttggactgggtttcgagtttctcctgaatctccgtgatctttgttgccatccagattctgaattctatgtctatcatttcagtcatttcagactcattaagaacattgctggggagatagtgtggtcacttgaaggtaaaatactctggcttttggatgtgtcagatttctttcactggttcttcctcatctgtgtgggctgatgttcctttaatctttgaagttgctgttctttggatagggctctttgcttttatattctctgatgcccttgagggtttcacagtggtataacttgggcttagacaactgcatttgtttctggatgatttcaaggggcccaggctcaactcagcactcctgagctgcatgctctaactacagggacctgggacctggcccatggcttttttttttttttttcctggcccttcaaggttaagcacctcctatgctggaatggccaaggtgttccgggtccactggcaacaacgctccaataggggttgctgacaaagcattttggcagggtggccatgggtgatgggagttcctgcacgtggtgtgcatcagctgcagggtggccgtgggtcttgcaaatctgcttgctaatgttatgcctaagatcacgttataaaagactaacttgtgcctca

SEQ ID NO: 181359 - DNA, 614 bp, Homo sapiens
  Payload ID: 15726
  Gene Symbol: SIGLEC9
  Gene Name: sialic acid binding Ig-like lectin 9
  ENST ID: ENST00000599948
  CDS Start-End: 1-614
tatccacagtcttgggaaatggctcatctctgtcactcccagagggccagtctctgcgcctggtctgtgcagttgatgcagttgacagcaatccccctgccaggctgagcctgagctggagaggcctgaccctgtgcccctcacagccctcaaacccgggggtgctggagctgccttgggtgcacctgagggatgcagctgaattcacctgcagagctcagaaccctctcggctctcagcaggtctacctgaacgtctccctgcagagcaaagccacatcaggagtgactcagggggtggtcgggggagctggagccacagccctggtcttcctgtccttctgcgtcatcttcgttgtagtgaggtcctgcaggaagaaatcggcaaggccagcagcgggcgtgggagatacgggcatagaggatgcaaacgctgtcaggggttcagcctctcagaagacatcatcgtccagttcctctgcatttgaacagctgttcccccacccctcaataccgtttagagcagaagccagcaaatactatctgtcagggacagatagaaactattttcggcttcatgggccacacagtctcattgcagctcctcaaatctgc

SEQ ID NO: 181360 - DNA, 2045 bp, Homo sapiens
  Payload ID: 15727
  Gene Symbol: NEU1
  Gene Name: sialidase 1 (lysosomal sialidase)
  Uniprot ID: Q99519
  ENST ID: ENST00000229725
  CDS Start-End: 131-1378
cgggaagcgcggcggggcctccagaccggggcgggcttaagggtgacatctgcgctttaaagggtccgggtcagctgactcccgactctgtggagtctagctgccagggtcgcggcagctgcggggagagatgactggggagcgacccagcacggcgctcccggacagacgctgggggccgcggattctgggcttctggggaggctgtagggtttgggtgtttgccgcgatcttcctgctgctgtctctggcagcctcctggtccaaggctgagaacgacttcggtctggtgcagccgctggtgaccatggagcaactgctgtgggtgagcgggagacagatcggctcagtggacaccttccgcatcccgctcatcacagccactccgcggggcactcttctcgcctttgctgaggcgaggaaaatgtcctcatccgatgagggggccaagttcatcgccctgcggaggtccatggaccagggcagcacatggtctcctacagcgttcattgtcaatgatggggatgtccccgatgggctgaaccttggggcagtagtgagcgatgttgagacaggagtagtatttcttttctactccctttgtgctcacaaggccggctgccaggtggcctctaccatgttggtatggagcaaggatgatggtgtttcctggagcacaccccggaatctctccctggatattggcactgaagtgtttgcccctggaccgggctctggtattcagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccagccctatgagctcccagatggctcagtcgtcatcaatgcccgaaaccagaacaactaccactgccactgccgaattgtcctccgcagctatgatgcctgtgatacactaaggccccgtgatgtgaccttcgaccctgagctcgtggaccctgtggtagctgcaggagctgtagtcaccagctccggcattgtcttcttctccaacccagcacatccagagttccgagtgaacctgaccctgcgatggagcttcagcaatggtacctcatggcggaaagagacagtccagctatggccaggccccagtggctattcatccctggcaaccctggagggcagcatggatggagaggagcaggccccccagctctacgtcctgtatgagaaaggccggaaccactacacagagagcatctccgtggccaaaatcagtgtctatgggacactctgagctgtgccactgccacaggggtattctgccttcaggactctgccttcaggaacacgggtctgtagagggtctgctggagacgcctgaaagacagttccatcttcctttagactccagccttggcaaaatcaccttccctttaccagggaaatcacttcctttaggactgaaagctaggcgtcctctcccacaaaaaagtcctgccctcatctgagaatactgtctttccatatggctaagtgtggccccaccaccctctctgccctcccgggacattgattggtcctgtcttgggcaggtctagtgagctgtagaattgaatcaatgtgaactcagggaactggggaaggctgagcctcctctttggtgttgcggtaagataaccgacagggctggtgaaagtccccagatggcaggatatttggtttcagagtaaggactaggtgcaccaccatgactgactatcaatcaaaatgtttgtaacttaaaatttttaatgaaggataatgaatatttgtagagtctctatggttctgtcaatgcacatcttcgtgtctgttttcctcatgtatccttgtgagcctgggtgagttctggggagagacctgatgtgcgtactgcctgtgaaaatctgactttggcaaatcaaatcctcttttccttttga

SEQ ID NO: 181361 - DNA, 2045 bp, Homo sapiens; identical to SEQ ID NO: 181360
  Payload ID: 15727
  Gene Symbol: NEU1
  Gene Name: sialidase 1 (lysosomal sialidase)
  Uniprot ID: Q99519
  ENST ID: ENST00000375631
  CDS Start-End: 131-1378

SEQ ID NO: 181362 - DNA, 2071 bp, Homo sapiens
  Payload ID: 15727
  Gene Symbol: NEU1
  Gene Name: sialidase 1 (lysosomal sialidase)
  Uniprot ID: Q99519
  ENST ID: ENST00000411774
  CDS Start-End: 157-1404
gagctacttgaagaccaattagagtccgggaagcgcggcggggcctccagaccggggcgggcttaagggtgacatctgcgctttaaagggtccgggtcagctgactcccgactctgtggagtctagctgccagggtcgcggcagctgcggggagagatgactggggagcgacccagcacggcgctcccggacagacgctgggggccgcggattctgggcttctggggaggctgtagggtttgggtgtttgccgcgatcttcctgctgctgtctctggcagcctcctggtccaaggctgagaacgacttcggtctggtgcagccgctggtgaccatggagcaactgctgtgggtgagcgggagacagatcggctcagtggacaccttccgcatcccgctcatcacagccactccgcggggcactcttctcgcctttgctgaggcgaggaaaatgtcctcatccgatgagggggccaagttcatcgccctgcggaggtccatggaccagggcagcacatggtctcctacagcgttcattgtcaatgatggggatgtccccgatgggctgaaccttggggcagtagtgagcgatgttgagacaggagtagtatttcttttctactccctttgtgctcacaaggccggctgccaggtggcctctaccatgttggtatggagcaaggatgatggtgtttcctggagcacaccccggaatctctccctggatattggcactgaagtgtttgcccctggaccgggctctggtattcagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccagccctatgagctcccagatggctcagtcgtcatcaatgcccgaaaccagaacaactaccactgccactgccgaattgtcctccgcagctatgatgcctgtgatacactaaggccccgtgatgtgaccttcgaccctgagctcgtggaccctgtggtagctgcaggagctgtagtcaccagctccggcattgtcttcttctccaacccagcacatccagagttccgagtgaacctgaccctgcgatggagcttcagcaatggtacctcatggcggaaagagacagtccagctatggccaggccccagtggctattcatccctggcaaccctggagggcagcatggatggagaggagcaggccccccagctctacgtcctgtatgagaaaggccggaaccactacacagagagcatctccgtggccaaaatcagtgtctatgggacactctgagctgtgccactgccacaggggtattctgccttcaggactctgccttcaggaacacgggtctgtagagggtctgctggagacgcctgaaagacagttccatcttcctttagactccagccttggcaaaatcaccttccctttaccagggaaatcacttcctttaggactgaaagctaggcgtcctctcccacaaaaaagtcctgccctcatctgagaatactgtctttccatatggctaagtgtggccccaccaccctctctgccctcccgggacattgattggtcctgtcttgggcaggtctagtgagctgtagaattgaatcaatgtgaactcagggaactggggaaggctgagcctcctctttggtgttgcggtaagataaccgacagggctggtgaaagtccccagatggcaggatatttggtttcagagtaaggactaggtgcaccaccatgactgactatcaatcaaaatgtttgtaacttaaaatttttaatgaaggataatgaatatttgtagagtctctatggttctgtcaatgcacatcttcgtgtctgttttcctcatgtatccttgtgagcctgggtgagttctggggagagacctgatgtgcgtactgcctgtgaaaatctgactttggcaaatcaaatcctcttttccttttga

SEQ ID NO: 181363 - DNA, 2045 bp, Homo sapiens; identical to SEQ ID NO: 181360
  Payload ID: 15727
  Gene Symbol: NEU1
  Gene Name: sialidase 1 (lysosomal sialidase)
  Uniprot ID: Q99519
  ENST ID: ENST00000423382
  CDS Start-End: 131-1378

SEQ ID NO: 181364 - DNA, 2045 bp, Homo sapiens; identical to SEQ ID NO: 181360
  Payload ID: 15727
  Gene Symbol: NEU1
  Gene Name: sialidase 1 (lysosomal sialidase)
  Uniprot ID: Q99519
  ENST ID: ENST00000437432
  CDS Start-End: 131-1378

SEQ ID NO: 181365 - DNA, 2045 bp, Homo sapiens
  Payload ID: 15727
  Gene Symbol: NEU1
  Gene Name: sialidase 1 (lysosomal sialidase)
  Uniprot ID: Q99519
  ENST ID: ENST00000439648
  CDS Start-End: 131-1378
cgggaagcgcggcggggcctccagaccggggcgggcttaagggtgacatctgcgctttaaagggtccgggtcagctgactcccgactctgtggagtctagctgccagggtcgcggcagctgcggggagagatgactggggagcgacccagcacggcgctcccggacagacgctgggggccgcggattctgggcttctggggaggctgtagggtttgggtgtttgccgcgatcttcctgctgctgtctctggcagcctcctggtccaaggctgagaacgacttcggtctggtgcagccgctggtgaccatggagcaactgctgtgggtgagcgggagacagatcggctcagtggacaccttccgcatcccgctcatcacagccactccgcggggcactcttctcgcctttgctgaggcgaggaaaatgtcctcatccgatgagggggccaagttcatcgccctgcggaggtccatggaccagggcagcacatggtctcctacagcgttcattgtcaatgatggggatgtccccgatgggctgaaccttggggcagtagtgagcgatgttgagacaggagtagtatttcttttctactccctttgtgctcacaaggccggctgccaggtggcctctaccatgttggtatggagcaaggatgatggtgtttcctggagcacaccccggaatctctccctggatattggcactgaagtgtttgcccctggaccgggctctggtattcagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccagccctatgagctcccagatggctcagtcgtcatcaatgcccgaaaccagaacaactaccactgccactgccgaattgtcctccgcagctatgatgcctgtgatacactaaggccccgtgatgtgaccttcgaccctgagctcgtggaccctgtggtagctgcaggagctgtagtcaccagctccggcattgtcttcttctccaacccagcacatccagagttccgagtgaacctgaccctgcgatggagcttcagcaatggtacctcatggcggaaagagacagtccagctatggccaggccccagtggctattcatccctggcaaccctggagggcagcatggatggagaggagcaggccccccagctctacgtcctgtatgagaaaggccggaaccactacacagagagcatctccgtggccaaaatcagtgtctatgggacactctgagctgtgccactgccacaggggtattctgccttcaggactctgccttcaggaacacaggtctgtagagggtctgctggagacgcctgaaagacagttccatcttcctttagactccagccttggcaaaatcaccttccctttaccagggaaatcacttcctttaggactgaaagctaggcgtcctctcccacaaaaaagtcctgccctcatctgagaatactgtctttccatatggctaagtgtggccccaccaccctctctgccctcccgggacattgattggtcctgtcttgggcaggtctagtgagctgtagaattgaatcaatgtgaactcagggaactggggaaggctgagcctcctctttggtgttgcggtaagataaccgacagggctggtgaaagtccccagatggcaggatatttggtttcagagtaaggactaggtgcaccaccatgactgactatcaatcaaaatgtttgtaacttaaaatttttaatgaaggataatgaatatttgtagagtctctatggttctgtcaatgcacatcttcgtgtctgttttcctcatgtatccttgtgagcctgggtgagttctggggagagacctgatgtgcgtactgcctgtgaaaatctgactttggcaaatcaaatcctcttttccttttga

SEQ ID NO: 181366 - DNA, 2045 bp, Homo sapiens; identical to SEQ ID NO: 181360
  Payload ID: 15727
  Gene Symbol: NEU1
  Gene Name: sialidase 1 (lysosomal sialidase)
  Uniprot ID: Q99519
  ENST ID: ENST00000422978
  CDS Start-End: 131-1378

SEQ ID NO: 181367 - DNA, 2045 bp, Homo sapiens; identical to SEQ ID NO: 181360
  Payload ID: 15727
  Gene Symbol: NEU1
  Gene Name: sialidase 1 (lysosomal sialidase)
  Uniprot ID: Q99519
  ENST ID: ENST00000434496
  CDS Start-End: 131-1378

SEQ ID NO: 181368 - DNA, 1875 bp, Homo sapiens
  Payload ID: 15727
  Gene Symbol: NEU1
  Gene Name: sialidase 1 (lysosomal sialidase)
  ENST ID: ENST00000475767
  CDS Start-End: 47-850
actctgtggagtctagctgccagggtcgcggcagctgcggggagagatgactggggagcgacccagcacggcgctcccggacagacgctgggggccgcggattctgggcttctggggaggctgtagggtttgggtgtttgccgcgatcttcctgctgctgtctctggcagcctcctggtccaaggctgagaacgacttcggtctggtgcagccgctggtgaccatggagcaactgctgtgggtgagcgggagacagatcggctcagtggacaccttccgcatcccgctcatcacagccactccgcggggcactcttctcgcctttgctgaggcgaggaaaatgtcctcatccgatgagggggccaagttcatcgccctgcggaggtccatggaccagggcagcacatggtctcctacagcgttcattgtcaatgatggggatgtccccgatgggctgaaccttggggcagtagtgagcgatgttgagacaggagtagtatttcttttctactccctttgtgctcacaaggccggctgccaggtggcctctaccatgttggtatggagcaaggatgatggtgtttcctggagcacaccccggaatctctccctggatattggcactgaagtgtttgcccctggaccgggctctggtattcagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccagctatgatgcctgtgatacactaaggccccgtgatgtgaccttcgaccctgagctcgtggaccctgtggtagctgcaggagctgtagtcaccagctccggcattgtcttcttctccaacccagcacatccagagttccgagtgaacctgaccctgcgatggagcttcagcaatggtacctcatggcggaaagagacagtccagctatggccaggccccagtggctattcatccctggcaaccctggagggcagcatggatggagaggagcaggccccccagctctacgtcctgtatgagaaaggccggaaccactacacagagagcatctccgtggccaaaatcagtgtctatgggacactctgagctgtgccactgccacaggggtattctgccttcaggactctgccttcaggaacacgggtctgtagagggtctgctggagacgcctgaaagacagttccatcttcctttagactccagccttggcaaaatcaccttccctttaccagggaaatcacttcctttaggactgaaagctaggcgtcctctcccacaaaaaagtcctgccctcatctgagaatactgtctttccatatggctaagtgtggccccaccaccctctctgccctcccgggacattgattggtcctgtcttgggcaggtctagtgagctgtagaattgaatcaatgtgaactcagggaactggggaaggctgagcctcctctttggtgttgcggtaagataaccgacagggctggtgaaagtccccagatggcaggatatttggtttcagagtaaggactaggtgcaccaccatgactgactatcaatcaaaatgtttgtaacttaaaatttttaatgaaggataatgaatatttgtagagtctctatggttctgtcaatgcacatcttcgtgtctgttttcctcatgtatccttgtgagcctgggtgagttctggggagagacctgatgtgcgtactgcctgtgaaaatctgactttggcaaatcaaatcctcttttccttttga

SEQ ID NO: 181369 - DNA, 1875 bp, Homo sapiens; identical to SEQ ID NO: 181368
  Payload ID: 15727
  Gene Symbol: NEU1
  Gene Name: sialidase 1 (lysosomal sialidase)
  ENST ID: ENST00000486127
  CDS Start-End: 47-850

SEQ ID NO: 181370 - DNA, 1875 bp, Homo sapiens; identical to SEQ ID NO: 181368
  Payload ID: 15727
  Gene Symbol: NEU1
  Gene Name: sialidase 1 (lysosomal sialidase)
  ENST ID: ENST00000495464
  CDS Start-End: 47-850

SEQ ID NO: 181371 - DNA, 1579 bp, Homo sapiens
  Payload ID: 15727
  Gene Symbol: NEU1
  Gene Name: sialidase 1 (lysosomal sialidase)
  ENST ID: ENST00000477637
  CDS Start-End: 41-259
tggagtctagctgccagggtcgcggcagctgcggggagagatgactggggagcgacccagcacggcgctcccggacagacgctgggggccgcggattctgggcttctggggaggctgtagggtttgggtgtttgccgcgatcttcctgctgctgtctctggcagcctcctggtccaaggctgagaacgacttcggtctggcagcacatggtctcctacagcgttcattgtcaatgatggggatgtccccgatgggctgaaccttggggcagtagtgagcgatgttgagacaggagtagtatttcttttctactccctttgtgctcacaaggccggctgccaggtggcctctaccatgttggtatggagcaaggatgatggtgtttcctggagcacaccccggaatctctccctggatattggcactgaagtgtttgcccctggaccgggctctggtattcagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccagccctatgagctcccagatggctcagtcgtcatcaatgcccgaaaccagaacaactaccactgccactgccgaattgtcctccgcagctatgatgcctgtgatacactaaggccccgtgatgtgaccttcgaccctgagctcgtggaccctgtggtagctgcaggagctgtagtcaccagctccggcattgtcttcttctccaacccagcacatccagagttccgagtgaacctgaccctgcgatggagcttcagcaatggtacctcatggcggaaagagacagtccagctatggccaggccccagtggctattcatccctggcaaccctggagggcagcatggatggagaggagcaggccccccagctctacgtcctgtatgagaaaggccggaaccactacacagagagcatctccgtggccaaaatcagtgtctatgggacactctgagctgtgccactgccacaggggtattctgccttcaggactctgccttcaggaacacaggtctgtagagggtctgctggagacgcctgaaagacagttccatcttcctttagactccagccttggcaaaatcaccttccctttaccagggaaatcacttcctttaggactgaaagctaggcgtcctctcccacaaaaaagtcctgccctcatctgagaatactgtctttccatatggctaagtgtggccccaccaccctctctgccctcccgggacattgattggtcctgtcttgggcaggtctagtgagctgtagaattgaatcaatgtgaactcagggaactggggaaggctgagcctcctctttggtgttgcggtaagataaccgacagggctggtgaaagtccccagatggcaggatatttggtttcagagtaaggactaggtgcaccaccatgactgactatcaatcaaaatgtttgtaac

SEQ ID NO: 181372 - DNA, 1875 bp, Homo sapiens
  Payload ID: 15727
  Gene Symbol: NEU1
  Gene Name: sialidase 1 (lysosomal sialidase)
  ENST ID: ENST00000473972
  CDS Start-End: 47-850
actctgtggagtctagctgccagggtcgcggcagctgcggggagagatgactggggagcgacccagcacggcgctcccggacagacgctgggggccgcggattctgggcttctggggaggctgtagggtttgggtgtttgccgcgatcttcctgctgctgtctctggcagcctcctggtccaaggctgagaacgacttcggtctggtgcagccgctggtgaccatggagcaactgctgtgggtgagcgggagacagatcggctcagtggacaccttccgcatcccgctcatcacagccactccgcggggcactcttctcgcctttgctgaggcgaggaaaatgtcctcatccgatgagggggccaagttcatcgccctgcggaggtccatggaccagggcagcacatggtctcctacagcgttcattgtcaatgatggggatgtccccgatgggctgaaccttggggcagtagtgagcgatgttgagacaggagtagtatttcttttctactccctttgtgctcacaaggccggctgccaggtggcctctaccatgttggtatggagcaaggatgatggtgtttcctggagcacaccccggaatctctccctggatattggcactgaagtgtttgcccctggaccgggctctggtattcagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccagctatgatgcctgtgatacactaaggccccgtgatgtgaccttcgaccctgagctcgtggaccctgtggtagctgcaggagctgtagtcaccagctccggcattgtcttcttctccaacccagcacatccagagttccgagtgaacctgaccctgcgatggagcttcagcaatggtacctcatggcggaaagagacagtccagctatggccaggccccagtggctattcatccctggcaaccctggagggcagcatggatggagaggagcaggccccccagctctacgtcctgtatgagaaaggccggaaccactacacagagagcatctccgtggccaaaatcagtgtctatgggacactctgagctgtgccactgccacaggggtattctgccttcaggactctgccttcaggaacacaggtctgtagagggtctgctggagacgcctgaaagacagttccatcttcctttagactccagccttggcaaaatcaccttccctttaccagggaaatcacttcctttaggactgaaagctaggcgtcctctcccacaaaaaagtcctgccctcatctgagaatactgtctttccatatggctaagtgtggccccaccaccctctctgccctcccgggacattgattggtcctgtcttgggcaggtctagtgagctgtagaattgaatcaatgtgaactcagggaactggggaaggctgagcctcctctttggtgttgcggtaagataaccgacagggctggtgaaagtccccagatggcaggatatttggtttcagagtaaggactaggtgcaccaccatgactgactatcaatcaaaatgtttgtaacttaaaatttttaatgaaggataatgaatatttgtagagtctctatggttctgtcaatgcacatcttcgtgtctgttttcctcatgtatccttgtgagcctgggtgagttctggggagagacctgatgtgcgtactgcctgtgaaaatctgactttggcaaatcaaatcctcttttccttttga

SEQ ID NO: 181373 - DNA, 1762 bp, Homo sapiens
  Payload ID: 15727
  Gene Symbol: NEU1
  Gene Name: sialidase 1 (lysosomal sialidase)
  ENST ID: ENST00000487340
  CDS Start-End: 41-259
tggagtctagctgccagggtcgcggcagctgcggggagagatgactggggagcgacccagcacggcgctcccggacagacgctgggggccgcggattctgggcttctggggaggctgtagggtttgggtgtttgccgcgatcttcctgctgctgtctctggcagcctcctggtccaaggctgagaacgacttcggtctggcagcacatggtctcctacagcgttcattgtcaatgatggggatgtccccgatgggctgaaccttggggcagtagtgagcgatgttgagacaggagtagtatttcttttctactccctttgtgctcacaaggccggctgccaggtggcctctaccatgttggtatggagcaaggatgatggtgtttcctggagcacaccccggaatctctccctggatattggcactgaagtgtttgcccctggaccgggctctggtattcagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccagccctatgagctcccagatggctcagtcgtcatcaatgcccgaaaccagaacaactaccactgccactgccgaattgtcctccgcagctatgatgcctgtgatacactaaggccccgtgatgtgaccttcgaccctgagctcgtggaccctgtggtagctgcaggagctgtagtcaccagctccggcattgtcttcttctccaacccagcacatccagagttccgagtgaacctgaccctgcgatggagcttcagcaatggtacctcatggcggaaagagacagtccagctatggccaggccccagtggctattcatccctggcaaccctggagggcagcatggatggagaggagcaggccccccagctctacgtcctgtatgagaaaggccggaaccactacacagagagcatctccgtggccaaaatcagtgtctatgggacactctgagctgtgccactgccacaggggtattctgccttcaggactctgccttcaggaacacgggtctgtagagggtctgctggagacgcctgaaagacagttccatcttcctttagactccagccttggcaaaatcaccttccctttaccagggaaatcacttcctttaggactgaaagctaggcgtcctctcccacaaaaaagtcctgccctcatctgagaatactgtctttccatatggctaagtgtggccccaccaccctctctgccctcccgggacattgattggtcctgtcttgggcaggtctagtgagctgtagaattgaatcaatgtgaactcagggaactggggaaggctgagcctcctctttggtgttgcggtaagataaccgacagggctggtgaaagtccccagatggcaggatatttggtttcagagtaaggactaggtgcaccaccatgactgactatcaatcaaaatgtttgtaacttaaaatttttaatgaaggataatgaatatttgtagagtctctatggttctgtcaatgcacatcttcgtgtctgttttcctcatgtatccttgtgagcctgggtgagttctggggagagacctgatgtgcgtactgcctgtgaaaatctgactttggcaaatcaaatcctcttttccttttga

SEQ ID NO: 181374 - DNA, 1762 bp, Homo sapiens; identical to SEQ ID NO: 181373
  Payload ID: 15727
  Gene Symbol: NEU1
  Gene Name: sialidase 1 (lysosomal sialidase)
  ENST ID: ENST00000473255
  CDS Start-End: 41-259

SEQ ID NO: 181375 - DNA, 1875 bp, Homo sapiens; identical to SEQ ID NO: 181368
  Payload ID: 15727
  Gene Symbol: NEU1
  Gene Name: sialidase 1 (lysosomal sialidase)
  ENST ID: ENST00000491768
  CDS Start-End: 47-850

SEQ ID NO: 181376 - DNA, 1875 bp, Homo sapiens; identical to SEQ ID NO: 181368
  Payload ID: 15727
  Gene Symbol: NEU1
  Gene Name: sialidase 1 (lysosomal sialidase)
  ENST ID: ENST00000465246
  CDS Start-End: 47-850

SEQ ID NO: 181377 - DNA, 1875 bp, Homo sapiens; identical to SEQ ID NO: 181368
  Payload ID: 15727
  Gene Symbol: NEU1
  Gene Name: sialidase 1 (lysosomal sialidase)
  ENST ID: ENST00000460245
  CDS Start-End: 47-850

SEQ ID NO: 181378 - DNA, 1762 bp, Homo sapiens; identical to SEQ ID NO: 181373
  Payload ID: 15727
  Gene Symbol: NEU1
  Gene Name: sialidase 1 (lysosomal sialidase)
  ENST ID: ENST00000473226
  CDS Start-End: 41-259

SEQ ID NO: 181379 - DNA, 1762 bp, Homo sapiens; identical to SEQ ID NO: 181373
  Payload ID: 15727
  Gene Symbol: NEU1
  Gene Name: sialidase 1 (lysosomal sialidase)
  ENST ID: ENST00000495201
  CDS Start-End: 41-259

SEQ ID NO: 181380 - DNA, 1762 bp, Homo sapiens; identical to SEQ ID NO: 181373
  Payload ID: 15727
  Gene Symbol: NEU1
  Gene Name: sialidase 1 (lysosomal sialidase)
  ENST ID: ENST00000460116
  CDS Start-End: 41-259

SEQ ID NO: 181381 - DNA, 1762 bp, Homo sapiens; identical to SEQ ID NO: 181373
  Payload ID: 15727
  Gene Symbol: NEU1
  Gene Name: sialidase 1 (lysosomal sialidase)
  ENST ID: ENST00000465061
  CDS Start-End: 41-259

SEQ ID NO: 181382 - DNA, 1875 bp, Homo sapiens; identical to SEQ ID NO: 181368
  Payload ID: 15727
  Gene Symbol: NEU1
  Gene Name: sialidase 1 (lysosomal sialidase)
  ENST ID: ENST00000464056
  CDS Start-End: 47-850

SEQ ID NO: 181383 - DNA, 1143 bp, Homo sapiens
  Payload ID: 15728
  Gene Symbol: NEU2
  Gene Name: sialidase 2 (cytosolic sialidase)
  Uniprot ID: Q9Y3R4
  ENST ID: ENST00000233840
  CDS Start-End: 1-1143
atggcgtcccttcctgtcctgcagaaggagagcgtgttccagtcgggagcccatgcctacagaatccctgccctgctctacctgcctgggcagcagtccctgctggccttcgcggaacagcgggcaagcaagaaggatgagcacgcagagctgattgtcctgcgcagaggagactacgacgcacccacccaccaggttcagtggcaagctcaggaggtggtggcccaggcccggctggatggccaccggtccatgaacccatgccccttgtatgacgcgcagacggggaccctcttcctcttcttcattgccatccctgggcaagtcacggagcaacagcagctgcagaccagggccaatgtgacgcggctgtgccaagtcaccagcactgaccacgggaggacctggagctcccccagagacctcactgatgcggccatcggcccagcctaccgggagtggtccacctttgcagtgggcccggggcattgtttgcagcttcacgacagggcccggagcctggtggtgcccgcctacgcctaccggaaacttcaccccatccaaaggccgatcccctctgccttctgcttcctcagccatgaccatgggcgcacgtgggcgcgagggcactttgtggcccaggacaccctggagtgccaggtggccgaagtcgagactggggagcagagggtggtgaccctcaacgcgagaagccacctccgagccagggtccaggcccagagcaccaatgacgggcttgatttccaggagtctcagctggtgaagaagctggtggagccgccgccccagggctgccaggggagcgtcatcagcttccccagcccccgctcggggcctggctccccagcccagtggctgctctacactcaccccacacactcctggcagagggccgacctgggtgcctacctcaacccgcgacctccagcccctgaggcctggtcagagccggtactgctggccaagggcagctgtgcctactcagacctccagagcatgggcaccggccctgatgggtcccccttgtttgggtgtctgtacgaagccaatgattacgaggagattgtctttctcatgttcaccctgaagcaagccttcccagctgagtacctgcctcagtga

SEQ ID NO: 181384 - DNA, 6728 bp, Homo sapiens
  Payload ID: 15729
  Gene Symbol: NEU3
  Gene Name: sialidase 3 (membrane sialidase)
  Uniprot ID: Q9UQ49
  ENST ID: ENST00000294064
  CDS Start-End: 928-2313
tttccttttattggcgtttgtaaaatttcttctttttaaaattgttatattttagagacagggtctcgctctgtcacccaggctggagtgcagtggtgcaatcacagctcaccacagcctccaactcctgggctcaaggcatcctcccacgtaggccttccaaagcgctgagattgtaggcataagccaccaggcccagcctattacctttacgttgtacttagtcccagataaaaaatgaccttagatcagtcctttcctctttggctggggagaggggggcttaaattccggtactgtgaaacagaagaatggactcagtgctatgtgacaaatctatgtatgtaaatgtgtgtatatacacacacataaattatatatatgaatatattttcattttcatattttgcaaggagagtagccaatgctctggacctctggtcctttttgtagggtaccctctgaggccgggaacctttgctcaactctcaggctgtccagggaagctttaggcggtgataccgagctacagaccaatataagagctcggggctgtggcactgaagagaggaggcggccgttgggaactgaggtgggcccagggcttgagctgagttggcgagggtggaggtggtgccggtcccacgccgtggtggggaccgagctgcgggctggagggaggggcagcgccgagggggcgggacggggagggctcgcggagtaggccaacggttggccccaaccgccactgactacagcctgcgcccgcctcttttcgttgccgttacctgtttccggcagtcgacacgctcttcgcttctcggggcttgtctccgtgtcctccgtctcagttgtttctccctctctatcctcctctgtctcagtctccccagccttggggccggtgcctcttccgggcttcggcgaatgagacctgcggacctgcccccgcgccccatggaagaatccccggcgtccagctctgccccgacagagacggaggagccggggtccagtgcagaggtcatggaagaagtgacaacatgctccttcaacagccctctgttccggcaggaagatgacagagggattacctaccggatcccagccctgctctacataccccccacccacaccttcctggcctttgcagagaagcgttctacgaggagagatgaggatgctctccacctggtgctgaggcgagggttgaggattgggcagttggtacagtgggggcccctgaagccactgatggaagccacactaccggggcatcggaccatgaacccctgtcctgtatgggagcagaagagtggttgtgtgttcctgttcttcatctgtgtgcggggccatgtcacagagcgtcaacagattgtgtcaggcaggaatgctgcccgcctttgcttcatctacagtcaggatgctggatgttcatggagtgaggtgagggacttgactgaggaggtcattggctcagagctgaagcactgggccacatttgctgtgggcccaggtcatggcatccagctgcagtcagggagactggtcatccctgcgtatacctactacatcccttcctggttcttttgcttccagctaccatgtaaaaccaggcctcattctctgatgatctacagtgatgacctaggggtcacatggcaccatggtagactcattaggcccatggttacagtagaatgtgaagtggcagaggtgactgggagggctggccaccctgtgctatattgcagtgcccggacaccaaacaggtgccgggcagaggcgctcagcactgaccatggtgaaggctttcagagactggccctgagtcgacagctctgtgagcccccacatggttgccaagggagtgtggtaagtttccggcccctggagatcccacataggtgccaggactctagcagcaaagatgcacccaccattcagcagagctctccaggcagttcactgaggctggaggaggaagctggaacaccgtcagaatcatggctcttgtactcacacccaaccagtaggaaacagagggttgacctaggtatctatctcaaccagacccccttggaggctgcctgctggtcccgcccctggatcttgcactgtgggccctgtggctactctgatctggctgctctggaggaggagggcttgtttgggtgtttgtttgaatgtgggaccaagcaagagtgtgagcagattgccttccgcctgtttacacaccgggagatcctgagtcacctgcagggggactgcaccagccctggtaggaacccaagccaattcaaaagcaattaattggcttaggacccaatttccatagatgcaaatggcagttacagacaggttaacagaagctactgaagtctacagataatcaaaaaacttaatattctgttccctaccttttttcacttttcctcctccaaagagcaaaatgaaaattttgccttagctactgcagtggaaagagcactgaactaggagttggaagacaaggatgtggtcctggctctgccactggcttgcttttggaccttggatgtgtcacctgaactctctggacctcaggtttccatctgtaaaatgagagtattggttctaagatttctcatcttctcatccctaggacaagcatagtgcctgcatgcttcatgatcagtaagtcctggctgcataaaggactctgatgtcaaaatggaaaccaggggacttaccttttcacatgacttacccctcatccgagtgtgaggttacaagcaggtgtcatggcaggaaggaagaccagatctgtatgatttgttccatttttaataacaaaaatatccacacccttttaataatgctcagttctgtaggctctctatcctagaggaattgagcaaaacagaagaatcatgaagtctcctaccttctacagccttgtagttctgcttaccttctcttcctcatccagaaagcatcattttctagggagaacaatgagaatctcaatgccagtagtactggataatagtgcgtattgcttctggtggcattaccctgatgatgggctgaagttcatttattagggtggttcctgatgggaaaaggacatggattaggactttaaaacactggacagaatttcccacagtctttgccctcaaggagttcaccagtttatggggctagaagagcgagaaaattcaagaaaataaatgtagctggtgggagactttgtagatgttgggctatatgttggggtgatggtagctcctgatgtaattttcttagttgcatcttcaatatgcctggagtcgtctgtccaaggcttgtccaggcttctgggtttctctcaagtttgtttttctcaggatattgtcctggcccagctactcctttacctgtgagaagatcttcaccattaggaagatctctagacccccagatctcagaatcaggcctatttgtgtaggcccatggaaatcactacttgtgaagtagagatgcctttttgtctaatggttttcgtgctgaacttagttcatgctgagtctctcagatgataccacgttggttgttcctatcttagattgtttctcccatagcctgttattgcaacagaaattctatcatgagagatttatttttttgtccctattttaggagtctaatgcttaaactggtatcaactaaatatatttggtgttgtacaatgaccacagagaacaagtcttagtcatgaaatatagcctaggagactaggggttacagttgcactagttgggtagagagagtcctacaggataaaagtggagattaactttacctactttagcagattgcttaagccatggcttagagtggcttttaaaaatccccttagcctctcctacatttgccaaggtaatcttcccaatacacaattattcactcatgtatacatttatctaaatatttcttgagtgcctaatacaaggtactttctactgccattccttggctctaaatcatttgtggttctccattgcctattataatgtaaagatgtttacatttagcctggcatgtaggaccttccagctgttgggtgaaataatgcacactttcctctacttccttatatgaggcccactgtcagggaaaacctctgtcaagttggcaggtggagggtggtggaggtctagggatgggcaggattggtgcagggaggaattggggaaggggagaggattaaaagggcagccccctcctgagtggtagaaactccttgtttagcaaagctttcctgaacactgtactgcaagtggataggaatagggaggatggccaagtcgtacaaccagggctaaaggatgaaaagaatgagaatatcaacttctttttttttttttttgagacagaatctcactctgtcgcccaggctggagtacagtggcacaatctcagctcactgcagtctccgcctcctgggttcaagcaattctcctgcctcagcctcccaagtagctgggattacaggtgcctgccactacgcccagctaattttttgtatttttagtagagacggggtttcaccatgttggccaggcttgtctcgaactcctagccttgtgattcgcctgcctcggcctcccaaagtgctgggaatacaggcatgagctactgcgcccagccgagaatatcaacttctttaggactactcaagaagggagtcaaggcagggaccttggtctgtgccactgtgacgcagagatgtataataccagtactcataagaggtccatctctaaattgccctcctcttacttcttccccctgcctcatgttttttctctttaatgactagcatcgaaactctttaaatggggcaggcctgtgttcttatctcaggaatagtaagaaaagggggttgggaacaggggaaatccagaataaagacttgagaaaggaacagagtgggtgatggcagctatgaagaaaaaacagatcagaagaagagtcctggcaccttaggaagagaaagtgtcacagacacgaggcctaggctagagagatggtgtaggtggtagctgctgtgaagaagaaatgacaacaggctggagctgttccctgaaacctgtgggaaggaagagagacctgcacaggccggcacttagcttgtggagaaggtcctaactcaacactgcaactttaagctggcttaacttgtccaagttccagatgaccaacaaagacagctatagacactctaactctgtgccaattacccaaggccttcagggccctgggacctattccatgatagtggtaccctaactgaacccatttcagccactcagattgataggatggaaaagacagggcaggtggtagcagctgtgaagaaaagaggaaagcagaagggtggcctataatctacaggcatgtagagaggactacataggcctctgttctttgccctcaggagcccccttcctgtcccttggactcagaatggatccttccagcacacatggcccaacactgagagtgcaggaagcatgggtaggggcctcctgctgctggtatgtacccaggccagcctcctgccgacacagcctactggctgggttcatgttcttactattcacctcaggccattgtctgggtgcttaatttgacttgtttcccctggtcaccagtctcccctccgatattcacaggacatcaagcagcttcagccacgggtaagaggcttttcaccctgcctgttgggtagcccagaggacccacaaaggtcaacctgagtctccacagcctcctccccagggcagtaggaattgatatctcacttttgccagattaggcttctcactcttcttgagtaggccataatccacctcttcagtaggccatgcatcttgtctctgcagtgccagaattcacagtctgggcctccctttggtccttaccataggctgccatgtattattgtctatgttgtgccctgtaggcctctgctaggctgtgaactccttgactgactcctcactgtgtcctttttaccttgaatcacagtggcttatctaaaaatataagcttttttctgtcatattctgaattccctgaaggtaaggactatgtctgattcctctctttgtcctctgcacccagcgtagggcctgaaacagagtagctagcagtaaagatacactgaatgaatgaatgagtcaaccatccttggcctctggagctaattgagaaggctagggggagttccgctgtagggagaaggatgttgcatccctttgtagattgtgtagcattcaaaacctgctgaacactcaccctcaatgtatattctctgttctggcctgcttcaaggtcagttacactacttcctgggatgggcctttctctggcttaagcttggttgtccctggctttcccaaggatcacagcccaaaaggcacagtggggaaaatttatggcctattccagaagagtgagcagcctaatcaagccaagccttgatttggggttctcacttcactggtattttccctctgtccctaattgggttttctatagttactagttttccaggcctccaagggagattctgaggcttgatgtgttctgactgtgtcttggctttgtgatgctgagtgccagaaatactctgtactataaaaactaccatcgttctttgaaacaacaaagaggaataaagaacttaattctggtga

SEQ ID NO: 181385 - DNA, 2468 bp, Homo sapiens
  Payload ID: 15729
  Gene Symbol: NEU3
  Gene Name: sialidase 3 (membrane sialidase)
  Uniprot ID: Q9UQ49
  ENST ID: ENST00000531509
  CDS Start-End: 491-1876
cccacgtaggccttccaaagcgctgagattgtaggcataagccaccaggcccagcctattacctttacgttgtacttagtcccagataaaaaatgaccttagatcagtcctttcctctttggctggggagaggggggcttaaattccggtactgtgaaacagaagaatggactcagtgctatgtgacaaatctatgtatgtaaatgtgtgtatatacacacacataaattatatatatgaatatattttcattttcatattttgcaaggagagtagccaatgctctggacctctggtcctttttgtagggtaccctctgaggccgggaacctttgctcaactctcaggctgtccagggaagctttaggcggtgataccgagctacagaccaatataagagctcggggctgtggcactgaagagaggaggcggccgttgggaactgagtctccccagccttggggccggtgcctcttccgggcttcggcgaatgagacctgcggacctgcccccgcgccccatggaagaatccccggcgtccagctctgccccgacagagacggaggagccggggtccagtgcagaggtcatggaagaagtgacaacatgctccttcaacagccctctgttccggcaggaagatgacagagggattacctaccggatcccagccctgctctacataccccccacccacaccttcctggcctttgcagagaagcgttctacgaggagagatgaggatgctctccacctggtgctgaggcgagggttgaggattgggcagttggtacagtgggggcccctgaagccactgatggaagccacactaccggggcatcggaccatgaacccctgtcctgtatgggagcagaagagtggttgtgtgttcctgttcttcatctgtgtgcggggccatgtcacagagcgtcaacagattgtgtcaggcaggaatgctgcccgcctttgcttcatctacagtcaggatgctggatgttcatggagtgaggtgagggacttgactgaggaggtcattggctcagagctgaagcactgggccacatttgctgtgggcccaggtcatggcatccagctgcagtcagggagactggtcatccctgcgtatacctactacatcccttcctggttcttttgcttccagctaccatgtaaaaccaggcctcattctctgatgatctacagtgatgacctaggggtcacatggcaccatggtagactcattaggcccatggttacagtagaatgtgaagtggcagaggtgactgggagggctggccaccctgtgctatattgcagtgcccggacaccaaacaggtgccgggcagaggcgctcagcactgaccatggtgaaggctttcagagactggccctgagtcgacagctctgtgagcccccacatggttgccaagggagtgtggtaagtttccggcccctggagatcccacataggtgccaggactctagcagcaaagatgcacccaccattcagcagagctctccaggcagttcactgaggctggaggaggaagctggaacaccgtcagaatcatggctcttgtactcacacccaaccagtaggaaacagagggttgacctaggtatctatctcaaccagacccccttggaggctgcctgctggtcccgcccctggatcttgcactgtgggccctgtggctactctgatctggctgctctggaggaggagggcttgtttgggtgtttgtttgaatgtgggaccaagcaagagtgtgagcagattgccttccgcctgtttacacaccgggagatcctgagtcacctgcagggggactgcaccagccctggtaggaacccaagccaattcaaaagcaattaattggcttaggacccaatttccatagatgcaaatggcagttacagacaggttaacagaagctactgaagtctacagataatcaaaaaacttaatattctgttccctaccttttttcacttttcctcctccaaagagcaaaatgaaaattttgccttagctactgcagtggaaagagcactgaactaggagttggaagacaaggatgtggtcctggctctgccactggcttgcttttggaccttggatgtgtcacctgaactctctggacctcaggtttccatctgtaaaatgagagtattggttctaagatttctcatcttctcatccctaggacaagcatagtgcctgcatgcttcatgatcagtaagtcctggctgcataaaggactctgatgtcaaaatggaaaccaggggacttaccttttcacatgacttacccctcatccgagtgtgaggttacaagcaggtgtcatggcaggaaggaagaccagatctgtatgatttgttccatttttaataacaaaaatatccacacccttttaataatgctcagttctgtaggctctctatcctagaggaattgagcaaaacag

SEQ ID NO: 181386 - DNA, 581 bp, Homo sapiens
  Payload ID: 15729
  Gene Symbol: NEU3
  Gene Name: sialidase 3 (membrane sialidase)
  ENST ID: ENST00000529024
  CDS Start-End: 72-377
agagaggaggcggccgttgggaactgagtctccccagccttggggccggtgcctcttccgggcttcggcgaatgagacctgcggacctgcccccgcgccccatggaagaatccccggcgtccagctctgccccgacagagacggaggagccggggtccagtgcagtgggggcccctgaagccactgatggaagccacactaccggggcatcggaccatgaacccctgtcctgtatgggagcagaagagtggttgtgtgttcctgttcttcatctgtgtgcggggccatgtcacagagcgtcaacagattgtgtcaggcaggaatgctgcccgcctttgcttcatctacagtcaggatgctggatgttcatggagtgagagaaccctgactaatacagtaaattggtaccagtagagtggggcattgccgaaaagatacccaaaaatgtggaaactactttggaacttggtaacaggcagaagttggaacagtttggagggctcagaagaagagagaaaaatgtggaaaagtttggaactccctagagacttgttgaatggctttgacaaaaatgctgataa

SEQ ID NO: 181387 - DNA, 746 bp, Homo sapiens
  Payload ID: 15729
  Gene Symbol: NEU3
  Gene Name: sialidase 3 (membrane sialidase)
  ENST ID: ENST00000534628
  CDS Start-End: 118-630
tcttcgcttctcggggcttgtctccgtgtcctccgtctcagttgtttctccctctctatcctcctctgtctcagtctccccagccttggggccggtgcctcttccgggcttcggcgaatgagacctgcggacctgcccccgcgccccatggaagaatccccggcgtccagctctgccccgacagagacggaggagccggggtccagtgcagaggtcatggaagaagtgacaacatgctccttcaacagccctctgttccggcaggaagatgacagagggattacctaccggatcccagccctgctctacataccccccacccacaccttcctggcctttgcagagaagcgttctacgaggagagatgaggatgctctccacctggtgctgaggcgagggttgaggattgggcagttggtacaggtgactcttcatcccagatctgagtctgggcctcagtttctcttcacaaagctcagagctcttcaggatctgtgccttttctcatcagtacaggaaagccctgtgtggggagcagaggcagaaaaaacagcaaaaacaatggctctcactgagtgcttattgtgtgccaggggcacattgggtcctcacagccattctgtgtcgtaggtactgttttcagtcatattttacagacaaggaaactgagactcagagaggttgccatttgctcaaggttatacagctataataaagcagtagaagctggtttcaaactcagtcgc

SEQ ID NO: 181388 - DNA, 1643 bp, Homo sapiens
  Payload ID: 15729
  Gene Symbol: NEU3
  Gene Name: sialidase 3 (membrane sialidase)
  ENST ID: ENST00000532963
  CDS Start-End: 128-433
gtcgacacgctcttcgcttctcggggcttgtctccgtgtcctccgtctcagttgtttctccctctctatcctcctctgtctcagtctccccagccttggggccggtgcctcttccgggcttcggcgaatgagacctgcggacctgcccccgcgccccatggaagaatccccggcgtccagctctgccccgacagagacggaggagccggggtccagtgcagtgggggcccctgaagccactgatggaagccacactaccggggcatcggaccatgaacccctgtcctgtatgggagcagaagagtggttgtgtgttcctgttcttcatctgtgtgcggggccatgtcacagagcgtcaacagattgtgtcaggcaggaatgctgcccgcctttgcttcatctacagtcaggatgctggatgttcatggagtgaggtgagggacttgactgaggaggtcattggctcagagctgaagcactgggccacatttgctgtgggcccaggtcatggcatccagctgcagtcagggagactggtcatccctgcgtatacctactacatcccttcctggttcttttgcttccagctaccatgtaaaaccaggcctcattctctgatgatctacagtgatgacctaggggtcacatggcaccatggtagactcattaggcccatggttacagtagaatgtgaagtggcagaggtgactgggagggctggccaccctgtgctatattgcagtgcccggacaccaaacaggtgccgggcagaggcgctcagcactgaccatggtgaaggctttcagagactggccctgagtcgacagctctgtgagcccccacatggttgccaagggagtgtggtaagtttccggcccctggagatcccacataggtgccaggactctagcagcaaagatgcacccaccattcagcagagctctccaggcagttcactgaggctggaggaggaagctggaacaccgtcagaatcatggctcttgtactcacacccaaccagtaggaaacagagggttgacctaggtatctatctcaaccagacccccttggaggctgcctgctggtcccgcccctggatcttgcactgtgggccctgtggctactctgatctggctgctctggaggaggagggcttgtttgggtgtttgtttgaatgtgggaccaagcaagagtgtgagcagattgccttccgcctgtttacacaccgggagatcctgagtcacctgcagggggactgcaccagccctggtaggaacccaagccaattcaaaagcaattaattggcttaggacccaatttccatagatgcaaatggcagttacagacaggttaacagaagctactgaagtctacagataatcaaaaaacttaatattctgttccctaccttttttcacttttcctcctccaaagagcaaaatgaaaattttgccttagctactgcagtggaaagagcactgaactaggagttggaagacaaggatgtggtcctggctctgccactggcttgcttttggaccttggatgtgtcacctgaactctctggacctcaggtttccatctgtaaaatgagagtattggttctaagatttctcatcttctcatccctaggacaagcatag

SEQ ID NO: 181389 - DNA, 582 bp, Homo sapiens
  Payload ID: 15729
  Gene Symbol: NEU3
  Gene Name: sialidase 3 (membrane sialidase)
  ENST ID: ENST00000531619
  CDS Start-End: 119-538
ctcttcgcttctcggggcttgtctccgtgtcctccgtctcagttgtttctccctctctatcctcctctgtctcagtctccccagccttggggccggtgcctcttccgggcttcggcgaatgagacctgcggacctgcccccgcgccccatggaagaatccccggcgtccagctctgccccgacagagacggaggagccggggtccagtgcagaggtcatggaagaagtgacaacatgctccttcaacagccctctgttccggcaggaagatgacagagggattacctaccggatcccagccctgctctacataccccccacccacaccttcctggcctttgcagagaagcgttctacgaggagagatgaggatgctctccacctggtgctgaggcgagggttgaggattgggcagttggtacagagatggggttttgccatgttgcccagactggtctcaaactcctggactcaagctattctaaagtgctgggattacagcatgagccactgtgcctggccatttgggggcccctgaagccactgatggaagccacactaccggggcatcggaccatgaac

SEQ ID NO: 181390 - DNA, 431 bp, Homo sapiens
  Payload ID: 15729
  Gene Symbol: NEU3
  Gene Name: sialidase 3 (membrane sialidase)
  ENST ID: ENST00000526068
  CDS Start-End: 137-313
tttccggcagtcgacacgctcttcgcttctcggggcttgtctccgtgtcctccgtctcagttgtttctccctctctatcctcctctgtctcagtctccccagccttggggccggtgcctcttccgggcttcggcgaatgagacctgcggacctgcccccgcgccccatggaagaatccccggcgtccagctctgccccgacagagacggaggagccggggtccagtgcagcacctgatttgtgtgaaacgttttgggtggcaatgccagaatcaccatctatattacttctgtcatcaacacgatcagcataattacaaaaattaatggctctaattgttatagtgataataaagcataaatgaaattgtgaggacatcaaaatttataattaaagacacctattaaaacagcagtttaaaatttataaaa

SEQ ID NO: 181391 - DNA, 2288 bp, Homo sapiens
  Payload ID: 15730
  Gene Symbol: NEU4
  Gene Name: sialidase 4
  Uniprot ID: Q8WWR8
  ENST ID: ENST00000325935
  CDS Start-End: 430-1923
gaggggctgtgctgtgccaggggaggccccgcacccgggaagcccagaggagagtgtgcactcacggagccctcctggcagggccgcgtctctggagcagcagacccgtgtccctctgggaggtcaactgcggcctcacagctgggcctgtcccagcacagcccttgttggagggcgcacccccgtgtcctcagcaccccagtgttgagtgccttgacctgcagaggggagcctgtgctggtcccgggcgtctgtgtggctcctgggtgcccatctgcacccctggccctgctctgggcttcagtggagccgtgccaccgtgggagtgtccagggtcctgacgtagccctgagacgtggccagctccctggcctgctgcccgcacagtgggcccttgtctctgctctgggtcaggcgaggcagccacccatgatgagctctgcagccttcccaaggtggctgcagagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcaggactgggccacattcgctgtgggtcccggccacggtgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcaggcgagtgccagctggcagcggtggacggtgggcaggccggcagcttcctctactgcaatgcccggagcccactgggcagccgtgtgcaggcgctcagcactgacgagggcacctccttcctgcccgcagagcgcgtggcttccctgcccgagactgcctggggctgccagggcagcatcgtgggcttcccagcccccgcccccaacaggccacgggatgacagttggtcagtgggccccgggagtcccctccagcctccactcctcggtcctggagtccacgaacccccagaggaggctgctgtagacccccgtggaggccaggtgcctggtgggcccttcagccgtctgcagcctcggggggatggccccaggcagcctggccccaggcctggggtcagtggggatgtggggtcctggaccctggcactccccatgccctttgctgccccgccccagagccccacgtggctgctgtactcccacccagtggggcgcagggctcggctacacatgggtatccgcctgagccagtccccgctggacccgcgcagctggacagagccctgggtgatctacgagggccccagcggctactccgacctggcgtccatcgggccggcccctgaggggggcctggtttttgcctgcctgtacgagagcggggccaggacctcctatgatgagatttccttttgtacattctccctgcgtgaggtcctggagaacgtgcccgccagccccaaaccgcccaaccttggggacaagcctcgggggtgctgctggccctcctgacaggccttctggccgtgcccatgccccttgggtgcctggggcagaggggtggaatacgttggggtgccccacgatagctgtggggggggctcttagtgcaggatcctgtggattagaaacaagttgctcctcagagctctcaagcagggactgctctttaggaaggggagcagcggctgggagtgagcagggcagggtgggggcagggtgggggcacgaagtgggccctgggtgacccccacagctcccttccgaggctgcagggccaggcgcgggaccgcaggtagcccagggtgttgtgggtggcagcacttgtttactggctgctttctggctcgaaataaaggaatcgtgcttgtgtcggg

SEQ ID NO: 181392 - DNA, 2526 bp, Homo sapiens
  Payload ID: 15730
  Gene Symbol: NEU4
  Gene Name: sialidase 4
  Uniprot ID: Q8WWR8
  ENST ID: ENST00000391969
  CDS Start-End: 712-2166
gcgatggggtgctggcctgccaggagcacagatacagagctagagcccagtgaggcctgtgctgtgaggggctgtgctgtgccaggggaggccccgcacccgggaagcccagaggagagtgtgcactcacggagccctcctggcagggccgcgtctctggagcagcagacccgtgtccctctgggaggtcaactgcggcctcacagctgggcctgtcccagcacagcccttgttggagggcgcacccccgtgtcctcagcaccccagtgttgagtgccttgacctgcagaggggagcctgtgctggtcccgggcgtctgtgtggctcctgggtgcccatctgcacccctggccctgctctgggcttcagtggagccgtgccaccgtgggagtgtccagggtcctgacgtagccctgagacgtggccagctccctggcctgctgcccgcacagtgggcccttgtctctgctctgggtcaggcgaggcagccacccatgatgagctctgcagccttcccaaggtggctgccccgcatccaggtgccccgtgtgcccggcctgggcggctggccgtggatctgaccgctcctgcatggtggaggaccagcgttcccactgtctgcagctgtgccacctccctgtgccgggctgtgcgtgctcacgctcggctccgtctgcctttgtgcgatcagactgagagaccccccagagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcaggactgggccacattcgctgtgggtcccggccacggtgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcaggcgagtgccagctggcagcggtggacggtgggcaggccggcagcttcctctactgcaatgcccggagcccactgggcagccgtgtgcaggcgctcagcactgacgagggcacctccttcctgcccgcagagcgcgtggcttccctgcccgagactgcctggggctgccagggcagcatcgtgggcttcccagcccccgcccccaacaggccacgggatgacagttggtcagtgggccccgggagtcccctccagcctccactcctcggtcctggagtccacgaacccccagaggaggctgctgtagacccccgtggaggccaggtgcctggtgggcccttcagccgtctgcagcctcggggggatggccccaggcagcctggccccaggcctggggtcagtggggatgtggggtcctggaccctggcactccccatgccctttgctgccccgccccagagccccacgtggctgctgtactcccacccagtggggcgcagggctcggctacacatgggtatccgcctgagccagtccccgctggacccgcgcagctggacagagccctgggtgatctacgagggccccagcggctactccgacctggcgtccatcgggccggcccctgaggggggcctggtttttgcctgcctgtacgagagcggggccaggacctcctatgatgagatttccttttgtacattctccctgcgtgaggtcctggagaacgtgcccgccagccccaaaccgcccaaccttggggacaagcctcgggggtgctgctggccctcctgacaggccttctggccgtgcccatgccccttgggtgcctggggcagaggggtggaatacgttggggtgccccacgatagctgtggggggggctcttagtgcaggatcctgtggattagaaacaagttgctcctcagagctctcaagcagggactgctctttaggaaggggagcagcggctgggagtgagcagggcagggtgggggcagggtgggggcacgaagtgggccctgggtgacccccacagctcccttccgaggctgcagggccaggcgcgggaccgcaggtagcccagggtgttgtgggtggcagcacttgtttactggctgctttctggctcgaaataaaggaatcgtgcttgtg

SEQ ID NO: 181393 - DNA, 1907 bp, Homo sapiens
  Payload ID: 15730
  Gene Symbol: NEU4
  Gene Name: sialidase 4
  Uniprot ID: Q8WWR8
  ENST ID: ENST00000405370
  CDS Start-End: 95-1549
agcttcacagtcaccgaagaaatgaagttacaggaggggcacaccgtccttttgtctctgcctttgaggttggcgggaactgaaactgcagagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcaggactgggccacattcgctgtgggtcccggccacggtgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcaggcgagtgccagctggcagcggtggacggtgggcaggccggcagcttcctctactgcaatgcccggagcccactgggcagccgtgtgcaggcgctcagcactgacgagggcacctccttcctgcccgcagagcgcgtggcttccctgcccgagactgcctggggctgccagggcagcatcgtgggcttcccagcccccgcccccaacaggccacgggatgacagttggtcagtgggccccgggagtcccctccagcctccactcctcggtcctggagtccacgaacccccagaggaggctgctgtagacccccgtggaggccaggtgcctggtgggcccttcagccgtctgcagcctcggggggatggccccaggcagcctggccccaggcctggggtcagtggggatgtggggtcctggaccctggcactccccatgccctttgctgccccgccccagagccccacgtggctgctgtactcccacccagtggggcgcagggctcggctacacatgggtatccgcctgagccagtccccgctggacccgcgcagctggacagagccctgggtgatctacgagggccccagcggctactccgacctggcgtccatcgggccggcccctgaggggggcctggtttttgcctgcctgtacgagagcggggccaggacctcctatgatgagatttccttttgtacattctccctgcgtgaggtcctggagaacgtgcccgccagccccaaaccgcccaaccttggggacaagcctcgggggtgctgctggccctcctgacaggccttctggccgtgcccatgccccttgggtgcctggggcagaggggtggaatacgttggggtgccccacgatagctgtggggggggctcttagtgcaggatcctgtggattagaaacaagttgctcctcagagctctcaagcagggactgctctttaggaaggggagcagcggctgggagtgagcagggcagggtgggggcagggtgggggcacgaagtgggccctgggtgacccccacagctcccttccgaggctgcagggccaggcgcgggaccgcaggtagcccagggtgttgtgggtggcagcacttgtttactggctgctttctggctcgaaataaaggaatcgtgcttg

SEQ ID NO: 181394 - DNA, 2352 bp, Homo sapiens
  Payload ID: 15730
  Gene Symbol: NEU4
  Gene Name: sialidase 4
  Uniprot ID: Q8WWR8
  ENST ID: ENST00000404257
  CDS Start-End: 498-1988
attgcgatggggtgctggcctgccaggagcacagatacagagctagagcccagtgaggcctgtgctgtgaggggctgtgctgtgccaggggaggccccgcacccgggaagcccagaggagagtgtgcactcacggagccctcctggcagggccgcgtctctggagcagcagacccgtgtccctctgggaggtcaactgcggcctcacagctgggcctgtcccagcacagcccttgttggagggcgcacccccgtgtcctcagcaccccagtgttgagtgccttgacctgcagaggggagcctgtgctggtcccgggcgtctgtgtggctcctgggtgcccatctgcacccctggccctgctctgggcttcagtggagccgtgccaccgtgggagtgtccagggtcctgacgtagccctgagacgtggccagctccctggcctgctgcccgcacagtgggcccttgtctctgctctgggtcaggcgaggcagccacccatgatgagctctgcagccttcccaaggtggctgagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcaggactgggccacattcgctgtgggtcccggccacggtgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcaggcgagtgccagctggcagcggtggacggtgggcaggccggcagcttcctctactgcaatgcccggagcccactgggcagccgtgtgcaggcgctcagcactgacgagggcacctccttcctgcccgcagagcgcgtggcttccctgcccgagactgcctggggctgccagggcagcatcgtgggcttcccagcccccgcccccaacaggccacgggatgacagttggtcagtgggccccgggagtcccctccagcctccactcctcggtcctggagtccacgaacccccagaggaggctgctgtagacccccgtggaggccaggtgcctggtgggcccttcagccgtctgcagcctcggggggatggccccaggcagcctggccccaggcctggggtcagtggggatgtggggtcctggaccctggcactccccatgccctttgctgccccgccccagagccccacgtggctgctgtactcccacccagtggggcgcagggctcggctacacatgggtatccgcctgagccagtccccgctggacccgcgcagctggacagagccctgggtgatctacgagggccccagcggctactccgacctggcgtccatcgggccggcccctgaggggggcctggtttttgcctgcctgtacgagagcggggccaggacctcctatgatgagatttccttttgtacattctccctgcgtgaggtcctggagaacgtgcccgccagccccaaaccgcccaaccttggggacaagcctcgggggtgctgctggccctcctgacaggccttctggccgtgcccatgccccttgggtgcctggggcagaggggtggaatacgttggggtgccccacgatagctgtggggggggctcttagtgcaggatcctgtggattagaaacaagttgctcctcagagctctcaagcagggactgctctttaggaaggggagcagcggctgggagtgagcagggcagggtgggggcagggtgggggcacgaagtgggccctgggtgacccccacagctcccttccgaggctgcagggccaggcgcgggaccgcaggtagcccagggtgttgtgggtggcagcacttgtttactggctgctttctggctcgaaataaaggaatcgtgcttgtgtcgg

SEQ ID NO: 181395 - DNA, 2273 bp, Homo sapiens
  Payload ID: 15730
  Gene Symbol: NEU4
  Gene Name: sialidase 4
  Uniprot ID: Q8WWR8
  ENST ID: ENST00000407683
  CDS Start-End: 454-1908
gttgtcgcggaggcctgcgtgagtgaggcctggcgtgccctggaaacattcccctgagttgaagaaagactcacagttttcagcatccagttaccctctgagcatcaggcagaacccgccggccccaaaaccaggcccccttggcacatgtgggcccgagtgagtccagcatgaggaggtgccgcttctgagcagagctcaggttgtctctgggaggaggagcgagcgttgggtgcggtggccgctgcgttggcagccctgtccctgagcggaacgcaggtcgtctctgggaggaggagcgagggttggacgcagtggccgctgcggtggcagccctgtccccaggcgtggactctgccctcagcttcacagtcaccgaagaaatgaagttacaggaggggcacaccgtccttttgtctctgcctttgaggttggcgggaactgaaactgagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcaggactgggccacattcgctgtgggtcccggccacggtgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcaggcgagtgccagctggcagcggtggacggtgggcaggccggcagcttcctctactgcaatgcccggagcccactgggcagccgtgtgcaggcgctcagcactgacgagggcacctccttcctgcccgcagagcgcgtggcttccctgcccgagactgcctggggctgccagggcagcatcgtgggcttcccagcccccgcccccaacaggccacgggatgacagttggtcagtgggccccgggagtcccctccagcctccactcctcggtcctggagtccacgaacccccagaggaggctgctgtagacccccgtggaggccaggtgcctggtgggcccttcagccgtctgcagcctcggggggatggccccaggcagcctggccccaggcctggggtcagtggggatgtggggtcctggaccctggcactccccatgccctttgctgccccgccccagagccccacgtggctgctgtactcccacccagtggggcgcagggctcggctacacatgggtatccgcctgagccagtccccgctggacccgcgcagctggacagagccctgggtgatctacgagggccccagcggctactccgacctggcgtccatcgggccggcccctgaggggggcctggtttttgcctgcctgtacgagagcggggccaggacctcctatgatgagatttccttttgtacattctccctgcgtgaggtcctggagaacgtgcccgccagccccaaaccgcccaaccttggggacaagcctcgggggtgctgctggccctcctgacaggccttctggccgtgcccatgccccttgggtgcctggggcagaggggtggaatacgttggggtgccccacgatagctgtggggggggctcttagtgcaggatcctgtggattagaaacaagttgctcctcagagctctcaagcagggactgctctttaggaaggggagcagcggctgggagtgagcagggcagggtgggggcagggtgggggcacgaagtgggccctgggtgacccccacagctcccttccgaggctgcagggccaggcgcgggaccgcaggtagcccagggtgttgtgggtggcagcacttgtttactggctgctttctggctcgaaataaaggaatcgtgcttgtgtcggg

SEQ ID NO: 181396 - DNA, 845 bp, Homo sapiens
  Payload ID: 15730
  Gene Symbol: NEU4
  Gene Name: sialidase 4
  ENST ID: ENST00000420288
  CDS Start-End: 65-845
tctctgctctgggtcaggcgaggcagccacccatgatgagctctgcagccttcccaagcagagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcaggactgggccacattcgctgtgggtcccggccacggtgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcaggcgagtgccagctggcagcggtggacggtgggcaggccggcagcttcctctactgcaatgcccggagcccactgggcagccgtgtgcaggcgctcagcactgacgagggcacctccttcc

SEQ ID NO: 181397 - DNA, 2281 bp, Homo sapiens
  Payload ID: 15730
  Gene Symbol: NEU4
  Gene Name: sialidase 4
  ENST ID: ENST00000435855
  CDS Start-End: 86-562
acagtcaccgaagaaatgaagttacaggaggggcacaccgtccttttgtctctgcctttgaggttggcgggaactgaaactgagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcaggaggagaaggctggacgctgaggtgtctctcagctcccaaaccaacagccaccccgccccaccccttcctcttattctttactcccttctcaccctgcccagggcctggccaggcctcacccacaactttccctccaccccatcctctgtggccacctgaccccggcccgtgggagctacagcagggagtgcagcagacacatggccaacccagggaccccactgcagggcctcatgccccccgcctgccctccgctctctctgtgtgggcagcgctcaccagcctccctgggtgccgtccacctgggctcggctgctaagggctgtgagaggcttgttcagcctgggaggactcagggcggctgggatgagtcgtgtggaagggcggtcagagtgcgatggtcctaacccgaggcaccagcccctccttccccgtccccctgtgccttcctccagccccccgacctcggggacccagcagcccctcccacctctgccctcctccctgcagactgggccacattcgctgtgggtcccggccacggtgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcagagcgcgtggcttccctgcccgagactgcctggggctgccagggcagcatcgtgggcttcccagcccccgcccccaacaggccacgggatgacagttggtcagtgggccccgggagtcccctccagcctccactcctcggtcctggagtccacgaacccccagaggaggctgctgtagacccccgtggaggccaggtgcctggtgggcccttcagccgtctgcagcctcggggggatggccccaggcagcctggccccaggcctggggtcagtggggatgtggggtcctggaccctggcactccccatgccctttgctgccccgccccagagccccacgtggctgctgtactcccacccagtggggcgcagggctcggctacacatgggtatccgcctgagccagtccccgctggacccgcgcagctggacagagccctgggtgatctacgagggccccagcggctactccgacctggcgtccatcgggccggcccctgaggggggcctggtttttgcctgcctgtacgagagcggggccaggacctcctatgatgagatttccttttgtacattctccctgcgtgaggtcctggagaacgtgcccgccagccccaaaccgcccaaccttggggacaagcctcgggggtgctgctggccctcctgacaggccttctggccgtgcccatgccccttgggtgcctggggcagaggggtggaatacgttggggtgccccacgatagctgtggggggggctcttagtgcaggatcctgtggattagaaacaagttgctcctcagagctctcaagcagggactgctctttaggaaggggagcagcggctgggagtgagcagggcagggtgggggcagggtgggggcacgaagtgggccctgggtgacccccacagctcccttccgaggctgcagggccaggcgcgggaccgcaggtagcccagggtgttgtgggtggcagcacttgtttactggctgctttctggctcgaaataaaggaatcgtgcttgtg

SEQ ID NO: 181398 - DNA, 505 bp, Homo sapiens
  Payload ID: 15730
  Gene Symbol: NEU4
  Gene Name: sialidase 4
  ENST ID: ENST00000428592
  CDS Start-End: 73-505
acggtgctgtggcctctattctggggacactgagctcctccttgctcgaggttttgggtcctcattgtccacatgacctcctgctgggcgaattctgggatgaccctgtgtcctgggcacatggctggcagggtcccgggggctctctggccagcctcccctgcaccctggcaccaaccagcctggccgaggagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcg

SEQ ID NO: 181399 - DNA, 860 bp, Homo sapiens
  Payload ID: 15730
  Gene Symbol: NEU4
  Gene Name: sialidase 4
  ENST ID: ENST00000415936
  CDS Start-End: 217-860
gccgctgcgttggcagccctgtccctgagcggaacgcaggtcgtctctgggaggaggagcgagggttggacgcagtggccgctgcggtggcagccctgtccccaggcgtggactctgccctcagcttcacagtcaccgaagaaatgaagttacaggaggggcacaccgtccttttgtctctgcctttgaggttggcgggaactgaaactgcagagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggactgggccacattcgctgtgggtcccggccacggtgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcaggcgagtgccagctggcagcggtggacggtgggcaggccggcagcttcctctactgcaatgcccggagcccactgggcagccgtgtgcaggcgctcagcactgacgagggcacctccttcctgcccgcagagcgcgtggcttccctgcccgagactgcctggggctgccagggcagcatcgtgggcttcccagcccccgcccccaacaggccacgggatgacagttggtcagtgggcccc

SEQ ID NO: 181400 - DNA, 753 bp, Homo sapiens
  Payload ID: 15730
  Gene Symbol: NEU4
  Gene Name: sialidase 4
  ENST ID: ENST00000423583
  CDS Start-End: 188-753
cttttgtctctgcctttgaggttggcgggaactgaaactgattgaaaacagtgggcttgaaaagcctggagcagagggagtgaggcctgccccccaccccagctctgcgggcacaccctggccagacagccctgctccagacccggcctgtgtctcagggtggcccaggaggggactttgcaagagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcaggactgggccacattcgctgtgggtcccggccacggtgtgcagctgccctcaggccgcctgctggtacccgcctacacctaccgcgtggaccgccgagagtgttttggcaa

SEQ ID NO: 181401 - DNA, 484 bp, Homo sapiens
  Payload ID: 15730
  Gene Symbol: NEU4
  Gene Name: sialidase 4
  ENST ID: ENST00000435894
  CDS Start-End: 254-484
gtctctgctctgggtcaggcgaggcagccacccatgatgagctctgcagccttcccaaggtggctgccccgcatccaggtgccccgtgtgcccggcctgggcggctggccgtggatctgaccgctcctgcatggtggaggaccagcgttcccactgtctgcagctgtgccacctccctgtgccgggctgtgcgtgctcacgctcggctccgtctgcctttgtgcgatcagactgagagaccccccagcagagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagca

SEQ ID NO: 181402 - DNA, 676 bp, Homo sapiens
  Payload ID: 15730
  Gene Symbol: NEU4
  Gene Name: sialidase 4
  ENST ID: ENST00000426032
  CDS Start-End: 34-676
gtctctgctctgggtcaggcgaggcagccacccatgatgagctctgcagccttcccaaggtggctgagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggactgggccacattcgctgtgggtcccggccacggtgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcaggcgagtgccagctggcagcggtggacggtgggcaggccggcagcttcctctactgcaatgcccggagcccactgggcagccgtgtgcaggcgctcagcactgacgagggcacctccttcctgcccgcagagcgcgtggcttccctgcccgagactgcctggggctgccagggcagcatcgtgggcttcccagcccccgcccc

SEQ ID NO: 181403 - DNA, 451 bp, Homo sapiens
  Payload ID: 15730
  Gene Symbol: NEU4
  Gene Name: sialidase 4
  ENST ID: ENST00000435934
  CDS Start-End: 296-451
gcccttgtctctgctctgggtcaggcgaggcagccacccatgatgagctctgcagccttcccaaggtggctgccccgcatccaggtgccccgtgtgcccggcctgggcggctggccgtggatctgaccgctcctgcatggtggaggaccagcgttcccactgtctgcagctgtgccacctccctgtgccgggctgtgcgtgctcacgctcggctccgtctgcctttgtgcgatcagactgagagaccccccaggcaggtcccgcctgcaacaagcagaccccatgcgtgccccaaatgccccctcacccgggccctgccctggtgggtgttgcctgggagcaaactcccagaatggccgccgggccccactcggctttggagcttctgattcctgtgggcgcttctcagagcatgggggtccctcgtaccccttcacggacagtgctcttc

SEQ ID NO: 181404 - DNA, 1907 bp, Homo sapiens; identical to SEQ ID NO: 181393
  Payload ID: 15730
  Gene Symbol: NEU4
  Gene Name: sialidase 4
  Uniprot ID: Q8WWR8
  ENST ID: ENST00000621851
  CDS Start-End: 95-1549

SEQ ID NO: 181405 - DNA, 2352 bp, Homo sapiens; identical to SEQ ID NO: 181394
  Payload ID: 15730
  Gene Symbol: NEU4
  Gene Name: sialidase 4
  Uniprot ID: Q8WWR8
  ENST ID: ENST00000616490
  CDS Start-End: 498-1988

SEQ ID NO: 181406 - DNA, 2526 bp, Homo sapiens; identical to SEQ ID NO: 181392
  Payload ID: 15730
  Gene Symbol: NEU4
  Gene Name: sialidase 4
  Uniprot ID: Q8WWR8
  ENST ID: ENST00000618866
  CDS Start-End: 712-2166

SEQ ID NO: 181407 - DNA, 2288 bp, Homo sapiens; identical to SEQ ID NO: 181391
  Payload ID: 15730
  Gene Symbol: NEU4
  Gene Name: sialidase 4
  Uniprot ID: Q8WWR8
  ENST ID: ENST00000626600
  CDS Start-End: 430-1923

SEQ ID NO: 181408 - DNA, 753 bp, Homo sapiens; identical to SEQ ID NO: 181400
  Payload ID: 15730
  Gene Symbol: NEU4
  Gene Name: sialidase 4
  ENST ID: ENST00000625452
  CDS Start-End: 188-753

SEQ ID NO: 181409 - DNA, 676 bp, Homo sapiens; identical to SEQ ID NO: 181402
  Payload ID: 15730
  Gene Symbol: NEU4
  Gene Name: sialidase 4
  ENST ID: ENST00000627724
  CDS Start-End: 34-676

SEQ ID NO: 181410 - DNA, 505 bp, Homo sapiens; identical to SEQ ID NO: 181398
  Payload ID: 15730
  Gene Symbol: NEU4
  Gene Name: sialidase 4
  ENST ID: ENST00000625706
  CDS Start-End: 73-505

SEQ ID NO: 181411 - DNA, 451 bp, Homo sapiens; identical to SEQ ID NO: 181403
  Payload ID: 15730
  Gene Symbol: NEU4
  Gene Name: sialidase 4
  ENST ID: ENST00000627618
  CDS Start-End: 296-451

SEQ ID NO: 181412 - DNA, 860 bp, Homo sapiens; identical to SEQ ID NO: 181399
  Payload ID: 15730
  Gene Symbol: NEU4
  Gene Name: sialidase 4
  ENST ID: ENST00000626222
  CDS Start-End: 217-860

SEQ ID NO: 181413 - DNA, 2273 bp, Homo sapiens; identical to SEQ ID NO: 181395
  Payload ID: 15730
  Gene Symbol: NEU4
  Gene Name: sialidase 4
  Uniprot ID: Q8WWR8
  ENST ID: ENST00000630923
  CDS Start-End: 454-1908

SEQ ID NO: 181414 - DNA, 845 bp, Homo sapiens; identical to SEQ ID NO: 181396
  Payload ID: 15730
  Gene Symbol: NEU4
  Gene Name: sialidase 4
  ENST ID: ENST00000626195
  CDS Start-End: 65-845

SEQ ID NO: 181415 - DNA, 2281 bp, Homo sapiens; identical to SEQ ID NO: 181397
  Payload ID: 15730
  Gene Symbol: NEU4
  Gene Name: sialidase 4
  ENST ID: ENST00000629521
  CDS Start-End: 86-562

SEQ ID NO: 181416 - DNA, 484 bp, Homo sapiens; identical to SEQ ID NO: 181401
  Payload ID: 15730
  Gene Symbol: NEU4
  Gene Name: sialidase 4
  ENST ID: ENST00000629646
  CDS Start-End: 254-484

SEQ ID NO: 181417 - DNA, 6894 bp, Homo sapiens
  Payload ID: 15731
  Gene Symbol: SPN
  Gene Name: sialophorin
  Uniprot ID: P16150
  ENST ID: ENST00000360121
  CDS Start-End: 133-1335
cctttccccttggggccctgtccttcccagtcttgccccagcctcgggaggtggtggagtgacctggccccagtgctgcgtccttatcagccgagccggtcccagctcttgctcctgcctgtttgcctggaaatggccacgcttctccttctccttggggtgctggtggtaagcccagacgctctggggagcacaacagcagtgcagacacccacctccggagagcctttggtctctactagcgagcccctgagctcaaagatgtacaccacttcaataacaagtgaccctaaggccgacagcactggggaccagacctcagccctacctccctcaacttccatcaatgagggatcccctctttggacttccattggtgccagcactggttcccctttacctgagccaacaacctaccaggaagtttccatcaagatgtcatcagtgccccaggaaacccctcatgcaaccagtcatcctgctgttcccataacagcaaactctctaggatcccacaccgtgacaggtggaaccataacaacgaactctccagaaacctccagtaggaccagtggagcccctgttaccacggcagctagctctctggagacctccagaggcacctctggaccccctcttaccatggcaactgtctctctggagacttccaaaggcacctctggaccccctgttaccatggcaactgactctctggagacctccactgggaccactggaccccctgttaccatgacaactggctctctggagccctccagcggggccagtggaccccaggtctctagcgtaaaactatctacaatgatgtctccaacgacctccaccaacgcaagcactgtgcccttccggaacccagatgagaactcacgaggcatgctgccagtggctgtgcttgtggccctgctggcggtcatagtcctcgtggctctgctcctgctgtggcgccggcggcagaagcggcggactggggccctcgtgctgagcagaggcggcaagcgtaacggggtggtggacgcctgggctgggccagcccaggtccctgaggagggggccgtgacagtgaccgtgggagggtccgggggcgacaagggctctgggttccccgatggggaggggtctagccgtcggcccacgctcaccactttctttggcagacggaagtctcgccagggctccctggcgatggaggagctgaagtctgggtcaggccccagcctcaaaggggaggaggagccactggtggccagtgaggatggggctgtggacgccccagctcctgatgagcccgaagggggagacggggctgccccttaagtgtcggtgaatagtgaggctggaggccggaatctcagccagcctccagcaccttccctctcaccatcccactgccccctcgctcccatgtttccacccggcaccctgatcctcacccgaatctcctttttttttttcttttgagacagagtttcgctttgtcgcccaggctggagtgcaatgcacgatctcagttcactgcaacctctgcctcctaagttcaggcgattctcctgcctcagcttcccgagtaactgagattacaggcacccaccaccatgcccagctgcttttttgtatttttggtagagatggggtttcaccatgttggctaggctggtctcaaactcctgacctcaggtgatctacctgcctcagcctcccaaagtgctgagattacagacatgagcctccgcgccttgcctcctcacccacctcttcactctgaatcctcatgaggcttctcagccctggatttcctgctgccatcctcacccagcacccacaactagcgcctgggcagggcagggctggcacctctcaacgtctgtggactgaatgaataaaccctcctcatccacccctatttatctccatcaccatttccccctctttcttgttcctggaaacggctgctgagtctccatcggccaaacttatctgccctgtgatttctttgacaattctccttttcccccagaacccaccctgggttgaccagagtctgggaagaaggacaagagaacccggcaaactccctcctaggattaactttgtaaagcacccttgccctgtagctgcaagggctgtggaacctgggcagcccgcaaccacctttagctctgggccccccaggccagcctggagcatggctgggtggggccaccagcccatgctctcaggcgggcctgtgatctttcccagggcacatggactgtaggctggccctggcccacaccaccacactctccccagccatggacagaggcagccagaggcctcacggtttctcctccgagtttctggctgggtgtagttctcagaaaccccagtgcctgcgtgtgtccactcgtgggtgtggtttgtgtgcaagagctgaggatttggcgatgcttgggaggggtagttgtgggtacagacggtgtgggggtgggaagtggtgcagagactgaagagggtcaacctgggcatgggggacacagggactgctgagaacgtgcgtgtcatctttgctctgatggggtggacatagcagaaaatctaactctgtctgtagccccatacagaatgccagggtgagcacagtggctggtgcctttaatcccagcactttggaaagttgaggcaggaggatcgcttgagcccaggagttcgagtctgaagtgagctgtgattgcaccactgcacttcagcctgggcaacagagtgagcccctgtctcaaaaaagaaaagaaaaagaaagccaggcttcatggaaagatcgtatgtgtgacccaaatatgagttcttcagctcagccatggtaatcccttccttgaagtctccatttctgcagtacacatgcatgtgcgctctctctctctctctctctctcacacacacacacacacacacacacacacgcgcgcgcgcgcgcgctctcctgcgaacagaggcagggggagaggggtttgccctggtctcggggactggtctggctggcgcttccccactgcacgtttccaggtttagtttgtctgtgtctcctcttccatcccaggggctgagccccttccatcctccaagaggaaccagtgagagtgagtgaaggaggggcctggagccagggacttcccctgtggggcctgggtggagaggggagaactcaatggtgctgcctttgagaccagcccaggctacagcccaggagcacacatgggccagggcagttggtatttcccgaggacaaagaggaaattttcaaagaggaagttgttgagttagagcttgcggtggctgagagcagacaggttgacctgcaaaaaaagacaggggaggcatgtgagtgtgacagccctgctctgtggcctgggcaggagatgggggaaagggtcaggtgggggatgggctcgtgcagtgggagaggagacggagggagggagcgggaaggggcttgcttagtgggtgggaagagctgagctcggatggaaccagcttctaccagccaggctgggcacccactgggctgcatctggtggccttttctgattgctatttggactcactgcagctgcagaatgacagaggccatgtccaaaatcccttagagacactgttgtcttagagttgttaaaataagagcccccatatcaggtttagaaaatactgtcaccgaacgaacgtcgctgtcctcagctccacctccctttcctttgacagatatggttgttttctaagccaggactggttttagtcaggtcctgggcgaatcctgaaaaaaagaggtagtacgggtaaggaaggcacccaacagggctttcacaatccagaaaatatcaaaatataagtgttaaaagagaggcacaggccgggtgcggtggctcacgcctgtaatctcagcactttgggaggccaaggtgggcagatcatgaggtcaggagtttgagaccagcctggccaatatgatgaaaccccgtttctactaaaaatacaaaagttagccaggcatggtggtgtgctcctgtaatcccagctacttaggaggctgaggccagagaattgcttgaaccctggagtcagaggttgcagtgagccgggatcatgccactgtactccaggctgggtgacaaagtgagactgtctcaaaaaataaaaataaataaaataaataaaagagaggcacaaacagtgttatgaatgcaccaaggaaaatggtgcattcataactctcaggtgaagcctaccaagccatgcgtgtgtgcacatatgtgtgtacgtgtgcatgtgcgtgcgtgcatgtgcgtgcgtgcatgtgcctgtgtgtgtatgtgtgcacatgtgtgtgcgcatgtgtgtgtgtgcgcgcatgtgtgtgtgcatgcatgttctcccatgcatgtgtactgtggcaagggagactttgaggaagagattccagtggctgagcagaagggctcgcattgccctggcgaaaggttggaaggcttcacctgagagtgtgtcgtggcctttgtcatatccactgcttgattcctttctttaaaaattatttttattgttttctacatatgagaaccaccacacctggctaatttttgtattttttgtagagatggggtttcaccatgttgtcccggctggtctcaaactcccgggcacaagagatccacctgcctcagcctcccaaaatgctgggactataggcatgagccactgcacccagccactgcttcattcctggtggctgctgtgcctggcatgttgcagatcctccatgaatatgcatttgaatgaatgaatgaatgaatgaatgaatgaatggagatgacgcctcagagattctttcttttgagatgaggtctcattctgtcacccagactagagggcagtggtgcaatcacagctcaccacagcctcaacctcctgggcctcccaagtagctgcgatcacaggtgtgcaccaacatgcccagctaatttttttttttaatttttaatttgtacagacagggtcttgctgtgttgcccaggctggtctcaaactcctgggctcaagtggtcctcccacctaagcttccccaaatactgggattataggtgtgagccactgtgcccaggcttgcctcagatatttgaaggctgggaaggattttgcaaagctgggaaaaggaaaaggcattcccagcagaggggatagcaggtggaaatacataattaaaaaaaaaaaacgtggagcagatccagcgcagtggctcatgcctgtaatcccagcactttgggaggcagagcagggaggattgcttgagtctaggagttcaagaccagcctgggtaacatagaaagaccctgtctctacaaaaacacaaaaaattagccaggcgtggtggtgcatgcctgtagtaccagctacttgagaagctgaggcaggaggactgcttgaagccaggagtttgagaccagcctgggcaacatagtgagaccccgtgtctacaaaaagtaaacatttatatatatattttttaaagtggagcagttcaatatagagtcttttttgaacaaacgtgaaatagatgtcttttttttttttttgagatggagttttcactcttgttacccaggctggagtgcaatggcgtgatcttggctcaccagaacctccgcctcctgggttcaaacaattctcctgcctcagcctcccaggtagctgggattacaggcatgcaccaccaaacccggataattttgtatttttagtagagatggggtttcaccatgttggtcaagctggtcttgaactcccgacctctgctgatccgtatgcctcggcctcccaaagtgctgggattacatgcgtgagccaccgtgcccgacaatagatgtcttttaattttctggaggaaaaagcaaagcaaaagaagcagtggatattttaagactaaaaaggaaaacaaaaaaaggagatagagcaggccagacgtggtggctcaacgtctgtaatcccagcactttgggaggccgaggcaggtggatcacctgaggtcaggagttcaagaccagcctgaccaacatggtgaaaccctgtttcaaaatacaaaaaattagctgggcgtggtggcgggcacctgtaatcccagctacttgggaggctgaggcaggagaatcccttgaacccaggaggtggaggttgcagtgagccgagatcacgccattgcactccagcctgggcgacaagtaaaaaactccatctcaaaaaaaaaaaaggagatagagcaaggaacagtaagaaaatagttgggtgcagtggctatgcggtggcactataggaggctgaggcgggcagatcacctgaggtcaggagttggagaccagcctgggcaacatagacccctatctctacaaaaaatttgaaatatgaaaaattagccaggtgtagtggtgtgcgcctgtggtaccagctactcaagaggcgaaggcagggaagattgcttgagcccaggagtttgaggctatagtgagctgtgatcatgccactgcactccagcctgggcaatagtgtgagactctgtctcaaaagaaagaacatggccaggcgtggtggctcacacctgtaatcccagcactttgggaggccgaggcagtcagatcatgaggccagtttgaaaccagcctggccaacatggtgaaaccctgtctctactaaaaatacaaaaattagccaggcgtggtggcatgcccccgtaatcccagctacttgggggtctgaggcagaagaattgcttgaaaccgggaggcagaggttgcagtgagccgagatcgtgtcattgcactctagtctgggcgacagagcaagactccgtcttgg

SEQ ID NO: 181418 - DNA, 1935 bp, Homo sapiens
  Payload ID: 15731
  Gene Symbol: SPN
  Gene Name: sialophorin
  Uniprot ID: P16150
  ENST ID: ENST00000395389
  CDS Start-End: 137-1339
cctctgagcccagccctccctagcatcaccacttccatcccattcctcagccaagagccaggaatcctgattccagatcccacgcttccctgcctccctcaggtcccagctcttgctcctgcctgtttgcctggaaatggccacgcttctccttctccttggggtgctggtggtaagcccagacgctctggggagcacaacagcagtgcagacacccacctccggagagcctttggtctctactagcgagcccctgagctcaaagatgtacaccacttcaataacaagtgaccctaaggccgacagcactggggaccagacctcagccctacctccctcaacttccatcaatgagggatcccctctttggacttccattggtgccagcactggttcccctttacctgagccaacaacctaccaggaagtttccatcaagatgtcatcagtgccccaggaaacccctcatgcaaccagtcatcctgctgttcccataacagcaaactctctaggatcccacaccgtgacaggtggaaccataacaacgaactctccagaaacctccagtaggaccagtggagcccctgttaccacggcagctagctctctggagacctccagaggcacctctggaccccctcttaccatggcaactgtctctctggagacttccaaaggcacctctggaccccctgttaccatggcaactgactctctggagacctccactgggaccactggaccccctgttaccatgacaactggctctctggagccctccagcggggccagtggaccccaggtctctagcgtaaaactatctacaatgatgtctccaacgacctccaccaacgcaagcactgtgcccttccggaacccagatgagaactcacgaggcatgctgccagtggctgtgcttgtggccctgctggcggtcatagtcctcgtggctctgctcctgctgtggcgccggcggcagaagcggcggactggggccctcgtgctgagcagaggcggcaagcgtaacggggtggtggacgcctgggctgggccagcccaggtccctgaggagggggccgtgacagtgaccgtgggagggtccgggggcgacaagggctctgggttccccgatggggaggggtctagccgtcggcccacgctcaccactttctttggcagacggaagtctcgccagggctccctggcgatggaggagctgaagtctgggtcaggccccagcctcaaaggggaggaggagccactggtggccagtgaggatggggctgtggacgccccagctcctgatgagcccgaagggggagacggggctgccccttaagtgtcggtgaatagtgaggctggaggccggaatctcagccagcctccagcaccttccctctcaccatcccactgccccctcgctcccatgtttccacccggcaccctgatcctcacccgaatctcctttttttttttcttttgagacagagtttcgctttgtcgcccaggctggagtgcaatgcacgatctcagttcactgcaacctctgcctcctaagttcaggcgattctcctgcctcagcttcccgagtaactgagattacaggcacccaccaccatgcccagctgcttttttgtatttttggtagagatggggtttcaccatgttggctaggctggtctcaaactcctgacctcaggtgatctacctgcctcagcctcccaaagtgctgagattacagacatgagcctccgcgccttgcctcctcacccacctcttcactctgaatcctcatgaggcttctcagccctggatttcctgctgccatcctcacccagcacccacaactagcgcctgggcagggcagggctggcacctctcaacgtctgtggactgaatgaataaaccctcctcatccacccctatttatctcca

SEQ ID NO: 181419 - DNA, 1197 bp, Homo sapiens
  Payload ID: 15731
  Gene Symbol: SPN
  Gene Name: sialophorin
  ENST ID: ENST00000436527
  CDS Start-End: 133-1197
cctttccccttggggccctgtccttcccagtcttgccccagcctcgggaggtggtggagtgacctggccccagtgctgcgtccttatcagccgagccggtcccagctcttgctcctgcctgtttgcctggaaatggccacgcttctccttctccttggggtgctggtggtaagcccagacgctctggggagcacaacagcagtgcagacacccacctccggagagcctttggtctctactagcgagcccctgagctcaaagatgtacaccacttcaataacaagtgaccctaaggccgacagcactggggaccagacctcagccctacctccctcaacttccatcaatgagggatcccctctttggacttccattggtgccagcactggttcccctttacctgagccaacaacctaccaggaagtttccatcaagatgtcatcagtgccccaggaaacccctcatgcaaccagtcatcctgctgttcccataacagcaaactctctaggatcccacaccgtgacaggtggaaccataacaacgaactctccagaaacctccagtaggaccagtggagcccctgttaccacggcagctagctctctggagacctccagaggcacctctggaccccctcttaccatggcaactgtctctctggagacttccaaaggcacctctggaccccctgttaccatggcaactgactctctggagacctccactgggaccactggaccccctgttaccatgacaactggctctctggagccctccagcggggccagtggaccccaggtctctagcgtaaaactatctacaatgatgtctccaacgacctccaccaacgcaagcactgtgcccttccggaacccagatgagaactcacgaggcatgctgccagtggctgtgcttgtggccctgctggcggtcatagtcctcgtggctctgctcctgctgtggcgccggcggcagaagcggcggactggggccctcgtgctgagcagaggcggcaagcgtaacggggtggtggacgcctgggctgggccagcccaggtccctgaggagggggccgtgacagtgaccgtgggagggtccgggggcgacaagggctctgggttccccgatggggaggggtctagccgtcggcccacgctcaccactttctttggcagacggaagtctcgccagggctcc

SEQ ID NO: 181420 - DNA, 1853 bp, Homo sapiens
  Payload ID: 15731
  Gene Symbol: SPN
  Gene Name: sialophorin
  Uniprot ID: P16150
  ENST ID: ENST00000563039
  CDS Start-End: 97-1299
cccagcctcgggaggtggtggagtgacctggccccagtgctgcgtccttatcagccgagccggtcccagctcttgctcctgcctgtttgcctggaaatggccacgcttctccttctccttggggtgctggtggtaagcccagacgctctggggagcacaacagcagtgcagacacccacctccggagagcctttggtctctactagcgagcccctgagctcaaagatgtacaccacttcaataacaagtgaccctaaggccgacagcactggggaccagacctcagccctacctccctcaacttccatcaatgagggatcccctctttggacttccattggtgccagcactggttcccctttacctgagccaacaacctaccaggaagtttccatcaagatgtcatcagtgccccaggaaacccctcatgcaaccagtcatcctgctgttcccataacagcaaactctctaggatcccacaccgtgacaggtggaaccataacaacgaactctccagaaacctccagtaggaccagtggagcccctgttaccacggcagctagctctctggagacctccagaggcacctctggaccccctcttaccatggcaactgtctctctggagacttccaaaggcacctctggaccccctgttaccatggcaactgactctctggagacctccactgggaccactggaccccctgttaccatgacaactggctctctggagccctccagcggggccagtggaccccaggtctctagcgtaaaactatctacaatgatgtctccaacgacctccaccaacgcaagcactgtgcccttccggaacccagatgagaactcacgaggcatgctgccagtggctgtgcttgtggccctgctggcggtcatagtcctcgtggctctgctcctgctgtggcgccggcggcagaagcggcggactggggccctcgtgctgagcagaggcggcaagcgtaacggggtggtggacgcctgggctgggccagcccaggtccctgaggagggggccgtgacagtgaccgtgggagggtccgggggcgacaagggctctgggttccccgatggggaggggtctagccgtcggcccacgctcaccactttctttggcagacggaagtctcgccagggctccctggcgatggaggagctgaagtctgggtcaggccccagcctcaaaggggaggaggagccactggtggccagtgaggatggggctgtggacgccccagctcctgatgagcccgaagggggagacggggctgccccttaagtgtcggtgaatagtgaggctggaggccggaatctcagccagcctccagcaccttccctctcaccatcccactgccccctcgctcccatgtttccacccggcaccctgatcctcacccgaatctcctttttttttttcttttgagacagaagcaagactccgtcttggaaaaaaatttaaaaaaagaaaatataaaatatggtataagattaaatatattagttatgaaaataattgtaaatggcttattgaacttatagtcagtaaaaatcatgtttttgaaaattatgtaatgactttggaaaataccagcaatataatgttaagtggggaaaaaagcaagttactcctctgtaatacatatgattttagttttgtaataaaaattcccaaccatatatgcacttatagggaaacaaaggacccatcgcaaatgttttccatgctgatctccaaagtggtgagtttatgtgtgatttttattttgtttatgctcttctgtattttccgaatttcatacaataaatatctgttacttttacaatatgaaaaaa

SEQ ID NO: 181421 - DNA, 5080 bp, Homo sapiens
  Payload ID: 15732
  Gene Symbol: SIDT1
  Gene Name: SID1 transmembrane family, member 1
  Uniprot ID: Q9NXL6
  ENST ID: ENST00000264852
  CDS Start-End: 727-3210
acatatttacatacatacacatatggtgagggagagaacgtgatgacgtgagactctccatggagagtaggaggtaataaagaaataaaacaggtgtctgaggagaggttctattagagaggggagaatagagagtaattatcgttcagacaggcaagagttctctgcaggtagcagcctgggaaagcgaactcgcgcaccctcttgggggacgggctcttttgctttctatttcttctcctgcagccagggtgcacacgtatttgaaacagaccgaatttcctcctcgatgtggcgtcaggttgacttttcgagactagcgggtatttctttttaatgactccaatgcctttttattattgctgttattgaggttgagggagaagagatcggtctaaattctggctgggtaagtggggggattctcggcgatgagaaacgggggacttagaagccggaggaaaatcagcagccccacatctccacttctccagtccgccctactctccacccgtgacctccagtggagaccccaggcggcagcatcagtatttgatcggcccttcgtcagcacgctgccagccctggccggctgggttcgccaggcatcacccgctcggctctgaagcggacgcctggccctgcaccgggctttggaaggaccctctctgcgctcgccccctccccagggtggctccgctttcgagcccgggcgcggtgcccaccatgcgcggctgcctgcggctcgcgctgctctgcgcgctgccctggctcctgctggcggcgtcgcccgggcacccggcgaaatcccccaggcagcccccggcaccgcgccgcgaccccttcgacgctgccaggggcgccgatttcgatcatgtctacagcggggtggtgaacctcagcaccgagaacatctactctttcaactacaccagccagcccgaccaggtgacagccgtgagggtgtatgtgaacagttcctctgagaatctcaactacccggtccttgttgtggttcgccagcagaaagaggtgctgtcctggcaggttcctctgctcttccaaggactataccagaggagctacaactatcaagaagtgagccgcaccttatgtccctcagaagcaaccaatgagacgggacccttgcagcaactgatatttgtagatgtcgcatccatggcacccctgggtgctcagtacaaactgctagttaccaagctgaagcacttccagctccggacaaatgttgcctttcactttactgccagcccctctcaacctcagtattttctatacaagtttcccaaagacgtggactcagttatcattaaagtggtgtctgaaatggcttatccatgttctgttgtctcagtccagaatatcatgtgcccggtgtatgatctcgaccacaatgtggaatttaatggtgtctatcagtccatgaccaagaaagctgccatcacgctacagaagaaggattttccaggcgagcagttcttcgtggtatttgtgataaagcctgaagattatgcctgtggaggatctttcttcatccaggaaaaggaaaaccagacctggaatctacagcgaaaaaagaaccttgaagtgaccattgtcccttccattaaagaatctgtttatgtgaaatccagtcttttcagtgtcttcatcttcctgtccttctacttgggatgccttcttgttgggtttgttcattatctgaggtttcagagaaaatccattgatggaagctttgggtccaatgatggctctggaaatatggtggcatctcatcccattgctgccagcacacccgaagggagcaattatgggacaatagatgagtcaagctccagtcctggaaggcagatgtcctcctccgatggtgggccaccgggccagtcagacacagacagctccgtggaggagagcgacttcgacaccatgccagacattgagagtgataaaaacatcatccggaccaagatgttcctttacctgtcagatttgtccaggaaggaccggagaattgtcagcaaaaaatataaaatttatttttggaacatcatcaccattgctgtgttttacgcgctgcccgtgatccagctggtcattacctatcagacagtggtaaatgtcactggcaaccaggacatctgttactacaacttcctctgtgctcaccccttgggcgtcctgagtgccttcaacaacattctcagcaatctgggccacgtgcttctgggcttcctcttcctgctgatagtcttgcgccgcgacatcctccatcggagagccctggaagccaaggacatctttgctgtggagtacgggattcccaaacactttggtctcttctacgctatgggcattgcattgatgatggaaggggtgctcagtgcttgctaccatgtctgccctaattattccaacttccaattcgacacctccttcatgtacatgatcgctggcctgtgcatgctgaagctctatcagacccgccacccagacatcaatgccagcgcctactctgcctatgcctcctttgctgtggtcatcatggtcaccgtccttggagtggtgtttggaaaaaatgacgtatggttctgggtcatcttctctgcaatccacgttctggcctcgctagccctcagcacccagatatattatatgggtcgtttcaagatagatttgggaattttccggcgggctgccatggtgttctacacagactgtatccagcagtgtagccgacctctatatatggatagaatggtgttgctggttgtggggaatctggttaactggtccttcgccctctttggattgatataccgccccagggactttgcttcctacatgctgggcatcttcatctgtaaccttttgctgtacctggccttttacatcatcatgaagctccgcagctctgaaaaggtcctcccagtcccgctcttctgcatcgtggccaccgctgtgatgtgggctgccgccctatattttttcttccagaatctcagcagctgggagggaactccggccgaatcccgggagaagaaccgcgagtgcattctgctggatttcttcgatgaccatgacatctggcacttcctctctgctactgctctgtttttctcattcttggttttgttaactttggatgatgaccttgatgtggttcggagagaccagatccctgtcttctgaacctccaacattaagagaggggagggagcgatcaatcttggtgctgtttcacaaaaattacagtgaccacagcaaagtaaccactgccagatgctccactcaccctctgtagagccaactctgcattcacacaggaaggagaggggctgcgggagatttaaacctgcaagaaaggaggcagaaggggagccatgttttgaggacagacgcaaacctgaggagctgagaaacacttgctccttccatctgcagctttgggagtgcaacagggataggcactgcatccaagtcaactcaccatcttggggtccctcccaccctcacggagacttgccagcaatggcagaatgctgctgcacacttccctccagttgtcaccctgcccagaaaggccagcagcttggacttcctgcccagaaactgtgttggcccccttcacacctctgcaacacctgctgctccagcaagaggatgtgattctttagaatatggcggggaggtgaccccaggccctgccctactgggatagatgttttaatggcaccagctagtcacctcccagaagaaactctgtatatttcccccaggtttctgatgccatcagaagggctcaggagtggggtttgtcacacattcctcttaacaagtaactgtcactgggaccgagtcctgggtgcttacatattccttcgtgtcttcatctcactgacctgtgtggacctcatcactctgactctgccttcttggaaaggccctgtcactccacagatgtctggccagcttcaaggcagaaggaaaaacaggaaaagctcttttaacagcagcaggaacaagagaaatgactaaccatactaaaagactggtaacagcagcagcagccagacaggcctcaccttaaggacttgggctgccagagcaaattcagcagagcttatttggcctcccattcacacagctcagttctgtgcccacatcacctttggggaagaaatcagcattctaatcagggacactacttcaggagtcctccacagcgagtccgtcatctgtcactttatgtagatcagggttctagacttcttccctgaggttctcagaagcagctctcaggatgaacgtattgtcctcttcccctcttcttgcaaagtgcacagctaatctaatgttgtctctcggttgcacctgacattctctccccagtaaggtgttggcaagctcagcatctgggttccactctcacactgtctggcagctctgtgtctgagaagttctacattgaccaggcccccttgttgcctggagtatgacgtaatcagaaaatagacgtataaatgtgcacatgcgtatgtatttgcttgtgaaattaaagtcacctcttgcctctgctttcctgatcattcgttagagaaatggatcaggcatttttttaaattattattctttctctaaactatttgcattgtgttcaaaaacccattttagaagtttgaacagcaagcttttcctgattttaaaaacacaaagttgctttcaatgaaatattttgtgatttttttaaagtccccaaatgtgtacttagccttctgttattccttattctttaagcagtgttggcttccattgaccatatgaaggccaccaattaaatggttgtgttaatccaacatgtaaaaaactttttggcagggcacagtggctcacgcctgtaatcccaacactttgggaggctgaggcaggaggatcacttgagcccaggagattgacgccgcagtgaactatgattgtgcccctgcactccagcctggatgacagagtgagaccccatctcttaaaaaataaaaaaaaataaaaatttgaacctgtttcacta

SEQ ID NO: 181422 - DNA, 2572 bp, Homo sapiens
  Payload ID: 15732
  Gene Symbol: SIDT1
  Gene Name: SID1 transmembrane family, member 1
  Uniprot ID: Q9NXL6
  ENST ID: ENST00000393830
  CDS Start-End: 40-2538
agggtggctccgctttcgagcccgggcgcggtgcccaccatgcgcggctgcctgcggctcgcgctgctctgcgcgctgccctggctcctgctggcggcgtcgcccgggcacccggcgaaatcccccaggcagcccccggcaccgcgccgcgaccccttcgacgctgccaggggcgccgatttcgatcatgtctacagcggggtggtgaacctcagcaccgagaacatctactctttcaactacaccagccagcccgaccaggtgacagccgtgagggtgtatgtgaacagttcctctgagaatctcaactacccggtccttgttgtggttcgccagcagaaagaggtgctgtcctggcaggttcctctgctcttccaaggactataccagaggagctacaactatcaagaagtgagccgcaccttatgtccctcagaagcaaccaatgagacgggacccttgcagcaactgatatttgtagatgtcgcatccatggcacccctgggtgctcagtacaaactgctagttaccaagctgaagcacttccagctccggacaaatgttgcctttcactttactgccagcccctctcaacctcagtattttctatacaagtttcccaaagacgtggactcagttatcattaaagtggtgtctgaaatggcttatccatgttctgttgtctcagtccagaatatcatgtgcccggtgtatgatctcgaccacaatgtggaatttaatggtgtctatcagtccatgaccaagaaagctgccatcacgctacagaagaaggattttccaggcgagcagttcttcgtggtatttgtgataaagcctgaagattatgcctgtggaggatctttcttcatccaggaaaaggaaaaccagacctggaatctacagcgaaaaaagaaccttgaagtgaccattgtcccttccattaaagaatctgtttatgtgaaatccagtcttttcagtgtcttcatcttcctgtccttctacttgggatgccttcttgttgggtttgttcattatctgaggtttcagagaaaatccattgatggaagctttgggtccaatgatggctctggaaatatggtggcatctcatcccattgctgccagcacacccgaagggagcaattatgggacaatagatgagtcaagctccagtcctggaaggcagatgtcctcctccgatggtgggccaccgggccagtcagacacagacagctccgtggaggagagcgacttcgacaccatgccagacattgagagtgataaaaacatcatccggaccaagatgttcctttacctgtcagatttgtccaggaaggaccggagaattgtcagcaaaaaatataaaatttatttttggaacatcatcaccattgctgtgttttacgcgctgcccgtgatccagctggtcattacctatcagacagtggtaaatgtcactggcaaccaggacatctgttactacaacttcctctgtgctcaccccttgggcgtcctgagtgccttcaacaacattctcagcaatctgggccacgtgcttctgggcttcctcttcctgctgatagtcttgcgccgcgacatcctccatcggagagccctggaagccaaggacatctttgctgtggagtacgggattcccaaacactttggtctcttctacgctatgggcattgcattgatgatggaaggggtgctcagtgcttgctaccatgtctgccctaattattccaacttccaattcgacacctccttcatgtacatgatcgctggcctgtgcatgctgaagctctatcagacccgccacccagacatcaatgccagcgcctactctgcctatgcctcctttgctgtggtcatcatggtcaccgtccttggagtggtgtttggaaaaaatgacgtatggttctgggtcatcttctctgcaatccacgttctggcctcgctagccctcagcacccagatatattatatgggtcgtttcaagatagatgtgtctgacacagatttgggaattttccggcgggctgccatggtgttctacacagactgtatccagcagtgtagccgacctctatatatggatagaatggtgttgctggttgtggggaatctggttaactggtccttcgccctctttggattgatataccgccccagggactttgcttcctacatgctgggcatcttcatctgtaaccttttgctgtacctggccttttacatcatcatgaagctccgcagctctgaaaaggtcctcccagtcccgctcttctgcatcgtggccaccgctgtgatgtgggctgccgccctatattttttcttccagaatctcagcagctgggagggaactccggccgaatcccgggagaagaaccgcgagtgcattctgctggatttcttcgatgaccatgacatctggcacttcctctctgctactgctctgtttttctcattcttggttttgttaactttggatgatgaccttgatgtggttcggagagaccagatccctgtcttctgaacctccaacattaagagaggggagggagcgatca

SEQ ID NO: 181423 - DNA, 3135 bp, Homo sapiens
  Payload ID: 15733
  Gene Symbol: SIDT2
  Gene Name: SID1 transmembrane family, member 2
  ENST ID: ENST00000278951
  CDS Start-End: 84-2651
gccgcaacccgtcccggaggtgtcctgtctcctgtcgccgccgccgccgccaccaccgctgccactgccgccctgccggggccatgttcgctctgggcttgcccttcttggtgctcttggtggcctcggtcgagagccatctgggggttctggggcccaagaacgtctcgcagaaagacgccgagtttgagcgcacctacgtggacgaggtcaacagcgagctggtcaacatctacaccttcaaccatactgtgacccgcaacaggacagagggcgtgcgtgtgtctgtgaacgtcctgaacaagcagaagggggcgccgttgctgtttgtggtccgccagaaggaggctgtggtgtccttccaggtgcccctaatcctgcgagggatgtttcagcgcaagtacctctaccaaaaagtggaacgaaccctgtgtcagccccccaccaagaatgagtcggagattcagttcttctacgtggatgtgtccaccctgtcaccagtcaacaccacataccagctccgggtcagccgcatggacgattttgtgctcaggactggggagcagttcagcttcaataccacagcagcacagccccagtacttcaagtatgagttccctgaaggcgtggactcggtaattgtcaaggtgacctccaacaaggccttcccctgctcagtcatctccattcaggatgtgctgtgtcctgtctatgacctggacaacaacgtagccttcatcggcatgtaccagacgatgaccaagaaggcggccatcaccgtacagcgcaaagacttccccagcaacagcttttatgtggtggtggtggtgaagaccgaagaccaagcctgcgggggctccctgcctttctaccccttcgcagaagatgaaccggtcgatcaagggcaccgccagaaaaccctgtcagtgctggtgtctcaagcagtcacgtctgaggcatacgtcagtgggatgctcttttgcctgggtatatttctctccttttacctgctgaccgtcctcctggcctgctgggagaactggaggcagaagaagaagaccctgctggtggccattgaccgagcctgcccagaaagcggtcaccctcgagtcctggctgattcttttcctggcagttccccttatgagggttacaactatggctcctttgagaatgtttctggatctaccgatggtctggttgacagcgctggcactggggacctctcttacggttaccaggggcacgaccagttcaagcggcgcctcccctctggccagatgcggcagctgtgcattgccatgggccgctcctttgaacctgtaggtactcggccccgagtggactccatgagctctgtggaggaggatgactacgacacattgaccgacatcgattccgacaagaatgtcattcgcaccaagcaatacctctatgtggctgacctggcacggaaggacaagcgtgttctgcggaaaaagtaccagatctacttctggaacattgccaccattgctgtcttctatgcccttcctgtggtgcagctggtgatcacctaccagacggtggtgaatgtcacagggaatcaggacatctgctactacaacttcctctgcgcccacccactgggcaatctcagcgccttcaacaacatcctcagcaacctggggtacatcctgctggggctgcttttcctgctcatcatcctgcaacgggagatcaaccacaaccgggccctgctgcgcaatgacctctgtgccctggaatgtgggatccccaaacactttgggcttttctacgccatgggcacagccctgatgatggaggggctgctcagtgcttgctatcatgtgtgccccaactataccaatttccagtttgacacatcgttcatgtacatgatcgccggactctgcatgctgaagctctaccagaagcggcacccggacatcaacgccagcgcctacagtgcctacgcctgcctggccattgtcatcttcttctctgtgctgggcgtggtctttggcaaagggaacacggcgttctggatcgtcttctccatcattcacatcatcgccaccctgctcctcagcacgcagctctattacatgggccggtggaaactggactcggggatcttccgccgcatcctccacgtgctctacacagactgcatccggcagtgcagcgggccgctctacgtggaccgcatggtgctgctggtcatgggcaacgtcatcaactggtcgctggctgcctatgggcttatcatgcgccccaatgatttcgcttcctacttgttggccattggcatctgcaacctgctcctttacttcgccttctacatcatcatgaagctccggagtggggagaggatcaagctcatccccctgctctgcatcgtttgcacctccgtggtctggggcttcgcgctcttcttcttcttccagggactcagcacctggcagaaaacccctgcagagtcgagggagcacaaccgggactgcatcctcctcgacttctttgacgaccacgacatctggcacttcctctcctccatcgccatgttcgggtccttcctggtaagcgggcctcccggccgagccgggtgggtacgtgaaggtagcagctgcctccttctctgtggctgatctggcgtccacaccccaggtgttgctgacactggatgacgacctggatactaaaggggcttcaggaagggatgtgctgtttccctctacgtgcccagtcctagcctcgctctaggacccagggctggcttctaagtttccgtccagtcttcaggcaagttctgtgttagtcatgcacacacatacctatgaaaccttggagtttacaaagaattgccccagctctgggcaccctggccaccctggtccttggatccccttcgtcccacctggtccaccccagatgctgaggatgggggagctcaggcggggcctctgctttggggatgggaatgtgtttttctcccaaacttgtttttatagctctgcttgaagggctgggagatgaggtgggtctggatcttttctcagagcgtctccatgctatggttgcatttccgttttctatgaatgaatttgcattcaataaacaaccagactcagt

SEQ ID NO: 181424 - DNA, 4406 bp, Homo sapiens
  Payload ID: 15733
  Gene Symbol: SIDT2
  Gene Name: SID1 transmembrane family, member 2
  Uniprot ID: Q8NBJ9
  ENST ID: ENST00000324225
  CDS Start-End: 532-3030
ctcacttttcagtgttcgtgcgtcgggacggcgcgtccgcccgcccttaaagggcccgcacctcggaaaactcgcagcccagcacggcgtcgggtagctaccacctatcacgcccctcactctgcgactcgccttcctccgcggccagcccccgccgccggctcttcctccctcccctttcccggcgtctccaggctcccggcaaccagccgccctccttctcacggccctggcccggggctccagggtctcaggtcgtactcagcccctcgcgagctgggaccccttcccgtagccagcatcccctccctccccgccccctcccggccgccccctcccctgcggggaccctgggagcctcttcggggctcttgggaggggacatttcctaatctcaggccggggttaaagttctggtcctggtgagatgctggaagctgcggccgcagccgcaacccgtcccggaggtgtcctgtctcctgtcgccgccgccgccgccaccaccgctgccactgccgccctgccggggccatgttcgctctgggcttgcccttcttggtgctcttggtggcctcggtcgagagccatctgggggttctggggcccaagaacgtctcgcagaaagacgccgagtttgagcgcacctacgtggacgaggtcaacagcgagctggtcaacatctacaccttcaaccatactgtgacccgcaacaggacagagggcgtgcgtgtgtctgtgaacgtcctgaacaagcagaagggggcgccgttgctgtttgtggtccgccagaaggaggctgtggtgtccttccaggtgcccctaatcctgcgagggatgtttcagcgcaagtacctctaccaaaaagtggaacgaaccctgtgtcagccccccaccaagaatgagtcggagattcagttcttctacgtggatgtgtccaccctgtcaccagtcaacaccacataccagctccgggtcagccgcatggacgattttgtgctcaggactggggagcagttcagcttcaataccacagcagcacagccccagtacttcaagtatgagttccctgaaggcgtggactcggtaattgtcaaggtgacctccaacaaggccttcccctgctcagtcatctccattcaggatgtgctgtgtcctgtctatgacctggacaacaacgtagccttcatcggcatgtaccagacgatgaccaagaaggcggccatcaccgtacagcgcaaagacttccccagcaacagcttttatgtggtggtggtggtgaagaccgaagaccaagcctgcgggggctccctgcctttctaccccttcgcagaagatgaaccggtcgatcaagggcaccgccagaaaaccctgtcagtgctggtgtctcaagcagtcacgtctgaggcatacgtcagtgggatgctcttttgcctgggtatatttctctccttttacctgctgaccgtcctcctggcctgctgggagaactggaggcagaagaagaagaccctgctggtggccattgaccgagcctgcccagaaagcggtcaccctcgagtcctggctgattcttttcctggcagttccccttatgagggttacaactatggctcctttgagaatgtttctggatctaccgatggtctggttgacagcgctggcactggggacctctcttacggttaccagggccgctcctttgaacctgtaggtactcggccccgagtggactccatgagctctgtggaggaggatgactacgacacattgaccgacatcgattccgacaagaatgtcattcgcaccaagcaatacctctatgtggctgacctggcacggaaggacaagcgtgttctgcggaaaaagtaccagatctacttctggaacattgccaccattgctgtcttctatgcccttcctgtggtgcagctggtgatcacctaccagacggtggtgaatgtcacagggaatcaggacatctgctactacaacttcctctgcgcccacccactgggcaatctcagcgccttcaacaacatcctcagcaacctggggtacatcctgctggggctgcttttcctgctcatcatcctgcaacgggagatcaaccacaaccgggccctgctgcgcaatgacctctgtgccctggaatgtgggatccccaaacactttgggcttttctacgccatgggcacagccctgatgatggaggggctgctcagtgcttgctatcatgtgtgccccaactataccaatttccagtttgacacatcgttcatgtacatgatcgccggactctgcatgctgaagctctaccagaagcggcacccggacatcaacgccagcgcctacagtgcctacgcctgcctggccattgtcatcttcttctctgtgctgggcgtggtctttggcaaagggaacacggcgttctggatcgtcttctccatcattcacatcatcgccaccctgctcctcagcacgcagctctattacatgggccggtggaaactggactcggggatcttccgccgcatcctccacgtgctctacacagactgcatccggcagtgcagcgggccgctctacgtggaccgcatggtgctgctggtcatgggcaacgtcatcaactggtcgctggctgcctatgggcttatcatgcgccccaatgatttcgcttcctacttgttggccattggcatctgcaacctgctcctttacttcgccttctacatcatcatgaagctccggagtggggagaggatcaagctcatccccctgctctgcatcgtttgcacctccgtggtctggggcttcgcgctcttcttcttcttccagggactcagcacctggcagaaaacccctgcagagtcgagggagcacaaccgggactgcatcctcctcgacttctttgacgaccacgacatctggcacttcctctcctccatcgccatgttcgggtccttcctggtgttgctgacactggatgacgacctggatactgtgcagcgggacaagatctatgtcttctagcaggagctgggcccttcgcttcacctcaaggggccctgagctcctttgtgtcatagaccggtcactctgtcgtgctgtggggatgagtcccagcaccgctgcccagcactggatggcagcaggacagccaggtctagcttaggcttggcctgggacagccatggggtggcatggaaccttgcagctgccctctgccgaggagcaggcctgctcccctggaacccccagatgttggccaaattgctgctttcttctcagtgttggggccttccatgggcccctgtcctttggctctccatttgtccctttgcaagaggaaggatggaagggacaccctccccatttcatgccttgcattttgcccgtcctcctccccacaatgccccagcctgggacctaaggcctctttttcctcccatactcccactccagggcctagtctggggcctgaatctctgtcctgtatcagggccccagttctctttgggctgtccctggctgccatcactgcccattccagtcagccaggatggatgggggtatgagattttgggggttggccagctggtgccagacttttggtgctaaggcctgcaaggggcctggggcagtgcgtattctcttccctctgacctgtgctcagggctggctctttagcaatgcgctcagcccaatttgagaaccgccttctgattcaagaggctgaattcagaggtcacctcttcatcccatcagctcccagactgatgccagcaccaggactggagggagaagcgcctcaccccttcccttccttctttccaggcccttagtcttgccaaaccccagctggtggcctttcagtgccattgacactgcccaagaatgtccaggggcaaaggagggatgatacagagttcagcccgttctgcctccacagctgtgggcaccccagtgcctaccttagaaaggggcttcaggaagggatgtgctgtttccctctacgtgcccagtcctagcctcgctctaggacccagggctggcttctaagtttccgtccagtcttcaggcaagttctgtgttagtcatgcacacacatacctatgaaaccttggagtttacaaagaattgccccagctctgggcaccctggccaccctggtccttggatccccttcgtcccacctggtccaccccagatgctgaggatgggggagctcaggcggggcctctgctttggggatgggaatgtgtttttctcccaaacttgtttttatagctctgcttgaagggctgggagatgaggtgggtctggatcttttctcagagcgtctccatgctatggttgcatttccgttttctatgaatgaatttgcattcaataaacaaccagactca

SEQ ID NO: 181425 - DNA, 3910 bp, Homo sapiens
  Payload ID: 15733
  Gene Symbol: SIDT2
  Gene Name: SID1 transmembrane family, member 2
  ENST ID: ENST00000431081
  CDS Start-End: 42-2531
gccgccgccaccaccgctgccactgccgccctgccggggccatgttcgctctgggcttgcccttcttggtgctcttggtggcctcggtcgagagccatctgggggttctggggcccaagaacgtctcgcagaaagacgccgagtttgagcgcacctacgtggacgaggtcaacagcgagctggtcaacatctacaccttcaaccatactgtgacccgcaacaggacagagggcgtgcgtgtgtctgtgaacgtcctgaacaagcagaagggggcgccgttgctgtttgtggtccgccagaaggaggctgtggtgtccttccaggtgcccctaatcctgcgagggatgtttcagcgcaagtacctctaccaaaaagtggaacgaaccctgtgtcagccccccaccaagaatgagtcggagattcagttcttctacgtggatgtgtccaccctgtcaccagtcaacaccacataccagctccgggtcagccgcatggacgattttgtgctcaggactggggagcagttcagcttcaataccacagcagcacagccccagtacttcaagtatgagttccctgaaggcgtggactcggtaattgtcaaggtgacctccaacaaggccttcccctgctcagtcatctccattcaggatgtgctgtgtcctgtctatgacctggacaacaacgtagccttcatcggcatgtaccagacgatgaccaagaaggcggccatcaccgtacagcgcaaagacttccccagcaacagcttttatgtggtggtggtggtgaagaccgaagaccaagcctgcgggggctccctgcctttctaccccttcgcagaagatgaaccggtcgatcaagggcaccgccagaaaaccctgtcagtgctggtgtctcaagcagtcacgtctgaggcatacgtcagtgggatgctcttttgcctgggtatatttctctccttttacctgctgaccgtcctcctggcctgctgggagaactggaggcagaagaagaagaccctgctggtggccattgaccgagcctgcccagaaagcgcttctctccttggtcaccctcgagtcctggctgattcttttcctggcagttccccttatgagggttacaactatggctcctttgagaatgtttctggatctaccgatggtctggttgacagcgctggcactggggacctctcttacggttaccagggtactcggccccgagtggactccatgagctctgtggaggaggatgactacgacacattgaccgacatcgattccgacaagaatgtcattcgcaccaagcaatacctctatgtggctgacctggcacggaaggacaagcgtgttctgcggaaaaagtaccagatctacttctggaacattgccaccattgctgtcttctatgcccttcctgtggtgcagctggtgatcacctaccagacggtggtgaatgtcacagggaatcaggacatctgctactacaacttcctctgcgcccacccactgggcaatctcagcgccttcaacaacatcctcagcaacctggggtacatcctgctggggctgcttttcctgctcatcatcctgcaacgggagatcaaccacaaccgggccctgctgcgcaatgacctctgtgccctggaatgtgggatccccaaacactttgggcttttctacgccatgggcacagccctgatgatggaggggctgctcagtgcttgctatcatgtgtgccccaactataccaatttccagtttgacacatcgttcatgtacatgatcgccggactctgcatgctgaagctctaccagaagcggcacccggacatcaacgccagcgcctacagtgcctacgcctgcctggccattgtcatcttcttctctgtgctgggcgtggtctttggcaaagggaacacggcgttctggatcgtcttctccatcattcacatcatcgccaccctgctcctcagcacgcagctctattacatgggccggtggaaactggactcggggatcttccgccgcatcctccacgtgctctacacagactgcatccggcagtgcagcgggccgctctacgtggaccgcatggtgctgctggtcatgggcaacgtcatcaactggtcgctggctgcctatgggcttatcatgcgccccaatgatttcgcttcctacttgttggccattggcatctgcaacctgctcctttacttcgccttctacatcatcatgaagctccggagtggggagaggatcaagctcatccccctgctctgcatcgtttgcacctccgtggtctggggcttcgcgctcttcttcttcttccagggactcagcacctggcagaaaacccctgcagagtcgagggagcacaaccgggactgcatcctcctcgacttctttgacgaccacgacatctggcacttcctctcctccatcgccatgttcgggtccttcctggtgttgctgacactggatgacgacctggatactgtgcagcgggacaagatctatgtcttctagcaggagctgggcccttcgcttcacctcaaggggccctgagctcctttgtgtcatagaccggtcactctgtcgtgctgtggggatgagtcccagcaccgctgcccagcactggatggcagcaggacagccaggtctagcttaggcttggcctgggacagccatggggtggcatggaaccttgcagctgccctctgccgaggagcaggcctgctcccctggaacccccagatgttggccaaattgctgctttcttctcagtgttggggccttccatgggcccctgtcctttggctctccatttgtccctttgcaagaggaaggatggaagggacaccctccccatttcatgccttgcattttgcccgtcctcctccccacaatgccccagcctgggacctaaggcctctttttcctcccatactcccactccagggcctagtctggggcctgaatctctgtcctgtatcagggccccagttctctttgggctgtccctggctgccatcactgcccattccagtcagccaggatggatgggggtatgagattttgggggttggccagctggtgccagacttttggtgctaaggcctgcaaggggcctggggcagtgcgtattctcttccctctgacctgtgctcagggctggctctttagcaatgcgctcagcccaatttgagaaccgccttctgattcaagaggctgaattcagaggtcacctcttcatcccatcagctcccagactgatgccagcaccaggactggagggagaagcgcctcaccccttcccttccttctttccaggcccttagtcttgccaaaccccagctggtggcctttcagtgccattgacactgcccaagaatgtccaggggcaaaggagggatgatacagagttcagcccgttctgcctccacagctgtgggcaccccagtgcctaccttagaaaggggcttcaggaagggatgtgctgtttccctctacgtgcccagtcctagcctcgctctaggacccagggctggcttctaagtttccgtccagtcttcaggcaagttctgtgttagtcatgcacacacatacctatgaaaccttggagtttacaaagaattgccccagctctgggcaccctggccaccctggtccttggatccccttcgtcccacctggtccaccccagatgctgaggatgggggagctcaggcggggcctctgctttggggatgggaatgtgtttttctcccaaacttgtttttatagctctgcttgaagggctgggagatgaggtgggtctggatcttttctcagagcgtctccatgctatggttgcatttccgttttctatgaatgaatttgcattcaataaacaaccagactcagtt

SEQ ID NO: 181426 - DNA, 540 bp, Homo sapiens
  Payload ID: 15733
  Gene Symbol: SIDT2
  Gene Name: SID1 transmembrane family, member 2
  ENST ID: ENST00000532960
  CDS Start-End: 211-540
acttttcagtgttcgtgcgtcgggacggcgcgtccgcccgcccttaaagggcccgcacctcggaaaactcgcagcccagcacggcgtcggttctggtcctggtgagatgctggaagctgcggccgcagccgcaacccgtcccggaggtgtcctgtctcctgtcgccgccgccgccgccaccaccgctgccactgccgccctgccggggccatgttcgctctgggcttgcccttcttggtgctcttggtggcctcggtcgagagccatctgggggttctggggcccaagaacgtctcgcagaaagacgccgagtttgagcgcacctacgtggacgaggtcaacagcgagctggtcaacatctacaccttcaaccatactgtgacccgcaacaggacagagggcgtgcgtgtgtctgtgaacgtcctgaacaagcagaagggggcgccgttgctgtttgtggtccgccagaaggaggctgtggtgtccttccaggtgcccctaatcctgcgagggatgtttcagcgcaagtacctctaccaa

SEQ ID NO: 181427 - DNA, 2143 bp, Homo sapiens
  Payload ID: 15733
  Gene Symbol: SIDT2
  Gene Name: SID1 transmembrane family, member 2
  ENST ID: ENST00000532062
  CDS Start-End: 556-930
ctgcatccggcagtgcagcgggccgctctacgtggtacctgcctggttcccctgctccattctccacatctcctttcttccctctgatgggggagtggggctgggctgaggacccaggggagagtggggaccagctggctgggccttcttccaccaccctccctgcccctgccctcagtccctgtgtccctgcttccctccaggaccgcatggtgctgctggtcatgggcaacgtcatcaactggtcgctgtgagtatggtcagcagtagtggcctggttgggtggacagctggggactcggtcagccactggctgccttgggggctaaggacaacttccaaatgttgggcataagacatgggggctaagagagatcttggcctctcttctctctcttggcatctgggcttctagaatcttctgtgggcttctgaacacagcccaacatcataataaaacatgcctaggcagggcaggaagagcacttccttgcccttgggcttcctgcttcaccacccttcatccctcttgccagggctgcctatgggcttatcatgcgccccaatgatttcgcttcctacttgttggccattggcatctgcaacctgctcctttacttcgccttctacatcatcatgaagctccggagtggggagaggatcaagctcatccccctgctctgcatcgtttgcacctccgtggtctggggcttcgcgctcttcttcttcttccagggactcagcacctggcagaaaacccctgcagagtcgagggagcacaaccgggactgcatcctcctcgacttctttgacgaccacgacatctggcacttcctctcctccatcgccatgttcgggtccttcctggtgttgctgacactggatgacgacctggatactgtgcagcgggacaagatctatgtcttctagcaggagctgggcccttcgcttcacctcaaggggccctgagctcctttgtgtcatagaccggtcactctgtcgtgctgtggggatgagtcccagcaccgctgcccagcactggatggcagcaggacagccaggtctagcttaggcttggcctgggacagccatggggtggcatggaaccttgcagctgccctctgccgaggagcaggcctgctcccctggaacccccagatgttggccaaattgctgctttcttctcagtgttggggccttccatgggcccctgtcctttggctctccatttgtccctttgcaagaggaaggatggaagggacaccctccccatttcatgccttgcattttgcccgtcctcctccccacaatgccccagcctgggacctaaggcctctttttcctcccatactcccactccagggcctagtctggggcctgaatctctgtcctgtatcagggccccagttctctttgggctgtccctggctgccatcactgcccattccagtcagccaggatggatgggggtatgagattttgggggttggccagctggtgccagacttttggtgctaaggcctgcaaggggcctggggcagtgcgtattctcttccctctgacctgtgctcagggctggctctttagcaatgcgctcagcccaatttgagaaccgccttctgattcaagaggctgaattcagaggtcacctcttcatcccatcagctcccagactgatgccagcaccaggactggagggagaagcgcctcaccccttcccttccttctttccaggcccttagtcttgccaaaccccagctggtggcctttcagtgccattgacactgcccaagaatgtccaggggcaaaggagggatgatacagagttcagcccgttctgcctccacagctgtgggcaccccagtgcctaccttagaaaggggcttcaggaagggatgtgctgtttccctctacgtgcccagtcctagcctcgctctaggacccagggctggcttctaagtttccgtccagtcttcaggcaagttctgtgttagtcatgcacacacatacctatgaaaccttggagtttacaaagaattgccccagctctgggcaccctggccaccctggtccttggatccccttcgtcccacctggtccaccccagatgctgaggatgggggagctcaggcggggcctctgc

SEQ ID NO: 181428 - DNA, 583 bp, Homo sapiens
  Payload ID: 15733
  Gene Symbol: SIDT2
  Gene Name: SID1 transmembrane family, member 2
  ENST ID: ENST00000531353
  CDS Start-End: 291-583
attcttccatcagttgtggtctgagcacacatggcttgctctctaccctaaaccccagaatctgacagctctgtggggtctcggtgggagaggaaacaggcttattactgggcttgcccagaaaacctcaggggaatgagactggcccagaactgaaaagctctgtgcaggcaaagggcgtgcgtgtgtctgtgaacgtcctgaacaagcagaagggggcgccgttgctgtttgtggtccgccagaaggaggctgtggtgtccttccaggtgcccctaatcctgcgagggatgtttcagcgcaagtacctctaccaaaaagtggaacgaaccctgtgtcagccccccaccaagaatgagtcggagattcagttcttctacgtggatgtgtccaccctgtcaccagtcaacaccacataccagctccgggtcagccgcatggacgattttgtgctcaggactggggagcagttcagcttcaataccacagcagcacagccccagtacttcaagtatgagttccctgaaggcgtggactcggtaattgtcaaggtgacctccaacaaggccttcccctgctcagt

SEQ ID NO: 181429 - DNA, 840 bp, Homo sapiens
  Payload ID: 15733
  Gene Symbol: SIDT2
  Gene Name: SID1 transmembrane family, member 2
  ENST ID: ENST00000525478
  CDS Start-End: 1-402
gggatcttccgccgcatcctccacgtgctctacacagactgcatccggcagtgcagcgggccgctctacgtggaccgcatggtgctgctggtcatgggcaacgtcatcaactggtcgctggctgcctatgggcttatcatgcgccccaatgatttcgcttcctacttgttggccattggcatctgcaacctgctcctttacttcgccttctacatcatcatgaagaaaacccctgcagagtcgagggagcacaaccgggactgcatcctcctcgacttctttgacgaccacgacatctggcacttcctctcctccatcgccatgttcgggtccttcctggtgttgctgacactggatgacgacctggatactgtgcagcgggacaagatctatgtcttctagcaggagctgggcccttcgcttcacctcaaggggccctgagctcctttgtgtcatagaccggtcactctgtcgtgctgtggggatgagtcccagcaccgctgcccagcactggatggcagcaggacagccaggtctagcttaggcttggcctgggacagccatggggtggcatggaaccttgcagctgccctctgccgaggagcaggcctgctcccctggaacccccagatgttggccaaattgctgctttcttctcagtgttggggccttccatgggcccctgtcctttggctctccatttgtccctttgcaagaggaaggatggaagggacaccctccccatttcatgccttgcattttgcccgtcctcctccccacaatgccccagcctgggacctaaggcctctttttcctcccatactcccactccagggccta

SEQ ID NO: 181430 - DNA, 834 bp, Homo sapiens
  Payload ID: 15733
  Gene Symbol: SIDT2
  Gene Name: SID1 transmembrane family, member 2
  ENST ID: ENST00000524842
  CDS Start-End: 323-834
gagcgcacctacgtggacgaggtcaacagcgagctggtcaacatctacaccttcaaccatactgtgacccgcaacaggacagagggcgtgcgtgtgtctgtgaacgtcctgaacaagcagaagggggcgccgttgctgtttgtggtccgccagaaggaggctgtggtgtccttccaggtttcagcgcaagtacctctaccaaaaagtggaacgaaccctgtgtcagccccccaccaagaatgagtcggagattcagttcttctacgtggatgtgtccaccctgtcaccagtcaacaccacataccagctccgggtcagccgcatggacgattttgtgctcaggactggggagcagttcagcttcaataccacagcagcacagccccagtacttcaagtatgagttccctgaaggcgtggactcggtaattgtcaaggtgacctccaacaaggccttcccctgctcagtcatctccattcaggatgtgctgtgtcctgtctatgacctggacaacaacgtagccttcatcggcatgtaccagacgatgaccaagaaggcggccatcaccgtacagcgcaaagacttccccagcaacagcttttatgtggtggtggtggtgaagaccgaagaccaagcctgcgggggctccctgcctttctaccccttcgcagaagatgaaccggtcgatcaagggcaccgccagaaaaccctgtcagtgctggtgtctcaagcagtcacgtctgaggcatacgtcagtgggatgctcttttgcctgggtatatttctctccttttacctgctgaccgtcctcctggcctgctgggagaactggag

SEQ ID NO: 181431 - DNA, 3924 bp, Homo sapiens
  Payload ID: 15733
  Gene Symbol: SIDT2
  Gene Name: SID1 transmembrane family, member 2
  Uniprot ID: Q8NBJ9
  ENST ID: ENST00000620360
  CDS Start-End: 51-2549
cggcaaccagccgccgccaccaccgctgccactgccgccctgccggggccatgttcgctctgggcttgcccttcttggtgctcttggtggcctcggtcgagagccatctgggggttctggggcccaagaacgtctcgcagaaagacgccgagtttgagcgcacctacgtggacgaggtcaacagcgagctggtcaacatctacaccttcaaccatactgtgacccgcaacaggacagagggcgtgcgtgtgtctgtgaacgtcctgaacaagcagaagggggcgccgttgctgtttgtggtccgccagaaggaggctgtggtgtccttccaggtgcccctaatcctgcgagggatgtttcagcgcaagtacctctaccaaaaagtggaacgaaccctgtgtcagccccccaccaagaatgagtcggagattcagttcttctacgtggatgtgtccaccctgtcaccagtcaacaccacataccagctccgggtcagccgcatggacgattttgtgctcaggactggggagcagttcagcttcaataccacagcagcacagccccagtacttcaagtatgagttccctgaaggcgtggactcggtaattgtcaaggtgacctccaacaaggccttcccctgctcagtcatctccattcaggatgtgctgtgtcctgtctatgacctggacaacaacgtagccttcatcggcatgtaccagacgatgaccaagaaggcggccatcaccgtacagcgcaaagacttccccagcaacagcttttatgtggtggtggtggtgaagaccgaagaccaagcctgcgggggctccctgcctttctaccccttcgcagaagatgaaccggtcgatcaagggcaccgccagaaaaccctgtcagtgctggtgtctcaagcagtcacgtctgaggcatacgtcagtgggatgctcttttgcctgggtatatttctctccttttacctgctgaccgtcctcctggcctgctgggagaactggaggcagaagaagaagaccctgctggtggccattgaccgagcctgcccagaaagcggtcaccctcgagtcctggctgattcttttcctggcagttccccttatgagggttacaactatggctcctttgagaatgtttctggatctaccgatggtctggttgacagcgctggcactggggacctctcttacggttaccagggccgctcctttgaacctgtaggtactcggccccgagtggactccatgagctctgtggaggaggatgactacgacacattgaccgacatcgattccgacaagaatgtcattcgcaccaagcaatacctctatgtggctgacctggcacggaaggacaagcgtgttctgcggaaaaagtaccagatctacttctggaacattgccaccattgctgtcttctatgcccttcctgtggtgcagctggtgatcacctaccagacggtggtgaatgtcacagggaatcaggacatctgctactacaacttcctctgcgcccacccactgggcaatctcagcgccttcaacaacatcctcagcaacctggggtacatcctgctggggctgcttttcctgctcatcatcctgcaacgggagatcaaccacaaccgggccctgctgcgcaatgacctctgtgccctggaatgtgggatccccaaacactttgggcttttctacgccatgggcacagccctgatgatggaggggctgctcagtgcttgctatcatgtgtgccccaactataccaatttccagtttgacacatcgttcatgtacatgatcgccggactctgcatgctgaagctctaccagaagcggcacccggacatcaacgccagcgcctacagtgcctacgcctgcctggccattgtcatcttcttctctgtgctgggcgtggtctttggcaaagggaacacggcgttctggatcgtcttctccatcattcacatcatcgccaccctgctcctcagcacgcagctctattacatgggccggtggaaactggactcggggatcttccgccgcatcctccacgtgctctacacagactgcatccggcagtgcagcgggccgctctacgtggaccgcatggtgctgctggtcatgggcaacgtcatcaactggtcgctggctgcctatgggcttatcatgcgccccaatgatttcgcttcctacttgttggccattggcatctgcaacctgctcctttacttcgccttctacatcatcatgaagctccggagtggggagaggatcaagctcatccccctgctctgcatcgtttgcacctccgtggtctggggcttcgcgctcttcttcttcttccagggactcagcacctggcagaaaacccctgcagagtcgagggagcacaaccgggactgcatcctcctcgacttctttgacgaccacgacatctggcacttcctctcctccatcgccatgttcgggtccttcctggtgttgctgacactggatgacgacctggatactgtgcagcgggacaagatctatgtcttctagcaggagctgggcccttcgcttcacctcaaggggccctgagctcctttgtgtcatagaccggtcactctgtcgtgctgtggggatgagtcccagcaccgctgcccagcactggatggcagcaggacagccaggtctagcttaggcttggcctgggacagccatggggtggcatggaaccttgcagctgccctctgccgaggagcaggcctgctcccctggaacccccagatgttggccaaattgctgctttcttctcagtgttggggccttccatgggcccctgtcctttggctctccatttgtccctttgcaagaggaaggatggaagggacaccctccccatttcatgccttgcattttgcccgtcctcctccccacaatgccccagcctgggacctaaggcctctttttcctcccatactcccactccagggcctagtctggggcctgaatctctgtcctgtatcagggccccagttctctttgggctgtccctggctgccatcactgcccattccagtcagccaggatggatgggggtatgagattttgggggttggccagctggtgccagacttttggtgctaaggcctgcaaggggcctggggcagtgcgtattctcttccctctgacctgtgctcagggctggctctttagcaatgcgctcagcccaatttgagaaccgccttctgattcaagaggctgaattcagaggtcacctcttcatcccatcagctcccagactgatgccagcaccaggactggagggagaagcgcctcaccccttcccttccttctttccaggcccttagtcttgccaaaccccagctggtggcctttcagtgccattgacactgcccaagaatgtccaggggcaaaggagggatgatacagagttcagcccgttctgcctccacagctgtgggcaccccagtgcctaccttagaaaggggcttcaggaagggatgtgctgtttccctctacgtgcccagtcctagcctcgctctaggacccagggctggcttctaagtttccgtccagtcttcaggcaagttctgtgttagtcatgcacacacatacctatgaaaccttggagtttacaaagaattgccccagctctgggcaccctggccaccctggtccttggatccccttcgtcccacctggtccaccccagatgctgaggatgggggagctcaggcggggcctctgctttggggatgggaatgtgtttttctcccaaacttgtttttatagctctgcttgaagggctgggagatgaggtgggtctggatcttttctcagagcgtctccatgctatggttgcatttccgttttctatgaatgaatttgcattcaataaacaaccagactc

SEQ ID NO: 181432 - DNA, 2609 bp, Homo sapiens
  Payload ID: 15733
  Gene Symbol: SIDT2
  Gene Name: SID1 transmembrane family, member 2
  ENST ID: ENST00000628876
  CDS Start-End: 42-2609
gccgccgccaccaccgctgccactgccgccctgccggggccatgttcgctctgggcttgcccttcttggtgctcttggtggcctcggtcgagagccatctgggggttctggggcccaagaacgtctcgcagaaagacgccgagtttgagcgcacctacgtggacgaggtcaacagcgagctggtcaacatctacaccttcaaccatactgtgacccgcaacaggacagagggcgtgcgtgtgtctgtgaacgtcctgaacaagcagaagggggcgccgttgctgtttgtggtccgccagaaggaggctgtggtgtccttccaggtgcccctaatcctgcgagggatgtttcagcgcaagtacctctaccaaaaagtggaacgaaccctgtgtcagccccccaccaagaatgagtcggagattcagttcttctacgtggatgtgtccaccctgtcaccagtcaacaccacataccagctccgggtcagccgcatggacgattttgtgctcaggactggggagcagttcagcttcaataccacagcagcacagccccagtacttcaagtatgagttccctgaaggcgtggactcggtaattgtcaaggtgacctccaacaaggccttcccctgctcagtcatctccattcaggatgtgctgtgtcctgtctatgacctggacaacaacgtagccttcatcggcatgtaccagacgatgaccaagaaggcggccatcaccgtacagcgcaaagacttccccagcaacagcttttatgtggtggtggtggtgaagaccgaagaccaagcctgcgggggctccctgcctttctaccccttcgcagaagatgaaccggtcgatcaagggcaccgccagaaaaccctgtcagtgctggtgtctcaagcagtcacgtctgaggcatacgtcagtgggatgctcttttgcctgggtatatttctctccttttacctgctgaccgtcctcctggcctgctgggagaactggaggcagaagaagaagaccctgctggtggccattgaccgagcctgcccagaaagcggtcaccctcgagtcctggctgattcttttcctggcagttccccttatgagggttacaactatggctcctttgagaatgtttctggatctaccgatggtctggttgacagcgctggcactggggacctctcttacggttaccaggggcacgaccagttcaagcggcgcctcccctctggccagatgcggcagctgtgcattgccatgggccgctcctttgaacctgtaggtactcggccccgagtggactccatgagctctgtggaggaggatgactacgacacattgaccgacatcgattccgacaagaatgtcattcgcaccaagcaatacctctatgtggctgacctggcacggaaggacaagcgtgttctgcggaaaaagtaccagatctacttctggaacattgccaccattgctgtcttctatgcccttcctgtggtgcagctggtgatcacctaccagacggtggtgaatgtcacagggaatcaggacatctgctactacaacttcctctgcgcccacccactgggcaatctcagcgccttcaacaacatcctcagcaacctggggtacatcctgctggggctgcttttcctgctcatcatcctgcaacgggagatcaaccacaaccgggccctgctgcgcaatgacctctgtgccctggaatgtgggatccccaaacactttgggcttttctacgccatgggcacagccctgatgatggaggggctgctcagtgcttgctatcatgtgtgccccaactataccaatttccagtttgacacatcgttcatgtacatgatcgccggactctgcatgctgaagctctaccagaagcggcacccggacatcaacgccagcgcctacagtgcctacgcctgcctggccattgtcatcttcttctctgtgctgggcgtggtctttggcaaagggaacacggcgttctggatcgtcttctccatcattcacatcatcgccaccctgctcctcagcacgcagctctattacatgggccggtggaaactggactcggggatcttccgccgcatcctccacgtgctctacacagactgcatccggcagtgcagcgggccgctctacgtggaccgcatggtgctgctggtcatgggcaacgtcatcaactggtcgctggctgcctatgggcttatcatgcgccccaatgatttcgcttcctacttgttggccattggcatctgcaacctgctcctttacttcgccttctacatcatcatgaagctccggagtggggagaggatcaagctcatccccctgctctgcatcgtttgcacctccgtggtctggggcttcgcgctcttcttcttcttccagggactcagcacctggcagaaaacccctgcagagtcgagggagcacaaccgggactgcatcctcctcgacttctttgacgaccacgacatctggcacttcctctcctccatcgccatgttcgggtccttcctggtaagcgggcctcccggccgagccgggtgggtacgtgaaggtagcagctgcctccttctctgtggctga

SEQ ID NO: 181433 - DNA, 7606 bp, Homo sapiens
  Payload ID: 15734
  Gene Symbol: SDK1
  Gene Name: sidekick cell adhesion molecule 1
  ENST ID: ENST00000389531
  CDS Start-End: 1-6582
atggcccggggcgcccggccctcggcggccggtggcggcggcggcggcgcggagccccctgagcgcgcgggccccgggcggccgcggggatccccgcccggccgcgcccgcccctcgctggcgccgcgccccggcccggagccctcgcgaccccgggcggcgcccgagacctccggcggggacacggcgggcgcggggcggtgcggcgggcggcgggcggcaaagttggggccgggccgccgcggctggtgggcgctgctggcgctgcagctgcacttgctccgggcgctggcgcaagatgatgttgctccatattttaaaacggagccaggcctaccacagatccacctggaagggaaccgccttgttctcacctgccttgccgaagggagctggcctttggagttcaagtggatgcgcgatgacagtgagctcaccacctacagcagcgaatataagtacattattccatctttgcagaagctcgatgctgggttttaccgctgcgtggtgcgaaacagaatgggagcactcctgcaaagaaaatcagaagttcaagtcgcatatatgggaagtttcatggatacggaccagaggaaaacagtttctcaaggacgtgcagcgattctaaacctgctgcccatcaccagctaccccagacctcaagtgacttggtttagagaagggcacaagattattccaagcaacagaatagccatcacattggagaatcagctggtgatcctcgccaccacaaccagtgatgccggggcatactacgtgcaggccgtgaatgagaaaaatggagaaaacaagacaagcccattcattcatttgagcatagcaagagatgttggcacacctgaaaccatggccccaaccattgtggttcccccgggcaacagaagtgtggtggctggatccagtgagaccaccttggaatgtatagccagtgccaggcctgtggaggacctgagtgtgacctggaagaggaatggagtgagaatcaccagtggcctccacagctttggaagacgcctcaccatcagcaacccgacgtccgcggacaccgggccatacgtctgcgaggcggcgctgccggggagcgcttttgaaccggccagggcgacggcctttcttttcatcatagagccaccatattttactgctgagcccgagagtcggatttcagctgaagtagaagaaactgtggacatcggatgtcaagccatgggggtcccccttcccaccctccagtggtacaaggatgccatctccatcagcaggctccagaatcctcgatacaaagtgctcgccagcggaggcctgcgcatccagaagctgcgtccagaggactccggaatcttccagtgcttcgccagcaatgaaggaggggagatccagacccacacctacctggatgtaaccaatatcgctccagtgttcacccagcggccagtggacaccacagttactgacgggatgacagccattctaaggtgtgaggtgtccggggctcccaaacccgccatcacctggaaaagagaaaaccacattctggccagtggctctgtccggattcctaggttcatgcttcttgaatcggggggtctacagatcgcgcccgtcttcatccaggatgccggcaactacacctgctatgcggccaacacagagggctccctgaatgcatcggccacgctcactgtgtggaatcggacgtccatcgtccaccctcctgaggaccacgtggtgattaaggggaccacggccacgctgcactgtggtgccacacatgacccccgggtttcactccgctacgtttggaagaaggacaacgtggccctgactccatcgagcacgtctaggatcgtggtggagaaggacgggtcccttctcatcagccagacgtggtcaggcgacatcggtgactacagctgcgagattgtttctgaaggagggaatgactccaggatggcccggctggaagtgattgaactgcctcattcacctcagaacctcctggtcagccctaattcttcccacagccacgccgtggtgctctcttgggtccggccctttgatggaaacagtcctattctttattacatcgtggagctctctgaaaacaactctccatggaaggtgcatctgtcaaacgttggccctgagatgacaggcgtcaccgtgagtggcctgactccggctcgtacctatcaattccgggtgtgcgcggtgaatgaagtgggcaggggccagtacagcgccgagacaagcaggttgatgctacctgaagaaccacccagtgctcccccgaaaaatatagtggccagtgggcggactaatcagtccattatggtccagtggcagccacccccagaaacagagcacaacggggtgttgcgtggatacatcctcaggtaccgcctggctggccttcccggagagtaccagcagcggaacatcaccagcccggaggtgaactactgcctggtgacagacctgatcatctggacacagtatgagatacaggtggcggcgtacaacggggccggtctgggcgtcttcagcagggcagtgaccgagtacaccttgcagggagtgcccaccgcgcccccgcagaacgtgcagacggaagccgtgaactccaccaccattcagttcctgtggaaccctccgcctcagcagtttatcaatggcatcaaccagggatacaagcttctggcatggccggcagatgcccccgaggctgtcactgtggtcactattgccccagatttccacggagtccaccatggacacataacgaacctgaagaagtttaccgcctacttcacttccgttctgtgcttcaccacccctggggacgggcctcccagcacacctcagctggtctggactcaggaagacaaaccaggagctgtgggacatctgagtttcacagagatcttggacacatctctcaaggtcagctggcaggagcccctggagaaaaatggcatcattactggctatcagatctcttgggaagtgtacggcaggaacgactctcgtctcacgcacaccctgaacagcacgacgcacgagtacaagatccaaggcctctcatctctcaccacctacaccatcgacgtggccgctgtgactgccgtgggcactggcctggtgacttcatccaccatttcttctggagtgcccccagaccttcctggtgccccatccaacctggtcatttccaacatcagccctcgctccgccacccttcagttccggccaggctatgacgggaaaacgtccatctccaggtggattgttgaggggcaggtgggagctatcggcgacgaggaggagtgggtcaccctctatgaagaggagaatgagcctgatgcccagatgctggagatcccaaacctcacaccctacactcactacagatttcgaatgaagcaagtgaacattgttgggccgagcccctacagtccgtcttcccgggtcatccagaccctgcaggccccacccgacgtggctccaaccagcgtcacggtccgtactgccagtgagaccagcctgcggcttcgctgggtgcccctgccggattctcagtacaacgggaaccccgagtccgtgggctacaggattaagtactggcgctcagacctccagtcctcagcagtggcccaagtcgtcagtgaccggctggagagagaattcaccatcgaggagctggaggagtggatggaatacgagctgcagatgcaggccttcaacgccgtcggggctgggccgtggagcgaggtggtgcggggccggacgcgggagtcagttccttcagccgcccctgagaacgtgtcagccgaggctgtcagctcgacccagattttactgacatggacatccgtgccggaacaggaccagaatgggctcatactgggctacaagatcctgttccgggccaaagacctggatcccgagcccaggagccacatcgtgcgagggaaccacacgcagtcggccctgctggcaggcctgcgcaagttcgtgctctacgagctccaggtgctggcgttcacccgcatcgggaacggggtccccagcacgcccctcatcctggagcgcaccaaagacgatgccccaggcccaccagtgaggctcgtgttccccgaagtgagactcacctccgtgcggatagtgtggcaacctccggaggagcccaacggcatcatcctggggtaccagattgcctaccgcctggccagcagcagcccccacaccttcaccaccgtggaggtcggcgccacagtgaggcagttcacagccaccgacctggccccggagtccgcatacatcttcaggctgtccgccaagacgaggcagggctggggggagccactggaggccaccgtcatcaccaccgagaagagagagcggccggcaccccccagagagctcctggtgccccaggcagaagtgaccgcacgcagcctccggctccagtgggtcccgggcagcgacggggcctcccccatccggtacttcaccatgcaggtgcgagagctgcctcggggtgagtggcagacctactcctcgtccatcagccatgaggcgacagcatgcgtcgttgacagactgaggcccttcacctcctacaagctgcgcctgaaagccaccaacgacattggggacagtgacttcagttcagagacagaggcggtgaccacgctgcaggatgttccaggagagcccccgggatctgtctcagcgacgccacacaccacgtcctctgtcctgatacagtggcagcctccgagggacgaaagcctgaatggccttcttcagggatacaggatctactacagggagctggagtatgaagccgggtcaggcactgaggccaagacgctcaaaaaccctatagctttacatgctgagctcacagatttaaagaagtaccggcgctatgaagtaataatgaccgcctataacatcatcggcgagagcccagccagcgcgcccgtggaggtctttgtcggcgaggctgccccggccatggccccgcagaacgtgcaggtgaccccactcacggccagccagctggaggtcacgtgggacccaccacccccggagagccagaatgggaacatccaaggctacaagatttactactgggaggcagacagccagaacgaaacggagaaaatgaaggtcctcttcctccccgagcccgtggtgaggctgaagaacctgaccagccataccaagtacctggtcagcatatcagccttcaacgccgccggagatggacctaagagtgacccccagcaggggcgcacccaccaggccgcccctggggcccccagctttctggcgttctcagaaataacctccaccacgctcaacgtgtcctggggcgagcctgcggcggccaacggcatcctgcagggctatcgggtggtgtacgagcccttggcccctgtacaaggggtgagcaaggtggtgaccgtggaagtgagagggaactggcagcgctggctgaaggtgcgggacctcaccaagggagtgacctatttcttccgtgtccaagcgcggaccatcacctacgggcccgagctccaagccaatatcacagccgggccagccgagggatccccgggctcgcctagagatgtcctggtcaccaagtccgcctctgaactgacgctgcagtggactgagggacactctggcgacacacctaccacgggctatgtgatcgaggcccggccctcagatgaaggcttatgggacatgtttgtgaaggacatcccgcggagcgccacatcctacaccctcagcctggataagctccggcaaggagtgacttacgagttccgggtggtggctgtgaatgaggcgggctacggggagcccagcaacccctccacggctgtgtcagctcaagtggaagccccattctacgaggagtggtggttcctcctggtgatggctctgtccagcctgatcgtcatcctgctggtggtgttcgccctcgtcctgcacgggcagaataagaagtataagaactgcagcacaggaaaggggatctccaccatggaggagtctgtgaccctggacaacggaggatttgctgccctggagctcagcagccgccacctcaatgtcaagagcaccttctccaagaagaacgggaccaggtccccaccccggcctagccccggcggcctgcactactcagacgaggacatctgcaacaagtacaacggcgccgtgctgaccgagagcgtgagcctcaaggagaagtcggcagatgcatcagaatctgaggccacggactctgactacgaggacgcgctgcccaagcactccttcgtgaaccactacatgagcgaccccacctactacaactcatggaagcgcagggcccagggccgcgcacctgcgccgcacaggtacgaggcggtggcgggctccgaggcgggcgcgcagctgcacccggtcatcaccacgcagagcgcgggcggcgtctacacccccgctggccccggcgcgcgaactccgctcaccggcttctcctccttcgtgtgagcaaagcgccgcgcctccctcagggcggaacggaggcaactttccggagtctatttttgttaagacaatcaactccaataactgagctgaagtttttgtttaaaaagaaaaaaatctgataagtgatgattttacctacttgtggacactagatttcaattaggaaggtttttttaaacggctttttgtaacttcgctgcaggaagcaggtttgtttctttttcttttctttttaagagaaggtgtatttcactggtgcaatggcttggcacctccggggcctgggaggacctcagacctccccagccctgggtttctccgtcttcaagaccaactaggaagggtcaagcggggagagggagtggagggtcaggtgagatctcagagctgccccggccggcccccgtctctttctacctcctcttccagagaaccagcggctcacacccttctcaacgcaggacatcctcggcggctcctggggtttgaagagcaaacgtttttccctgggctcagtgcgttttgtcccaacttcatctgtttctgaaatgttctcacttggcagtgtctagtcaaggagtcggctttcaggttcctgacggccaggcagggatgctaaggtgtggctcagccgtcactgtctgtgtcactgcagtggtgcggtcctcaggcttttctgcctgtctttcccccttccttctcacctgacagcgagggagagggaagcctcttagggctggaagccaccacgctggccctctccttccccgaacacagcacacggtcaactccgcgggacacgaggacacgggacggcgtctccagaattgcttgttacgtaggaagcgtgcattgttaaccagagtatttttaaaatctttttatctttttttaaactatgtcacatgaaatgaatgcgtctttgctgtctccaggtgcctttttattaattgttcagctttgtacatgggaaagatgaaaagcaacagtgtctgcaaataaagcaaaacagctctgagaacac

SEQ ID NO: 181434 - DNA, 10397 bp, Homo sapiens
  Payload ID: 15734
  Gene Symbol: SDK1
  Gene Name: sidekick cell adhesion molecule 1
  Uniprot ID: Q7Z5N4
  ENST ID: ENST00000404826
  CDS Start-End: 140-6781
cctcagcgctgggcggccgctcacctcgggccggggggcgccgcgcctcccgcggagtggccgcgcccgctcggagccgtcccgcctgtcctgcccgcccgtccgtccggcgcggcgctcggggtggcggctgctcggcatggcccggggcgcccggccctcggcggccggtggcggcggcggcggcgcggagccccctgagcgcgcgggccccgggcggccgcggggatccccgcccggccgcgcccgcccctcgctggcgccgcgccccggcccggagccctcgcgaccccgggcggcgcccgagacctccggcggggacacggcgggcgcggggcggtgcggcgggcggcgggcggcaaagttggggccgggccgccgcggctggtgggcgctgctggcgctgcagctgcacttgctccgggcgctggcgcaagatgatgttgctccatattttaaaacggagccaggcctaccacagatccacctggaagggaaccgccttgttctcacctgccttgccgaagggagctggcctttggagttcaagtggatgcgcgatgacagtgagctcaccacctacagcagcgaatataagtacattattccatctttgcagaagctcgatgctgggttttaccgctgcgtggtgcgaaacagaatgggagcactcctgcaaagaaaatcagaagttcaagtcgcatatatgggaagtttcatggatacggaccagaggaaaacagtttctcaaggacgtgcagcgattctaaacctgctgcccatcaccagctaccccagacctcaagtgacttggtttagagaagggcacaagattattccaagcaacagaatagccatcacattggagaatcagctggtgatcctcgccaccacaaccagtgatgccggggcatactacgtgcaggccgtgaatgagaaaaatggagaaaacaagacaagcccattcattcatttgagcatagcaagagatgttggcacacctgaaaccatggccccaaccattgtggttcccccgggcaacagaagtgtggtggctggatccagtgagaccaccttggaatgtatagccagtgccaggcctgtggaggacctgagtgtgacctggaagaggaatggagtgagaatcaccagtggcctccacagctttggaagacgcctcaccatcagcaacccgacgtccgcggacaccgggccatacgtctgcgaggcggcgctgccggggagcgcttttgaaccggccagggcgacggcctttcttttcatcatagagccaccatattttactgctgagcccgagagtcggatttcagctgaagtagaagaaactgtggacatcggatgtcaagccatgggggtcccccttcccaccctccagtggtacaaggatgccatctccatcagcaggctccagaatcctcgatacaaagtgctcgccagcggaggcctgcgcatccagaagctgcgtccagaggactccggaatcttccagtgcttcgccagcaatgaaggaggggagatccagacccacacctacctggatgtaaccaatatcgctccagtgttcacccagcggccagtggacaccacagttactgacgggatgacagccattctaaggtgtgaggtgtccggggctcccaaacccgccatcacctggaaaagagaaaaccacattctggccagtggctctgtccggattcctaggttcatgcttcttgaatcggggggtctacagatcgcgcccgtcttcatccaggatgccggcaactacacctgctatgcggccaacacagagggctccctgaatgcatcggccacgctcactgtgtggaatcggacgtccatcgtccaccctcctgaggaccacgtggtgattaaggggaccacggccacgctgcactgtggtgccacacatgacccccgggtttcactccgctacgtttggaagaaggacaacgtggccctgactccatcgagcacgtctaggatcgtggtggagaaggacgggtcccttctcatcagccagacgtggtcaggcgacatcggtgactacagctgcgagattgtttctgaaggagggaatgactccaggatggcccggctggaagtgattgaactgcctcattcacctcagaacctcctggtcagccctaattcttcccacagccacgccgtggtgctctcttgggtccggccctttgatggaaacagtcctattctttattacatcgtggagctctctgaaaacaactctccatggaaggtgcatctgtcaaacgttggccctgagatgacaggcgtcaccgtgagtggcctgactccggctcgtacctatcaattccgggtgtgcgcggtgaatgaagtgggcaggggccagtacagcgccgagacaagcaggttgatgctacctgaagaaccacccagtgctcccccgaaaaatatagtggccagtgggcggactaatcagtccattatggtccagtggcagccacccccagaaacagagcacaacggggtgttgcgtggatacatcctcaggtaccgcctggctggccttcccggagagtaccagcagcggaacatcaccagcccggaggtgaactactgcctggtgacagacctgatcatctggacacagtatgagatacaggtggcggcgtacaacggggccggtctgggcgtcttcagcagggcagtgaccgagtacaccttgcagggagtgcccaccgcgcccccgcagaacgtgcagacggaagccgtgaactccaccaccattcagttcctgtggaaccctccgcctcagcagtttatcaatggcatcaaccagggatacaagcttctggcatggccggcagatgcccccgaggctgtcactgtggtcactattgccccagatttccacggagtccaccatggacacataacgaacctgaagaagtttaccgcctacttcacttccgttctgtgcttcaccacccctggggacgggcctcccagcacacctcagctggtctggactcaggaagacaaaccaggagctgtgggacatctgagtttcacagagatcttggacacatctctcaaggtcagctggcaggagcccctggagaaaaatggcatcattactggctatcagatctcttgggaagtgtacggcaggaacgactctcgtctcacgcacaccctgaacagcacgacgcacgagtacaagatccaaggcctctcatctctcaccacctacaccatcgacgtggccgctgtgactgccgtgggcactggcctggtgacttcatccaccatttcttctggagtgcccccagaccttcctggtgccccatccaacctggtcatttccaacatcagccctcgctccgccacccttcagttccggccaggctatgacgggaaaacgtccatctccaggtggattgttgaggggcaggtgggagctatcggcgacgaggaggagtgggtcaccctctatgaagaggagaatgagcctgatgcccagatgctggagatcccaaacctcacaccctacactcactacagatttcgaatgaagcaagtgaacattgttgggccgagcccctacagtccgtcttcccgggtcatccagaccctgcaggccccacccgacgtggctccaaccagcgtcacggtccgtactgccagtgagaccagcctgcggcttcgctgggtgcccctgccggattctcagtacaacgggaaccccgagtccgtgggctacaggattaagtactggcgctcagacctccagtcctcagcagtggcccaagtcgtcagtgaccggctggagagagaattcaccatcgaggagctggaggagtggatggaatacgagctgcagatgcaggccttcaacgccgtcggggctgggccgtggagcgaggtggtgcggggccggacgcgggagtcagttccttcagccgcccctgagaacgtgtcagccgaggctgtcagctcgacccagattttactgacatggacatccgtgccggaacaggaccagaatgggctcatactgggctacaagatcctgttccgggccaaagacctggatcccgagcccaggagccacatcgtgcgagggaaccacacgcagtcggccctgctggcaggcctgcgcaagttcgtgctctacgagctccaggtgctggcgttcacccgcatcgggaacggggtccccagcacgcccctcatcctggagcgcaccaaagacgatgccccaggcccaccagtgaggctcgtgttccccgaagtgagactcacctccgtgcggatagtgtggcaacctccggaggagcccaacggcatcatcctggggtaccagattgcctaccgcctggccagcagcagcccccacaccttcaccaccgtggaggtcggcgccacagtgaggcagttcacagccaccgacctggccccggagtccgcatacatcttcaggctgtccgccaagacgaggcagggctggggggagccactggaggccaccgtcatcaccaccgagaagagagagcggccggcaccccccagagagctcctggtgccccaggcagaagtgaccgcacgcagcctccggctccagtgggtcccgggcagcgacggggcctcccccatccggtacttcaccatgcaggtgcgagagctgcctcggggtgagtggcagacctactcctcgtccatcagccatgaggcgacagcatgcgtcgttgacagactgaggcccttcacctcctacaagctgcgcctgaaagccaccaacgacattggggacagtgacttcagttcagagacagaggcggtgaccacgctgcaggatgttccaggagagcccccgggatctgtctcagcgacgccacacaccacgtcctctgtcctgatacagtggcagcctccgagggacgaaagcctgaatggccttcttcagggatacaggatctactacagggagctggagtatgaagccgggtcaggcactgaggccaagacgctcaaaaaccctatagctttacatgctgagctcacagcccaaagcagcttcaagacggtgaacagcagctccacatcgacgatgtgtgaactaacacatttaaagaagtaccggcgctatgaagtaataatgaccgcctataacatcatcggcgagagcccagccagcgcgcccgtggaggtctttgtcggcgaggctgccccggccatggccccgcagaacgtgcaggtgaccccactcacggccagccagctggaggtcacgtgggacccaccacccccggagagccagaatgggaacatccaaggctacaagatttactactgggaggcagacagccagaacgaaacggagaaaatgaaggtcctcttcctccccgagcccgtggtgaggctgaagaacctgaccagccataccaagtacctggtcagcatatcagccttcaacgccgccggagatggacctaagagtgacccccagcaggggcgcacccaccaggccgcccctggggcccccagctttctggcgttctcagaaataacctccaccacgctcaacgtgtcctggggcgagcctgcggcggccaacggcatcctgcagggctatcgggtggtgtacgagcccttggcccctgtacaaggggtgagcaaggtggtgaccgtggaagtgagagggaactggcagcgctggctgaaggtgcgggacctcaccaagggagtgacctatttcttccgtgtccaagcgcggaccatcacctacgggcccgagctccaagccaatatcacagccgggccagccgagggatccccgggctcgcctagagatgtcctggtcaccaagtccgcctctgaactgacgctgcagtggactgagggacactctggcgacacacctaccacgggctatgtgatcgaggcccggccctcagatgaaggcttatgggacatgtttgtgaaggacatcccgcggagcgccacatcctacaccctcagcctggataagctccggcaaggagtgacttacgagttccgggtggtggctgtgaatgaggcgggctacggggagcccagcaacccctccacggctgtgtcagctcaagtggaagccccattctacgaggagtggtggttcctcctggtgatggctctgtccagcctgatcgtcatcctgctggtggtgttcgccctcgtcctgcacgggcagaataagaagtataagaactgcagcacaggaaaggggatctccaccatggaggagtctgtgaccctggacaacggaggatttgctgccctggagctcagcagccgccacctcaatgtcaagagcaccttctccaagaagaacgggaccaggtccccaccccggcctagccccggcggcctgcactactcagacgaggacatctgcaacaagtacaacggcgccgtgctgaccgagagcgtgagcctcaaggagaagtcggcagatgcatcagaatctgaggccacggactctgactacgaggacgcgctgcccaagcactccttcgtgaaccactacatgagcgaccccacctactacaactcatggaagcgcagggcccagggccgcgcacctgcgccgcacaggtacgaggcggtggcgggctccgaggcgggcgcgcagctgcacccggtcatcaccacgcagagcgcgggcggcgtctacacccccgctggccccggcgcgcgaactccgctcaccggcttctcctccttcgtgtgagcaaagcgccgcgcctccctcagggcggaacggaggcaactttccggagtctatttttgttaagacaatcaactccaataactgagctgaagtttttgtttaaaaagaaaaaaatctgataagtgatgattttacctacttgtggacactagatttcaattaggaaggtttttttaaacggctttttgtaacttcgctgcaggaagcaggtttgtttctttttcttttctttttaagagaaggtgtatttcactggtgcaatggcttggcacctccggggcctgggaggacctcagacctccccagccctgggtttctccgtcttcaagaccaactaggaagggtcaagcggggagagggagtggagggtcaggtgagatctcagagctgccccggccggcccccgtctctttctacctcctcttccagagaaccagcggctcacacccttctcaacgcaggacatcctcggcggctcctggggtttgaagagcaaacgtttttccctgggctcagtgcgttttgtcccaacttcatctgtttctgaaatgttctcacttggcagtgtctagtcaaggagtcggctttcaggttcctgacggccaggcagggatgctaaggtgtggctcagccgtcactgtctgtgtcactgcagtggtgcggtcctcaggcttttctgcctgtctttcccccttccttctcacctgacagcgagggagagggaagcctcttagggctggaagccaccacgctggccctctccttccccgaacacagcacacggtcaactccgcgggacacgaggacacgggacggcgtctccagaattgcttgttacgtaggaagcgtgcattgttaaccagagtatttttaaaatctttttatctttttttaaactatgtcacatgaaatgaatgcgtctttgctgtctccaggtgcctttttattaattgttcagctttgtacatgggaaagatgaaaagcaacagtgtctgcaaataaagcaaaacagctctgagaacacacgctcccgactcgcctcgtgcacaccaggccgtcccctccctctgtcctggcttctgctggctgctcgcagcagccaccgcttctccaccactggcgctgctgctgccccctctcccagtccgaggccagcttttagccttaacaggttttttggaaatgtttcttttttttatttaaaattgtcattgtttggtttaaatttttcagctagatgaaaagagtatgaactactttggaaaacttaacagctcagagatggccatgcctccagcccctcacgtcatctttgcaacagacgactgggctgccatggtccacccctcagcccgggtcccgggtctggatggaacgggagcactgctggtgcccactggcgtgtgtgccccgggtccctgtaagtgccccctcaccagcagcagcgtgacacacacaagactcaagaccaccctgtcagtgccccccagtgcacggcaaacgggcaggtgccgttcccccagtgacctgagggtaggggacaactgagcagtatctgaccagtgccacccaggagccagtctcctggccacatgcagaaagtgtggcccctgcttacctagatgttttgtgcacctccatgggcagagggtgtggatattgcctggattctgtgctgtcagcgttgctgagtatggccccaggagaccaaggagagttttgtataggctggaaaaccccttttcagtctttccaaaattagagggtatggcaagtttccttttttctctcctcccttccttcccctccttcctttcctttacccctcctttccttccttcctcccttcctctcttctttcctccctccctccctccttccctcccttccttcctctctttcctccttccttccctcccttctttccctccctcccttcctctctcccctattccttcttccttttctcctcctttttctgagtggagggggaaatattctaaaccaaaaatcctagatgctctgcccaaagccacttctgcatgagaatcgcaacccacagttccccggatgagactcaccacagtggacagtgccacctccttcccctcggccccggagagggcgaagtgggcgggaagccaggatgtgagcactggaatttcttggaagagaagcgataaatggagaccatggccagcgctgctttctgtgcactctgatgactgctctctgcagccatgaggatgtggctttacatgccagggagagtgttgagacgtcttaggttgaggatgagcagattcgagatatgtttgttgctctcgggttttcgatacaacatcatgacacttctgtttcaagctcatgttttccgtctcccctccactcttagtaaaccttgatctgtacggagcggcctgtccgaggctacgccggcctcctggctgctgctggactgtgcttaggacagcgcccatgcctcggagggactctgtcccatgagaaccacctgtgcaaaggaacagagctggatgtttccaggtagattttggcctcccagagcaatgcggcatttgagaagcaacagttcctaactccttatcttcagggaaggaaaagaaaatcacagcctaggaagatggaggttggattttaatctcggttttaaaaagaggacaaacaaaatgtctctaagccaggctagatggaatgtgctcccgctctctcctgccgtgctgaaagtcatgccttgcggatgcctcatgacagcagtggctgagtctccccacccacccccaacgtggctcatttcagattgcttcggccccaccctgcaaggatgtggtcacggagtggccaggaggctccgtctgagccacagggatgggtgtgcagagctccctcctcctggggtgccagggcagagattccaggcaggtgagcccagagagagctgccaggccacaccccctcggcctcctgcacggccaccttctgggtgaatcggtccagcccaagcccctctccccagcctcgccttcagcctctctcccagcctgcttttataaggcgcacttcactcaatgctgtagccaaaaaacgaggggccccagggagaggggacccagatggccacacacggaacgcgcctccacagccccgggaggtggctcactctgtacaggtcttcggaggccgtgtttgtatctaactgtgactgggctgaagcatgatgtttgcctaatggttcgtagcatggtttttatttcttacgcattcttggcacacagtgtagctatcctcctgacgagcaacccgtctgcgtacctaagtgtggctccccgtgggtcagcgtcctggtagcatggatccagtctgaaaggtgaggacaacgtggaaactcatgagctgagcctgcccgctgggacacgtctccttcccgcgtcaccttctggtttagggagccgtcaggtccctaaacgttccctacaactttttctgaaattgtgcagaaaaacagatctcattaaaagaaaaaaagaaacaacttgtaggaagacagagaggtgctatgggtacaatttttaataaaaacattattttgttccttaaa

SEQ ID NO: 181435 - DNA, 554 bp, Homo sapiens
  Payload ID: 15734
  Gene Symbol: SDK1
  Gene Name: sidekick cell adhesion molecule 1
  ENST ID: ENST00000426596
  CDS Start-End: 1-323
caggagatgttggcacacctgaaaccatggccccaaccattgtggttcccccgggcaacagaagtgtggtggctggatccagtgagaccaccttggaatgtatagccagtgccaggcctgtggaggacctgagtgtgacctggaagaggaatggagtgagaatcaccagtggcctccacagctttggaagacgcctcaccatcagcaacccgacgtccgcggacaccgggccatacgtctgcgaggcggcgctgccggggagcgcttttgaaccggccagggcgacggcctttcttttcatcataggtcccaccttgttttaaagatacagtcaatataggaggcatgccaagctatcttatccacattcaacacaattataatgaaagtaaaccagctctggaagacagttcccagaaattaattatcgcacagaaagtgaacacaacagccttttgttatcatgataatgaaatcaccaccaccttaatacttgacaaacttggccatgcctctgttgaatttctgctgaataaactggaaaaatgttgcaa

SEQ ID NO: 181436 - DNA, 10258 bp, Homo sapiens
  Payload ID: 15734
  Gene Symbol: SDK1
  Gene Name: sidekick cell adhesion molecule 1
  ENST ID: ENST00000615806
  CDS Start-End: 1-6642
atggcccggggcgcccggccctcggcggccggtggcggcggcggcggcgcggagccccctgagcgcgcgggccccgggcggccgcggggatccccgcccggccgcgcccgcccctcgctggcgccgcgccccggcccggagccctcgcgaccccgggcggcgcccgagacctccggcggggacacggcgggcgcggggcggtgcggcgggcggcgggcggcaaagttggggccgggccgccgcggctggtgggcgctgctggcgctgcagctgcacttgctccgggcgctggcgcaaggtaggtgcgccccatattttaaaacggagccaggcctaccacagatccacctggaagggaaccgccttgttctcacctgccttgccgaagggagctggcctttggagttcaagtggatgcgcgatgacagtgagctcaccacctacagcagcgaatataagtacattattccatctttgcagaagctcgatgctgggttttaccgctgcgtggtgcgaaacagaatgggagcactcctgcaaagaaaatcagaagttcaagtcgcatatatgggaagtttcatggatacggaccagaggaaaacagtttctcaaggacgtgcagcgattctaaacctgctgcccatcaccagctaccccagacctcaagtgacttggtttagagaagggcacaagattattccaagcaacagaatagccatcacattggagaatcagctggtgatcctcgccaccacaaccagtgatgccggggcatactacgtgcaggccgtgaatgagaaaaatggagaaaacaagacaagcccattcattcatttgagcatagcaagagatgttggcacacctgaaaccatggccccaaccattgtggttcccccgggcaacagaagtgtggtggctggatccagtgagaccaccttggaatgtatagccagtgccaggcctgtggaggacctgagtgtgacctggaagaggaatggagtgagaatcaccagtggcctccacagctttggaagacgcctcaccatcagcaacccgacgtccgcggacaccgggccatacgtctgcgaggcggcgctgccggggagcgcttttgaaccggccagggcgacggcctttcttttcatcatagagccaccatattttactgctgagcccgagagtcggatttcagctgaagtagaagaaactgtggacatcggatgtcaagccatgggggtcccccttcccaccctccagtggtacaaggatgccatctccatcagcaggctccagaatcctcgatacaaagtgctcgccagcggaggcctgcgcatccagaagctgcgtccagaggactccggaatcttccagtgcttcgccagcaatgaaggaggggagatccagacccacacctacctggatgtaaccaatatcgctccagtgttcacccagcggccagtggacaccacagttactgacgggatgacagccattctaaggtgtgaggtgtccggggctcccaaacccgccatcacctggaaaagagaaaaccacattctggccagtggctctgtccggattcctaggttcatgcttcttgaatcggggggtctacagatcgcgcccgtcttcatccaggatgccggcaactacacctgctatgcggccaacacagagggctccctgaatgcatcggccacgctcactgtgtggaatcggacgtccatcgtccaccctcctgaggaccacgtggtgattaaggggaccacggccacgctgcactgtggtgccacacatgacccccgggtttcactccgctacgtttggaagaaggacaacgtggccctgactccatcgagcacgtctaggatcgtggtggagaaggacgggtcccttctcatcagccagacgtggtcaggcgacatcggtgactacagctgcgagattgtttctgaaggagggaatgactccaggatggcccggctggaagtgattgaactgcctcattcacctcagaacctcctggtcagccctaattcttcccacagccacgccgtggtgctctcttgggtccggccctttgatggaaacagtcctattctttattacatcgtggagctctctgaaaacaactctccatggaaggtgcatctgtcaaacgttggccctgagatgacaggcgtcaccgtgagtggcctgactccggctcgtacctatcaattccgggtgtgcgcggtgaatgaagtgggcaggggccagtacagcgccgagacaagcaggttgatgctacctgaagaaccacccagtgctcccccgaaaaatatagtggccagtgggcggactaatcagtccattatggtccagtggcagccacccccagaaacagagcacaacggggtgttgcgtggatacatcctcaggtaccgcctggctggccttcccggagagtaccagcagcggaacatcaccagcccggaggtgaactactgcctggtgacagacctgatcatctggacacagtatgagatacaggtggcggcgtacaacggggccggtctgggcgtcttcagcagggcagtgaccgagtacaccttgcagggagtgcccaccgcgcccccgcagaacgtgcagacggaagccgtgaactccaccaccattcagttcctgtggaaccctccgcctcagcagtttatcaatggcatcaaccagggatacaagcttctggcatggccggcagatgcccccgaggctgtcactgtggtcactattgccccagatttccacggagtccaccatggacacataacgaacctgaagaagtttaccgcctacttcacttccgttctgtgcttcaccacccctggggacgggcctcccagcacacctcagctggtctggactcaggaagacaaaccaggagctgtgggacatctgagtttcacagagatcttggacacatctctcaaggtcagctggcaggagcccctggagaaaaatggcatcattactggctatcagatctcttgggaagtgtacggcaggaacgactctcgtctcacgcacaccctgaacagcacgacgcacgagtacaagatccaaggcctctcatctctcaccacctacaccatcgacgtggccgctgtgactgccgtgggcactggcctggtgacttcatccaccatttcttctggagtgcccccagaccttcctggtgccccatccaacctggtcatttccaacatcagccctcgctccgccacccttcagttccggccaggctatgacgggaaaacgtccatctccaggtggattgttgaggggcaggtgggagctatcggcgacgaggaggagtgggtcaccctctatgaagaggagaatgagcctgatgcccagatgctggagatcccaaacctcacaccctacactcactacagatttcgaatgaagcaagtgaacattgttgggccgagcccctacagtccgtcttcccgggtcatccagaccctgcaggccccacccgacgtggctccaaccagcgtcacggtccgtactgccagtgagaccagcctgcggcttcgctgggtgcccctgccggattctcagtacaacgggaaccccgagtccgtgggctacaggattaagtactggcgctcagacctccagtcctcagcagtggcccaagtcgtcagtgaccggctggagagagaattcaccatcgaggagctggaggagtggatggaatacgagctgcagatgcaggccttcaacgccgtcggggctgggccgtggagcgaggtggtgcggggccggacgcgggagtcagttccttcagccgcccctgagaacgtgtcagccgaggctgtcagctcgacccagattttactgacatggacatccgtgccggaacaggaccagaatgggctcatactgggctacaagatcctgttccgggccaaagacctggatcccgagcccaggagccacatcgtgcgagggaaccacacgcagtcggccctgctggcaggcctgcgcaagttcgtgctctacgagctccaggtgctggcgttcacccgcatcgggaacggggtccccagcacgcccctcatcctggagcgcaccaaagacgatgccccaggcccaccagtgaggctcgtgttccccgaagtgagactcacctccgtgcggatagtgtggcaacctccggaggagcccaacggcatcatcctggggtaccagattgcctaccgcctggccagcagcagcccccacaccttcaccaccgtggaggtcggcgccacagtgaggcagttcacagccaccgacctggccccggagtccgcatacatcttcaggctgtccgccaagacgaggcagggctggggggagccactggaggccaccgtcatcaccaccgagaagagagagcggccggcaccccccagagagctcctggtgccccaggcagaagtgaccgcacgcagcctccggctccagtgggtcccgggcagcgacggggcctcccccatccggtacttcaccatgcaggtgcgagagctgcctcggggtgagtggcagacctactcctcgtccatcagccatgaggcgacagcatgcgtcgttgacagactgaggcccttcacctcctacaagctgcgcctgaaagccaccaacgacattggggacagtgacttcagttcagagacagaggcggtgaccacgctgcaggatgttccaggagagcccccgggatctgtctcagcgacgccacacaccacgtcctctgtcctgatacagtggcagcctccgagggacgaaagcctgaatggccttcttcagggatacaggatctactacagggagctggagtatgaagccgggtcaggcactgaggccaagacgctcaaaaaccctatagctttacatgctgagctcacagcccaaagcagcttcaagacggtgaacagcagctccacatcgacgatgtgtgaactaacacatttaaagaagtaccggcgctatgaagtaataatgaccgcctataacatcatcggcgagagcccagccagcgcgcccgtggaggtctttgtcggcgaggctgccccggccatggccccgcagaacgtgcaggtgaccccactcacggccagccagctggaggtcacgtgggacccaccacccccggagagccagaatgggaacatccaaggctacaagatttactactgggaggcagacagccagaacgaaacggagaaaatgaaggtcctcttcctccccgagcccgtggtgaggctgaagaacctgaccagccataccaagtacctggtcagcatatcagccttcaacgccgccggagatggacctaagagtgacccccagcaggggcgcacccaccaggccgcccctggggcccccagctttctggcgttctcagaaataacctccaccacgctcaacgtgtcctggggcgagcctgcggcggccaacggcatcctgcagggctatcgggtggtgtacgagcccttggcccctgtacaaggggtgagcaaggtggtgaccgtggaagtgagagggaactggcagcgctggctgaaggtgcgggacctcaccaagggagtgacctatttcttccgtgtccaagcgcggaccatcacctacgggcccgagctccaagccaatatcacagccgggccagccgagggatccccgggctcgcctagagatgtcctggtcaccaagtccgcctctgaactgacgctgcagtggactgagggacactctggcgacacacctaccacgggctatgtgatcgaggcccggccctcagatgaaggcttatgggacatgtttgtgaaggacatcccgcggagcgccacatcctacaccctcagcctggataagctccggcaaggagtgacttacgagttccgggtggtggctgtgaatgaggcgggctacggggagcccagcaacccctccacggctgtgtcagctcaagtggaagccccattctacgaggagtggtggttcctcctggtgatggctctgtccagcctgatcgtcatcctgctggtggtgttcgccctcgtcctgcacgggcagaataagaagtataagaactgcagcacaggaaaggggatctccaccatggaggagtctgtgaccctggacaacggaggatttgctgccctggagctcagcagccgccacctcaatgtcaagagcaccttctccaagaagaacgggaccaggtccccaccccggcctagccccggcggcctgcactactcagacgaggacatctgcaacaagtacaacggcgccgtgctgaccgagagcgtgagcctcaaggagaagtcggcagatgcatcagaatctgaggccacggactctgactacgaggacgcgctgcccaagcactccttcgtgaaccactacatgagcgaccccacctactacaactcatggaagcgcagggcccagggccgcgcacctgcgccgcacaggtacgaggcggtggcgggctccgaggcgggcgcgcagctgcacccggtcatcaccacgcagagcgcgggcggcgtctacacccccgctggccccggcgcgcgaactccgctcaccggcttctcctccttcgtgtgagcaaagcgccgcgcctccctcagggcggaacggaggcaactttccggagtctatttttgttaagacaatcaactccaataactgagctgaagtttttgtttaaaaagaaaaaaatctgataagtgatgattttacctacttgtggacactagatttcaattaggaaggtttttttaaacggctttttgtaacttcgctgcaggaagcaggtttgtttctttttcttttctttttaagagaaggtgtatttcactggtgcaatggcttggcacctccggggcctgggaggacctcagacctccccagccctgggtttctccgtcttcaagaccaactaggaagggtcaagcggggagagggagtggagggtcaggtgagatctcagagctgccccggccggcccccgtctctttctacctcctcttccagagaaccagcggctcacacccttctcaacgcaggacatcctcggcggctcctggggtttgaagagcaaacgtttttccctgggctcagtgcgttttgtcccaacttcatctgtttctgaaatgttctcacttggcagtgtctagtcaaggagtcggctttcaggttcctgacggccaggcagggatgctaaggtgtggctcagccgtcactgtctgtgtcactgcagtggtgcggtcctcaggcttttctgcctgtctttcccccttccttctcacctgacagcgagggagagggaagcctcttagggctggaagccaccacgctggccctctccttccccgaacacagcacacggtcaactccgcgggacacgaggacacgggacggcgtctccagaattgcttgttacgtaggaagcgtgcattgttaaccagagtatttttaaaatctttttatctttttttaaactatgtcacatgaaatgaatgcgtctttgctgtctccaggtgcctttttattaattgttcagctttgtacatgggaaagatgaaaagcaacagtgtctgcaaataaagcaaaacagctctgagaacacacgctcccgactcgcctcgtgcacaccaggccgtcccctccctctgtcctggcttctgctggctgctcgcagcagccaccgcttctccaccactggcgctgctgctgccccctctcccagtccgaggccagcttttagccttaacaggttttttggaaatgtttcttttttttatttaaaattgtcattgtttggtttaaatttttcagctagatgaaaagagtatgaactactttggaaaacttaacagctcagagatggccatgcctccagcccctcacgtcatctttgcaacagacgactgggctgccatggtccacccctcagcccgggtcccgggtctggatggaacgggagcactgctggtgcccactggcgtgtgtgccccgggtccctgtaagtgccccctcaccagcagcagcgtgacacacacaagactcaagaccaccctgtcagtgccccccagtgcacggcaaacgggcaggtgccgttcccccagtgacctgagggtaggggacaactgagcagtatctgaccagtgccacccaggagccagtctcctggccacatgcagaaagtgtggcccctgcttacctagatgttttgtgcacctccatgggcagagggtgtggatattgcctggattctgtgctgtcagcgttgctgagtatggccccaggagaccaaggagagttttgtataggctggaaaaccccttttcagtctttccaaaattagagggtatggcaagtttccttttttctctcctcccttccttcccctccttcctttcctttacccctcctttccttccttcctcccttcctctcttctttcctccctccctccctccttccctcccttccttcctctctttcctccttccttccctcccttctttccctccctcccttcctctctcccctattccttcttccttttctcctcctttttctgagtggagggggaaatattctaaaccaaaaatcctagatgctctgcccaaagccacttctgcatgagaatcgcaacccacagttccccggatgagactcaccacagtggacagtgccacctccttcccctcggccccggagagggcgaagtgggcgggaagccaggatgtgagcactggaatttcttggaagagaagcgataaatggagaccatggccagcgctgctttctgtgcactctgatgactgctctctgcagccatgaggatgtggctttacatgccagggagagtgttgagacgtcttaggttgaggatgagcagattcgagatatgtttgttgctctcgggttttcgatacaacatcatgacacttctgtttcaagctcatgttttccgtctcccctccactcttagtaaaccttgatctgtacggagcggcctgtccgaggctacgccggcctcctggctgctgctggactgtgcttaggacagcgcccatgcctcggagggactctgtcccatgagaaccacctgtgcaaaggaacagagctggatgtttccaggtagattttggcctcccagagcaatgcggcatttgagaagcaacagttcctaactccttatcttcagggaaggaaaagaaaatcacagcctaggaagatggaggttggattttaatctcggttttaaaaagaggacaaacaaaatgtctctaagccaggctagatggaatgtgctcccgctctctcctgccgtgctgaaagtcatgccttgcggatgcctcatgacagcagtggctgagtctccccacccacccccaacgtggctcatttcagattgcttcggccccaccctgcaaggatgtggtcacggagtggccaggaggctccgtctgagccacagggatgggtgtgcagagctccctcctcctggggtgccagggcagagattccaggcaggtgagcccagagagagctgccaggccacaccccctcggcctcctgcacggccaccttctgggtgaatcggtccagcccaagcccctctccccagcctcgccttcagcctctctcccagcctgcttttataaggcgcacttcactcaatgctgtagccaaaaaacgaggggccccagggagaggggacccagatggccacacacggaacgcgcctccacagccccgggaggtggctcactctgtacaggtcttcggaggccgtgtttgtatctaactgtgactgggctgaagcatgatgtttgcctaatggttcgtagcatggtttttatttcttacgcattcttggcacacagtgtagctatcctcctgacgagcaacccgtctgcgtacctaagtgtggctccccgtgggtcagcgtcctggtagcatggatccagtctgaaaggtgaggacaacgtggaaactcatgagctgagcctgcccgctgggacacgtctccttcccgcgtcaccttctggtttagggagccgtcaggtccctaaacgttccctacaactttttctgaaattgtgcagaaaaacagatctcattaaaagaaaaaaagaaacaacttgtaggaagacagagaggtgctatgggtacaatttttaataaaaacattattttgttccttaaa

SEQ ID NO: 181437 - DNA, 10723 bp, Homo sapiens
  Payload ID: 15735
  Gene Symbol: SDK2
  Gene Name: sidekick cell adhesion molecule 2
  Uniprot ID: Q58EX2
  ENST ID: ENST00000392650
  CDS Start-End: 2-6520
catgtgggggcttttgatctggacactgctagctctgcatcagatccgcgcggccagagcccaagatgatgtgtccccgtatttcaagacagagcctgtgcggacacaggtgcacttggaaggaaaccgcctggtgcttacatgcatggccgagggcagctggccactggagttcaagtggctccacaacaacagggagctgaccaagttctccctggaatacagatacatgatcaccagcctggaccgcacccacgctggcttttaccgttgcatcgtgcggaaccgaatgggggccctgctgcagcggcaaaccgaggtccaggtggcctacatggggagctttgaggaaggtgagaagcaccagagcgtctcccacggagaagcagctgtcatccgtgccccgcgcatcgccagcttcccccagccacaggtgacctggttccgggacggccgcaagatcccgcccagcagccgcatagccatcacgctggagaacacccttgtcatcctgtcaacggtggcccctgacgcaggtcgctactatgtgcaggctgttaacgacaaaaacggggataacaagaccagccagcccatcacgctcaccgtggagaatgtaggggggcctgcagaccccatcgcacccaccatcatcatcccacctaaaaacaccagcgtggtggccggcacctcagaggttaccttggagtgtgtggccaatgccaggcccctgatcaagctacatatcatttggaagaaggacggggtattgctgtcgggcggcatcagtgaccacaaccgccggctcaccatccccaaccccaccggcagtgacgccggctactacgagtgtgaggctgtcctgcgcagcagcagcgtcccctctgttgtccggggcgcctacctctcagtgctggaaccgcctcagtttgtcaaggagccagaaagacacatcactgcggagatggagaaggtggtggacatcccctgtcaggccaaaggtgtgccgccgccctccatcacctggtacaaggacgcagccgtggtggaggtggagaagttgacccgcttccggcagcgcaacgacgggggcctgcagatcagcggcctggtgcccgatgataccggcatgttccagtgcttcgcccgcaatgcagccggcgaggtgcaaacttccacctacctggctgtcaccagcatcgcccctaacatcaccagaggccccctggacagcacggtgatcgatggcatgtcagtggtgctagcatgtgagacctcgggggcgccccgaccagctatcacttggcagaaaggggagcgcatcttggccagtggctctgtgcagctgcctcgcttcacacccctggagtcgggcagcctcctcatcagccccacacacatctccgatgcggggacctacacctgcctggccaccaactctcggggggtcgatgaggcctcagcagacctagtcgtttgggctcggacccgcatcaccaagcccccccaggatcagagtgtcatcaagggcacccaggcctccatggtgtgcggagtgacccacgacccccgagtaaccatcaggtacatctgggagaaggacggggccaccctgggcacggagagccatcctcgtatccgcctggacagaaacggctccctgcacatctcacagacgtggtcgggagacatcggcacgtacacctgccgggtgatctcagcaggaggcaacgactctcgcagtgcccacctgcgagtcaggcaactgccccacgcgcccgagcacccagtggccactctcagcaccgtggaaaggcgagccatcaacctgacgtggaccaagccctttgatggcaacagccccctgatccgctacattctggagatgtcggagaacaatgccccctggactgtactcctggccagtgtggaccccaaagctacctcagtgacagtcaagggcctggttcctgcacgctcctaccagttccgtctttgtgccgtcaacgacgtggggaaaggacagttcagcaaagacaccgagagggtctccctccccgaggagccccccacggcccctccacagaacgtcatcgccagcggtcgaaccaaccagtccatcatgatccagtggcagccgcctcctgagagccaccagaatggaattctcaagggttacatcatcaggtactgcctggccgggctgcccgtggggtaccagtttaagaacatcacggatgctgatgtgaacaacctgctgctggaggatctcatcatttggaccaactacgagatcgaggtggctgcttacaacagcgctgggctgggggtctacagcagtaaagtcaccgagtggacgctgcagggagttcccacggtccctccgggcaatgtgcacgcggaagccaccaattccacgaccatccgcttcacctggaacgcccccagcccccagttcatcaacggcatcaaccagggctacaagctgatcgcctgggagccggaacaggaagaggaggttaccatggtgaccgcccggcctaactttcaagacagcatccacgtgggcttcgtgtctggcctgaagaagttcaccgagtacttcacctcagtgctgtgtttcaccacccccggggacgggccacgcagcaccccgcagctggtgcgcacccatgaggatgtgcctgggcccgtgggacacctgagcttcagtgagatcctggacacatcgctgaaggtcagctggcaagagccgggagagaaaaatggcatcctcacagggtaccggatctcctgggaggagtacaatcgaaccaacacccgtgtgacccactacctgcccaacgtgaccctggagtaccgtgtcacgggcctcaccgcgctcaccacctacaccatcgaggtggccgccatgacctcaaagggccagggccaagtgtccgcctccaccatctcctctggggtgcccccagaactcccagggccccccaccaacctgggcatttccaacatcggcccccgctctgtgaccttgcagttcaggccaggctacgatgggaaaacctccatctcccgctggctggtggaagcccaggtaggcgtggttggggagggagaggagtggttgctgatccaccagctctccaatgagcccgatgcccgctccatggaggtgcccgacctcaaccccttcacctgctacagcttccgcatgcgccaggtgaacatcgtgggcaccagcccccccagtcagccttctagaaagatccagaccctgcaggcaccccctgacatggccccagccaatgtgtctctgcgcacagccagtgagaccagcctgtggctgcgctggatgcctctcccggagatggaatacaatgggaaccctgagtccgtgggctataagatcaagtacagccggtcagacgggcatggcaagacgctgagccacgtggtgcaggaccgtgtggagcgggactacaccatcgaggacctggaggagtggacagagtaccgcgtccaggtccaggccttcaacgccatcgggagcgggccctggagccagacggtggtgggcaggacccgggagtcagttccctcttccggccccaccaatgtgtctgcactggccaccacctccagcagcatgctggtgcgctggagcgaggtccccgaggctgatcgcaacgggctcgtgctgggctataaggtgatgtataaggagaaggactcggacacccagccccgattctggctggtggaaggcaactcgtctcgcagtgcccagctcaccggcttgggcaaatacgtgctctatgaagtccaggtgctggccttcacacgcatcggggacggcagccccagccaccctcccatcctggagcggacgctggatgatgtcccaggaccacccatgggcatcctgttcccagaggtgcggaccacgtctgtgcggctgatctggcagccccctgccgcccccaatggcatcattcttgcttaccagatcacacaccggctcaacaccaccacggccaacaccgccactgtggaggtgctggcacccagcgcccggcagtacacagccacgggcctcaagccagagtctgtctacctgttccgcatcacggcccagacccgcaagggctggggagaagctgccgaggccttggtggtgaccaccgagaagagagaccgtccgcagccccccagcaggccgatggtgcagcaggaggatgtgagagcacgcagcgtgctgctgtcctgggagccagggagcgacgggctctcccctgtgcgctactacaccatccagacccgcgagctgcccagcggcaggtgggcactgcactcggcctccgtgagccacaatgcctccagcttcattgtggacaggctgaagcccttcacgtcctacaagttccgagtgaaggcgaccaatgacattggcgacagcgagttcagcgaggagtcggagtcactgaccaccctgcaggctgcccccgatgaagcacccaccatcctctccgtgacgccccacaccaccacctccgtgctaatccgatggcagccgccagcagaggacaagatcaatggcatcctcctgggcttccggatccgataccgggagctgctctatgaaggactgaggggcttcacgcttcgaggcatcaacaacccaggggccacatgggctgagcttacctccatgtactccatgcggaacctgagccggcccagcctcacgcagtacgagctggacaacctgaacaagcacaggcggtacgagatacggatgagcgtgtacaacgctgtgggtgaggggccctccagccccccgcaggaggtctttgttggggaggcagtgcccacagcagcacctcgtaacgtggtcgtccacggcgccacggccacacagctggacgtgacttgggagccacctccgctggacagccagaatggagacatccaggggtacaagatttatttctgggaagcccagcgggggaacctcacagagcgagtgaagacgcttttcctggctgagaacagcgtgaagctcaagaacttgactggctacacggcctacatggtcagcgtggccgccttcaacgccgctggggatgggcctcggagcacccccacccaaggccagacccagcaagcagcccccagcgctcccagctcggtcaagttcagtgagctgaccacaacctcagtgaatgtgtcctgggaagccccgcagttccccaatggcatcctggagggctacaggctggtgtacgagccctgcagccccgtggatggagtcagcaagatcgtgaccgtggacgtgaaggggaacagccccctgtggctgaaggtgaaggacctggcggagggggtgacctacaggttccgcatcagagccaagaccttcacctacgggccggagatcgaagccaacgtcaccacgggccccggagaaggtgccccaggaccgcctggcgtgcccatcatcgtgcggtacagctctgccatcgccattcactggtccagcggagacccgggcaaagggcccatcacccgctacgtcatcgaggccagaccttcagacgagggactatgggacatcctcatcaaagacatccccaaggaggtgagctcctacacgttcagcatggacatcctgaagccgggcgtgagctatgacttccgggtcatcgcggtcaacgactatggtttcggcacccccagcagcccctcccagtctgtgccagcccagaaagccaaccccttctatgaggagtggtggttcttggtggtcattgccctggtcggcctcatcttcatcctgcttctggtcttcgtgctcatcatccggggccagagcaagaagtacgccaagaagacagactcggggaacagtgccaagtctggagccctaggccacagcgagatgatgagcttggatgaaagcagcttccctgccctggaactcaacaacaggcggctctccgtcaagaactctttctgccgaaagaacggcctgtacaccaggtctccccccaggcccagcccaggcagcctgcactactcggatgaggatgtcaccaaatacaacgacctcatccctgcagagagcagcagcctgacggagaagccctcagaaatctccgactctcagggaagtgacagcgagtacgaggtcgactcaaaccaccagaaggcccactcctttgtcaaccactacatcagtgaccccacatactacaactcgtggcggcgacagcagaagggcatctcgagggcacaggcctacagctacacggagagcgactcgggtgagccagaccacaccaccgtcaccaacagcaccagcacccagcagggcagcctctttcggcccaaggccagtcggactccaacgccccagaacccccctaaccccccaagtcagcagagcaccctctaccgtccccccagcagcctggccccaggctcccgggctcccatagcaggattttcatcatttgtttgacatcagaagaggaaaaagcagaaagagaaatggcaccaaactcctccttcacccctcctctcactgcctgccagaaaacaaaaacaccaagaaaccaagtcaacttttcacctcctgagtttatttttccagagattccagggccagcaaagccggcgttcagaaggagggagaaaaccgtgagaggatgtgtgtggccagcagctcttcagctttgagatggtggggttcactgctcccttgggaattacacggagctggggaagtggctgtgtcactgctatggacacggagtggggcgggcatctggagagagagagggagcggaggctaaggactggaggccgccaggcaggcgtggccgagggaagaaaaagcttctggatgtccagccagctgcccccttccagcccctccaggacccctggacccactgccgctgctctctgcaaaaagaatgggcatcccggaggccacgcctatcttctctctctgctcctccttccctccatgcaccatcactgtggctggcaggcatcggacagcctcatccagaccccctgccctgtcttggcaacctctactgcccatctcccctgctcaacttctccaccaagcatttggtttatttagaaaaaggaagaaaaacaaaaaacaaaaaactaaagggtgagaatttgcttagcgccttccttgttcctgcatattttttaaaatattgaatccaaggaagagagcccaagggtaggggagaaaccccccacaactgacccctgcctccctgtgctggaattgactttcctgagcatggacaaggaaaggtgaagtctggggagcagaggtgtaaataaggcgactggccttggcactgtgggatgattaggtttaacgcattgtgggcaagataagaatgacactttgactgttctctttcttccaatccaggttccatccgtcctctctttaaaggggtagtcagcttcccaaggctggggagtggggcacagctgagggatctccctctgggcagacacgtcactctccactggatagatcctcaccacacacacacacacacacacatctcccatgcacttacaaggaacagggtctagggatcctctccagaacaaactcatctgggccctcctagccagacagcacactcactttcagatctgtgtccctctcactgccacccggcagcctcctaagcacagaggcacaggagcccagaggggtggcccaagtccctggtccagaggctggaatacccagagtttgctcagtcagcctagcacccagtttacaggcaaaaaggcaaagacaccctaacccccagtaacagcttccaggctgggctccgcctggccagggcggggaggggaaggggcaggtcaggaagctcagtccaaagtggacccagcatttgaattgcacgcccagcaggggcaggtcagatgggaccaagtgacaagaatagctgatgggagggaatgcttttacacacacacacacacacacacacacacatacacatacacaatctgctccaaggagtgttctgcaaaaagccacatccagtggccaggatcttcccgtccacttggtacttacggatgccagggtttagggagaagcctttctatctaactccatacattgtccaaggccctctgtgccctcagccagccctgtaaggccagcccaacacctgccccaccgctgagatgggtggcagatggcccacaggggcctgtctgattcagcgtgagccccttcgtggagcagggctccctctgtgcactgtgtacaggcgctgctggccctgcccaagagatgatgctctgttggggtgggtgagcagagttcaaggaagcccaagtaggagatttgggaaacatgccaaggtaagagagagcctggaccactctcctacagccccaagtcagtcactgtgctaatggtgaccgggaagggaagtcagggtctggggcccaaagaacgggcacacccagccatgagtttttcctgaagcacttgacccctgggaaatgtgaacggggagatgctggaagatggctcagcagacaggccagcccagctccagtgtccaaaaagcggtttctccaataaggaggcctgggaagggaagcacaatcttccccaaaggagaaccaagggctgaggttctgcccctccaggaagtaaggtgctctcggggcctccttggacttgtctgggggctgcagtggagtcagctggacacctgctccacccctgccacctccgcccccaccctctgcagcatctggcatctccatggcagcacatctgcagctgccggcctgtgatcgtgccgcacagctttcttttctttcctctcatcttttttttttttttttttttaaataacttcatccctttccctctctgctgagcatttaaccatttaaggaagttcccagtttgcattagggaattatttaagcccagcccagtgagggattatttgggaggaagcaggagtgagtaaaaacattgtgtctgtgtatatattgcacatgaggtcaattttcctttgcctttaatgaatcacctggtgcactaagatattccacccccccactccccacacgctcattcgcacccatgctgacacctacgtgtacatgcgggatggtgcccatgcacgcctgtgcttacacacatgcacacacaaatatgcacagaacacacatctgtatgtgtgttagcaaagagactcctgaactccctctgatggctgaagccatctctcccctgtgaggcacaggtggcctgggttgcttgcacttggggcgtggctgggatctattgtctgagagggtgaggacaccacgcaaatttagacaagcccatgagatcaggctgggcccatggtgaaagtcccacacttagtcaatacccactcatctggaatattgtctccacagccccagccacagctggaagcccaggcctgcagctgtggaactctagattttttcaggacacgtctctttgcccttgtttacatatctactggcacagccgaggctcccaaccgtcctcccagaaacctggccacattagaaaggggtggtgggccctgccctttgtagaaagagtgggaccctttctggcctgtgattttccgtgccagtgatgccagggcccctgcctgtgggactccacccaaagcaggttcacaccaggacacacctggcacctttggcattgcctccttgtgccctaagcaatctcccagtgttgcacccaggagcccatgctgggcacaccagggctttccccttcctggctgcgcctccagagttgacgtcagctccacacccacactgccaagacaaaccaaaaagatgctctgggctccagaaccaccatcctcctagggctccagagagtttgcaaacccaggctgcctccccttctgtccatccctcaccccccggcccccaaaactcctacccccaaacctggcactgccgtgatttagaggaaacaaggacacagcgggggctgcccccacctggtgcacgctgcctcaaggccttctgttgctgcccacgcctccctgggcagtgcttctaaaggtgccagagcctcaccacagtgccactctggctgggcaggggcttccctcagcttcccagagtgcacatctgaaggtgcctaccctgggtgaggggctggtgggcaggaaggtaaaggggagaccatctgagcagccgccacccgctccccagtgcctctgtatggccctatccagggacacccatgggcatgcgcacatggcaatcctgaccaccacctgagcacaggtgccccctcgggaccaccccccttctctttgtttccatcagaataaccaaaagcatttaaacgtgttacctttctccatccatctagactccagaaacaaaaatcaacacaaatctttattttttgatttaaaagatataacaaaaaattatggggagagtattcattatggcaggtgtctgtctgtaagaaaaaaatatatatctctatgtcatatagcgtgttagcaggtttattttttaaatgaaaggtaagaaagaaattgatttgaaatatataccacaagaagtcccgtgtcctgtcaaactgtcagtattttataaataaacttttttttttgga

SEQ ID NO: 181438 - DNA, 4638 bp, Homo sapiens
  Payload ID: 15735
  Gene Symbol: SDK2
  Gene Name: sidekick cell adhesion molecule 2
  ENST ID: ENST00000424778
  CDS Start-End: 1-3990
cagggctacaagctgatcgcctgggagccggaacaggaagaggaggttaccatggtgaccgcccggcctaactttcaagacagcatccacgtgggcttcgtgtctggcctgaagaagttcaccgagtacttcacctcagtgctgtgtttcaccacccccggggacgggccacgcagcaccccgcagctggtgcgcacccatgaggatgtgcctgggcccgtgggacacctgagcttcagtgagatcctggacacatcgctgaaggtcagctggcaagagccgggagagaaaaatggcatcctcacagggtaccggatctcctgggaggagtacaatcgaaccaacacccgtgtgacccactacctgcccaacgtgaccctggagtaccgtgtcacgggcctcaccgcgctcaccacctacaccatcgaggtggccgccatgacctcaaagggccagggccaagtgtccgcctccaccatctcctctggggtgcccccagaactcccagggccccccaccaacctgggcatttccaacatcggcccccgctctgtgaccttgcagttcaggccaggctacgatgggaaaacctccatctcccgctggctggtggaagcccaggtaggcgtggttggggagggagaggagtggttgctgatccaccagctctccaatgagcccgatgcccgctccatggaggtgcccgacctcaaccccttcacctgctacagcttccgcatgcgccaggtgaacatcgtgggcaccagcccccccagtcagccttctagaaagatccagaccctgcaggcaccccctgacatggccccagccaatgtgtctctgcgcacagccagtgagaccagcctgtggctgcgctggatgcctctcccggagatggaatacaatgggaaccctgagtccgtgggctataagatcaagtacagccggtcagacgggcatggcaagacgctgagccacgtggtgcaggaccgtgtggagcgggactacaccatcgaggacctggaggagtggacagagtaccgcgtccaggtccaggccttcaacgccatcgggagcgggccctggagccagacggtggtgggcaggacccgggagtcagttccctcttccggccccaccaatgtgtctgcactggccaccacctccagcagcatgctggtgcgctggagcgaggtccccgaggctgatcgcaacgggctcgtgctgggctataaggtgatgtataaggagaaggactcggacacccagccccgattctggctggtggaaggcaactcgtctcgcagtgcccagctcaccggcttgggcaaatacgtgctctatgaagtccaggtgctggccttcacacgcatcggggacggcagccccagccaccctcccatcctggagcggacgctggatgatgtcccaggaccacccatgggcatcctgttcccagaggtgcggaccacgtctgtgcggctgatctggcagccccctgccgcccccaatggcatcattcttgcttaccagatcacacaccggctcaacaccaccacggccaacaccgccactgtggaggtgctggcacccagcgcccggcagtacacagccacgggcctcaagccagagtctgtctacctgttccgcatcacggcccagacccgcaagggctggggagaagctgccgaggccttggtggtgaccaccgagaagagagaccgtccgcagccccccagcaggccgatggtgcagcaggaggatgtgagagcacgcagcgtgctgctgtcctgggagccagggagcgacgggctctcccctgtgcgctactacaccatccagacccgcgagctgcccagcggcaggtgggcactgcactcggcctccgtgagccacaatgcctccagcttcattgtggacaggctgaagcccttcacgtcctacaagttccgagtgaaggcgaccaatgacattggcgacagcgagttcagcgaggagtcggagtcactgaccaccctgcaggctgcccccgatgaagcacccaccatcctctccgtgacgccccacaccaccacctccgtgctaatccgatggcagccgccagcagaggacaagatcaatggcatcctcctgggcttccggatccgataccgggagctgctctatgaaggactgaggggcttcacgcttcgaggcatcaacaacccaggggccacatgggctgagcttacctacctgaacaagcacaggcggtacgagatacggatgagcgtgtacaacgctgtgggtgaggggccctccagccccccgcaggaggtctttgttggggaggcagtgcccacagcagcacctcgtaacgtggtcgtccacggcgccacggccacacagctggacgtgacttgggagccacctccgctggacagccagaatggagacatccaggggtacaagatttatttctgggaagcccagcgggggaacctcacagagcgagtgaagacgcttttcctggctgagaacagcgtgaagctcaagaacttgactggctacacggcctacatggtcagcgtggccgccttcaacgccgctggggatgggcctcggagcacccccacccaaggccagacccagcaagcagcccccagcgctcccagctcggtcaagttcagtgagctgaccacaacctcagtgaatgtgtcctgggaagccccgcagttccccaatggcatcctggagggctacaggctggtgtacgagccctgcagccccgtggatggagtcagcaagatcgtgaccgtggacgtgaaggggaacagccccctgtggctgaaggtgaaggacctggcggagggggtgacctacaggttccgcatcagagccaagaccttcacctacgggccggagatcgaagccaacgtcaccacgggccccggagaaggtgccccaggaccgcctggcgtgcccatcatcgtgcggtacagctctgccatcgccattcactggtccagcggagacccgggcaaagggcccatcacccgctacgtcatcgaggccagaccttcagacgagggactatgggacatcctcatcaaagacatccccaaggaggtgagctcctacacgttcagcatggacatcctgaagccgggcgtgagctatgacttccgggtcatcgcggtcaacgactatggtttcggcacccccagcagcccctcccagtctgtgccagcccagaaagccaaccccttctatgaggagtggtggttcttggtggtcattgccctggtcggcctcatcttcatcctgcttctggtcttcgtgctcatcatccggggccagagcaagaagtacgccaagaagacagactcggggaacagtgccaagtctggagccctaggccacagcgagatgatgagcttggatgaaagcagcttccctgccctggaactcaacaacaggcggctctccgtcaagaactctttctgccgaaagaacggcctgtacaccaggtctccccccaggcccagcccaggcagcctgcactactcggatgaggatgtcaccaaatacaacgacctcatccctgcagagagcagcagcctgacggagaagccctcagaaatctccgactctcagggaagtgacagcgagtacgaggtcgactcaaaccaccagaaggcccactcctttgtcaaccactacatcagtgaccccacatactacaactcgtggcggcgacagcagaagggcatctcgagggcacaggcctacagctacacggagagcgactcgggtgagccagaccacaccaccgtcaccaacagcaccagcacccagcagggcagcctctttcggcccaaggccagtcggactccaacgccccagaacccccctaaccccccaagtcagcagagcaccctctaccgtccccccagcagcctggccccaggctcccgggctcccatagcaggattttcatcatttgtttgacatcagaagaggaaaaagcagaaagagaaatggcaccaaactcctccttcacccctcctctcactgcctgccagaaaacaaaaacaccaagaaaccaagtcaacttttcacctcctgagtttatttttccagagattccagggccagcaaagccggcgttcagaaggagggagaaaaccgtgagaggatgtgtgtggccagcagctcttcagctttgagatggtggggttcactgctcccttgggaattacacggagctggggaagtggctgtgtcactgctatggacacggagtggggcgggcatctggagagagagagggagcggaggctaaggactggaggccgccaggcaggcgtggccgagggaagaaaaagcttctggatgtccagccagctgcccccttccagcccctccaggacccctggacccactgccgctgctctctgcaaaaagaatgggcatcccggaggccacgcctatcttctctctctgctcctccttccctccatgcaccatcactgtggctggcaggcatcggacagcctcatccagaccccctgccctgtcttggcaacctctactgcccatctcccctgctcaacttctccaccaagcatttggtttatttagaaaaaggaagaaaaa

SEQ ID NO: 181439 - DNA, 4231 bp, Homo sapiens
  Payload ID: 15736
  Gene Symbol: SFXN1
  Gene Name: sideroflexin 1
  Uniprot ID: Q9H9B4
  ENST ID: ENST00000321442
  CDS Start-End: 255-1223
ggcgcggtcgctaagccagaagcggagtcgcgggcgcggggcggggcctggacccgggcctggacccggagggcgggtccctgggcctcgtagctcccgggcccggacgcgcgctcacaggcgcgcgcgaggacgcgctccggggacgcgcgaggacgccgtggcgggagaagcgtttccggtggcggcggaggctgcactgagcgggacctgcgagcagcgcgggcggcagcccgggggaagcgtccgggaccatgtctggagaactaccaccaaacattaacatcaaggaacctcgatgggatcaaagcactttcattggacgagccaatcatttcttcactgtaactgaccccaggaacattctgttaaccaacgaacaactcgagagtgcgagaaaaatagtacatgattacaggcaaggaattgttcctcctggtcttacagaaaatgaattgtggagagcaaagtacatctatgattcagcttttcatcctgacactggtgagaagatgattttgataggaagaatgtcagcccaggttcccatgaacatgaccatcacaggttgtatgatgacgttttacaggactacgccggctgtgctgttctggcagtggattaaccagtccttcaatgccgtcgtcaattacaccaacagaagtggagacgcacccctcactgtcaatgagttgggaacagcttacgtttctgcaacaactggtgccgtagcaacagctctaggactcaatgcattgaccaagcatgtctcaccactgataggacgttttgttccctttgctgccgtagctgctgctaattgcattaatattccattaatgaggcaaagggaactcaaagttggcattcccgtcacggatgagaatgggaaccgcttgggggagtcggcgaacgctgcgaaacaagccatcacgcaagttgtcgtgtccaggattctcatggcagcccctggcatggccatccctccattcattatgaacactttggaaaagaaagcctttttgaagaggttcccatggatgagtgcacccattcaagttgggttagttggcttctgtttggtgtttgctacacccctgtgttgtgccctgtttcctcagaaaagttccatgtctgtgacaagcttggaggccgagttgcaagctaagatccaagagagccatcctgaattgcgacgcgtgtacttcaataagggattgtaaagcagggaggaaacctctgcagctcattctgccactgcaaagctggtgtagccatgctggtgagaaaaatcctgttcaacctgggttctcccagttacggaaaccttttaaagatccacattagccttttagaataaagctgctactttaacagagcacctggcgtgggccaagtgcctgatactcccttacactgaatcatgttatgatttatagaaatacctttcctgtagcttttatagtcattgtttttcaaagacgatataccagccctcacccaggttttaaaaaagcactggtaggcatagaataggtgctcagtatatggtcagtaaatgttctattgattatcaatcagtgaaaaaagaaatctgtttaaaatactgaattttcatctcactcccattgcaaatcaaggagatctcagcagtgaactgggaaaatacaaaagctctgggctaatctataaaaacttaccctgaaatattaagggcagtttgcttctagtttggggattgcgctagcccaatgaaggtgatgaagcttttggatttggagggtaaaagctccttcacaccccttccaaaagtcagtcacagaccactgcaacatgccttccctgctggatcattatatacattcagattgtgagtggattgccttggttgacttttaatttattgttttttgttcttataaagatgataatcttaccttgcagttattgactttatattcaattatttacatcaaataatgaaataactgaaatgtacaaatgtcaaattttggaagtatattcaataccaatgctgtatgagtgggctgaatccagttcattgttttttttttggtaagaagtgagactacagttccagctacctacatgtcttttcttgtcatccttatagatctctttggctttcagaaagatacagtgataatgtgtgtatgaatcagtcacaatgaattttacttgaatattgtatgttgcattccacttcatttgaaaataatgaaaccatgtaccactgtttacatcatctgtagtgatttcatagataatatatttaatatgacagattatgtttcaactctgtagatgtttaacgtcatagacagttggccctctgtatccgtgagctctatatctgtgaattcaaccaagtttggatggaaaattttttttttttttttttttttgagacggagtctcgctctgtcacccaggctggagtgcagtggcgtagtctcggctcactgcaagctccgcctcccgggttcacgccgttctcctgcctcagcctctctgagaagctgggactacaggcgcccgccaccacgcccggctaatttttttgtatttttagtagagacggggtttcactgtggtctcgatctcctgacctcgtgatccgcccgccttggcctcccaaggtgctgggattacaagcgtgagccaccgcacccggcctgaaaatattttctaaaaagataaaaaatatacataacgatgaaaaataatacaaatttaaaaaccaatacagtataacaactatttacatagtgcttacattgtattaggtgttataagcaatctagagatgatttagcaagtatacaggaggatgtgcctaggttatatgcaaatactgtgccattttatatcaggaacttgagcatctgcagatattggtatcggagggcggtcctggaaccaagcatccacggatactgaggggtgacatttcatgaagtgtagatcattgtattcagagattgtaaatgaaaaaaatatagaaactatttagttttggtagattttttttctgacaatgtgaccagactgaatttcctcataaagaaaaaatggcgtgccttgtgtctgtgtttctcttttctctgaaaggattaatagatctgaagctttgggccactcagagccttccttgatgctgccagagtcttcttatttagattttctgtcttaaaccattggaagcaaaacggttttcccatgacattctggccttggacagattctgttgtcctcgacgcgtctctttataaagtggtaaaagcctgaaattcagggcagctctccatgaggtgctgaagggctcttttcataagaagctaaggcactgctgcctgccccaggtgtcccgctcctctcagagtcctccccctaccaggtagtgtgtagctccatttcagaatgttaacctccagtgaagagctaatgactggttagaagattgacaaactaaccaaaattttacacactccggttatgtgtgtgaaaggttataaaaggaatggccgggtgcggtggctcacccctgtaatcccagcactttgggaggccgaggcgggtggatcacctgaggtcaggagtttgagaccagcctggccaacatggagaaaccccgcctctactaaaaatacaaaaaattagccaggcatggaggcacatgcctataatcccagctactcgggaggctgaggtaggagaatcgcttgaatccgggagctggaggttgcagtgagccaagatcgcaccattgcactccagcctgggcaacaagagcgaaactccatctcaaaaaaaaaaaaaagagattataaaagggatgatgaacatggagctgcatctttttaaacgttgttttttgatgcttcagactcttaatgcttttatataaagctatcaactgtatgttgatcacagtttataagaaagaacaaatcaagattggcaatccttgccgatcttttagaaataccttttctggagaaaaaaaaatccacatgaagtgcaataagcttataaagctaagtagttattaatatttctattaacatgatacaaaggatgatgattgtaagtgtttactgactggcagcttttatttcagtattagcacagcgtcttgccagtgttggaggccatgtattatttcagttcaactggatgaaatgttaaataaactcagaatgaaaataaa

SEQ ID NO: 181440 - DNA, 572 bp, Homo sapiens
  Payload ID: 15736
  Gene Symbol: SFXN1
  Gene Name: sideroflexin 1
  ENST ID: ENST00000507017
  CDS Start-End: 139-572
ctcactctatcacctaggttggagtgcagtggcacaatctcagccgactgcaacctccacatcccaggctccagcaatcctgctacctcagcctcctgagtagctgggaccatacgccaccatgcccagtccgggaccatgtctggagaactaccaccaaacattaacatcaaggaacctcgatgggatcaaagcactttcattggacgagccaatcatttcttcactgtaactgaccccaggaacattctgttaaccaacgaacaactcgagagtgcgagaaaaatagtacatgattacaggcaaggaattgttcctcctggtcttacagaaaatgaattgtggagagcaaagtacatctatgattcagcttttcatcctgacactggtgagaagatgattttgataggaagaatgtcagcccaggttcccatgaacatgaccatcacaggttgtatgatgacgttttacaggactacgccggctgtgctgttctggcagtggattaaccagtccttcaatgccgtcgtcaattacaccaacagaagtggagacgcacccctcactgtcaa

SEQ ID NO: 181441 - DNA, 796 bp, Homo sapiens
  Payload ID: 15736
  Gene Symbol: SFXN1
  Gene Name: sideroflexin 1
  ENST ID: ENST00000506963
  CDS Start-End: 216-796
cactgagcgggacctgcgagcagcgcgggcggcagcccgggggaagcgaggcatggtcttgctttgtcacccaggctggagtgcagcggcatgatgatagctcactacagctccaactcttgggctcaagcgatccccacaccccactgccacctcagcctcctgagtagctgcaactataggcgtgcaccaccatgcccggataatccgggaccatgtctggagaactaccaccaaacattaacatcaaggaacctcgatgggatcaaagcactttcattggacgagccaatcatttcttcactgtaactgaccccaggaacattctgttaaccaacgaacaactcgagagtgcgagaaaaatagtacatgattacaggcaaggaattgttcctcctggtcttacagaaaatgaattgtggagagcaaagtacatctatgattcagcttttcatcctgacactggtgagaagatgattttgataggaagaatgtcagcccaggttcccatgaacatgaccatcacaggttgtatgatgacgttttacaggactacgccggctgtgctgttctggcagtggattaaccagtccttcaatgccgtcgtcaattacaccaacagaagtggagacgcacccctcactgtcaatgagttgggaacagcttacgtttctgcaacaactggtgccgtagcaacagctctaggactcaatgcattgaccaagcatgtctcaccactgataggacgttttgttccctttgctgccgtagctgctgctaattgcattaatattcc

SEQ ID NO: 181442 - DNA, 2611 bp, Homo sapiens
  Payload ID: 15736
  Gene Symbol: SFXN1
  Gene Name: sideroflexin 1
  ENST ID: ENST00000507823
  CDS Start-End: 88-258
tgcactgagcgggacctgcgagcagcgcgggcggcagcccgggggaagcggtgagtcgcgggcggcaggcccagccagtccgggaccatgtctggagaactaccaccaaacattaacatcaaggaacctcgatgggatcaaagcactttcattggacgagccaatcatttcttcactgtaactgaccccaggaacattctgttaaccaacgaacaactcgagagtgcgagaaaaatagtacatgattacagaaaatgaattgtggagagcaaagtacatctatgattcagcttttcatcctgacactggtgagaagatgattttgataggaagaatgtcagcccaggttcccatgaacatgaccatcacaggttgtatgatgacgttttacaggactacgccggctgtgctgttctggcagtggattaaccagtccttcaatgccgtcgtcaattacaccaacagaagtggagacgcacccctcactgtcaatgagttgggaacagcttacgtttctgcaacaactggtgccgtagcaacagctctaggactcaatgcattgaccaagcatgtctcaccactgataggacgttttgttccctttgctgccgtagctgctgctaattgcattaatattccattaatgaggcaaagggaactcaaagttggcattcccgtcacggatgagaatgggaaccgcttgggggagtcggcgaacgctgcgaaacaagccatcacgcaagttgtcgtgtccaggattctcatggcagcccctggcatggccatccctccattcattatgaacactttggaaaagaaagcctttttgaagaggttcccatggatgagtgcacccattcaagttgggttagttggcttctgtttggtgtttgctacacccctgtgttgtgccctgtttcctcagaaaaggtatgtatttgttattcgtcagaatcatcatgagtattaatcctaaaaaccaattgaaggtgcaggtgccattattccatttcattggcagggaagttgagactcaaaagatactgaagccagggtctcttaaaaggaagggatggaggcagaaatcaaacccacatctgtctaatttcagatgcacccagctcttttctacccccttccattaaatttgaaaatgctttattcttttgtgagaatcagattaactctgatgcaaatttgcttttatgaaaatttaaaatatggtccaatccactggcaaatgcatctgtaatacagatatgataggatgcaagttccacccccagggacagcaattatatgcacttagcttaggtggttggtatatttgcttcctttcttcccacttagttttttgccttaaaagctttcttgtgcacgcctctcatcgcaaactgcccttgaatcctgcctttgatgtgagaacaggactaactggcgttaaatcggcattttctacatcaggtctccagcctgctcttgacctgactccaacacacaaagcagcggcattttgttgtctgtcattttctgtaagtgttaccaggccccttgccttggtaataccctttcctttgtgggccagtaggtcccgaacatatggtctttaatcccccagccttgcggagttggttttggatgaggtgttctgttctagaactaatgctgtcagatccctctacctgatcgagaactccaccttgtatctgctctcccactctgtctccgaccctgctgttcttgaatagaaatttaaacctcatggacaggagcccttcatcaccttggagcctactgaagagccccccttgaagagggcaggaccttcagaacttgctctgggagcctgattcagatgaatttcctcatctctacagtgggataatgatacctgcttaattgtacaaaccccagagtcttggggctcaacctgagaatgtccatttctgtagtatgtggcttatgaacactggtgttcagcagctggccttgatttagcagtttagactttgagcacataaaatgccaaggggtgtgcctgataccaagttgtaaaacacctaagaaatgtagctgtaattattttcagattgaaagggttttagatttgaaaacccatagagaaactttctactttggccttttttctttgagtgctgcaagaaataaaatatagcccaacatttattttttatgattcattgaaactctaggggtagaaatggaaagctttctgtaactactagtgtccttaggtcaaggccctcagaaagcgtgtggttttacatttgagaaaccaatcctcttttgttttactgtattttaaaatagcttcttactctgttttgttgtttatacattgtatgtttggcttcttgaggtctctggctcctcagtttttccttggctcataacatagtatcctcattgatccaagcatgaccctgttttgcttatttttattttacttatactaataatataatgaatatccacaaattcagtgcccaatgaggcaggagaatcgctcgaacccagtaggcagaggctgtggtgagccaagatcacgctactgcattccagcctgggcaacagtgcgagattctgtctc

SEQ ID NO: 181443 - DNA, 641 bp, Homo sapiens
  Payload ID: 15736
  Gene Symbol: SFXN1
  Gene Name: sideroflexin 1
  ENST ID: ENST00000502865
  CDS Start-End: 1-68
ggaacattctgttaaccaacgaacaactcgagagtgcgagaaaaatagtacatgattacagaaaatgaattgtggagagcaaagtacatctatgattcagcttttcatcctgacactggtgagaagatgattttgataggaagaatgtcagcccaggttcccatgaacatgaccatcacaggttgtatgatgacgttttacaggactacgccggctgtgctgttctggcagtggattaaccagtccttcaatgccgtcgtcaattacaccaacagaagtggagacgcacccctcactgtcaatgagttgggaacagcttacgtttctgcaacaactggtgccgtagcaacagctctaggactcaatgcattgaccaagcatgtctcaccactgataggacgttttgttccctttgctgccgtagctgctgctaattgcattaatattccattaatgaggcaaagggaactcaaagttggcattcccgtcacggatgagaatgggaaccgcttgggggagtcggcgaacgctgcgaaacaagccatcacgcaagttgtcgtgtccaggattctcatggcagcccctggcatggccatccctccattcattatgaacactttggaaaagaaagcctttttgaa

SEQ ID NO: 181444 - DNA, 637 bp, Homo sapiens
  Payload ID: 15736
  Gene Symbol: SFXN1
  Gene Name: sideroflexin 1
  ENST ID: ENST00000502393
  CDS Start-End: 75-608
ggtggcggcggaggctgcactgagcgggacctgcgagcagcgcgggcggcagcccgggggaagcgtccgggaccatgtctggagaactaccaccaaacattaacatcaaggaacctcgatgggatcaaagcactttcattggacgagccaatcatttcttcactgtaactgaccccaggaacattctgttaaccaacgaacaactcgagagtgcgagaaaaatagtacatgattacaggcaaggaattgttcctcctggtcttacagaaaatgaattgtggagagcaaagtacatctatgattcagcttttcatcctgacactggtgagaagatgattttgataggaagaatgtcagcccaggttcccatgaacatgaccatcacaggttgtatgatgacgttttacaggactacgccggctgtgctgttctggcagtggattaaccagtccttcaatgccgtcgtcaattacaccaacagaagtggagacgcacccctcactgtcaatgagttgggaacagcttacgtttctgcaacaactggtgccgtagcaacagctctaggactcaatgcattgaccaaggtactcagatttttatttccataataaagctgtttaatttgttatcacctgcc

SEQ ID NO: 181445 - DNA, 6866 bp, Homo sapiens
  Payload ID: 15737
  Gene Symbol: SFXN2
  Gene Name: sideroflexin 2
  Uniprot ID: Q96NB2
  ENST ID: ENST00000369893
  CDS Start-End: 168-1136
ggcgggagcctcccggcctgggattggtcgaaaaggaggggcgtggggcgggcgtgggggcagttccccagcccaggtcctcctctcacccgggccagttttcaaggcgggctgtaactggtggcatttgtcccgggaccaggtccacagttttatgtgtgagcaagatggaggctgacctgtctggctttaacatcgatgccccccgttgggaccagcgcaccttcctggggagagtgaagcacttcctaaacatcacggacccccgcactgtctttgtatctgagcgggagctggactgggccaaggtgatggtggagaagagcaggatgggggttgtgcccccaggcacccaagtggagcagctgctgtatgccaagaagctgtatgactcggccttccaccccgacactggggagaagatgaatgtcatcgggcgcatgtctttccagcttcctggcggcatgatcatcacgggcttcatgctccagttctacaggacgatgccggcggtgatcttctggcagtgggtgaaccagtccttcaatgccttagtcaactacaccaacaggaatgcggcttcccccacatcagtcaggcagatggccctttcctacttcacagccacaaccactgctgtggccacggctgtgggcatgaacatgttgacaaagaaagcgccgcccttggtgggccgctgggtgccctttgccgctgtggctgcggctaactgtgtcaatatccccatgatgcgacagcaggagctcataaagggaatctgcgtgaaggacaggaatgaaaatgagattggtcattcccggagagctgcggccataggcatcacccaagtagttatttctcggatcaccatgtcagctcctgggatgatcttgctgccagtcatcatggaaaggcttgagaaattgcacttcatgcagaaagtcaaggtcctgcacgccccattgcaggtcatgctgagcgggtgcttcctcatcttcatggtgccagtggcgtgtgggcttttcccacagaaatgtgaattgccagtttcctatctggaaccgaagctccaagacactatcaaggccaagtatggagaacttgagccttatgtctacttcaataagggtctctaaatgccccacttcagcaaggaccagtctattcccatattcaccagctcctccttagctacgtgcacacttgtgtcctccttcccctttgccaacaaggcctgaaggccagggtagattggggggtgggacaatgaatgcctcatacttacaccctggtactggttgattggacctcaggggaaaaaagtgaaaaagggtagcaaaggccaatgtcttctagctgcttcctcaacccctgtcccctggagaccagaagctgaggccctctcagggaggagacatccaagcaaatcatttggaaaagttaggaaacctttaggattctggttccagccagggttgaggaaaagaccttggatcaaaaggaagcttctatacctctttcttcttcgcttcctcctctcccaagcaatggaaacttttacccatgtaattctagctgaactcaggaaaaagaagggggaaaggactctgtccccttggggctcatcacccttccacatcctcctcctcgttgccccctggtcaggcagcttcttttttttttttttcaagatggagtcttgctctgtcgcccaggctggaatgcagtggcgcgatctcggctcactgcaaactctgcctcctggattcaagcgattctcctgcctcagcctctcaagtagctgggattacagggcacctgccaccacgcctggctaatttttgtattttagtggagacggggtttcaccatgctggccagactggtctcgaactcctgacctcaggtgatccgcccgcctcagcctctgaaattgctgggattacaggcatgagccaccacacccagcccggacagcttctttgggagtgctgctaaccttgaaattatcagacacttaggagttattagtgctaaaaaggggaccgtgcaaggcagcagagttacatggttcttcaaatcatgtctgaacctattcttggaatcttctctataataagggaagttctcttaccccactgccacatacctctgttttaaaagataagtccactaactgtgagtaaaaatgatatatataggcattaaccacacactttaatgggtataatttcctggctgcctcccttcctcagcccattaggttaaacaccaaagaaagactggtgtgtactgaataggaaagggaagttttatttggaaccttctaagaggaaatcaaccaggaccaaagagccttaaaggacacacagcaatgcacagccacttcccttccccagcttggctgccctaggtgatttctcaagctccttgggggactgttgtttctcatctggaatcaatgtgtgtatgagttttgtctggtaggattgctgactctgtccaacagatatcactgtgaattgaataaatttgttgaaagagcacacaggcacacatacacacaaactgtaaactaagttaatgaagcctgaatggaaagcaggatctggccttactttggccttggcatgtcagaaggtatcacaactactatataaggggaacttgtctgatgcctggaggctgttgtttatttccctcattaaaggggaaatccacctgtctccacaggaagctccagatctcccagaatgggagctgtgttgccctagagcaagagttggcaagctatggctcaaggggccaaatccacctgccacctgtttttgtgcaattggaagctaagaatgtttttacatttttaaagagttgtaaaagggaacaacaggaatgacagagaccctacctatgtggcatacaaagcctaaaatatttactgtctgatccttgacacaaaaagtttcccctgccctggagcagtggttcttaagcacatgcatcaaccgggcgcagtggctcatgcctgtaatccccacactttgggaggccgaggcaggtggatcacctgaggtcaggagttcgagaccagcctgatcaacatggtgaaacccgatctctactaaaaatacaaaaaatttgctgggtgtggtggcatacacctgtaatcccagctactcggggggctgagactggagaatcacttgaacctgggaggtggaggttgtggtgagccaagattgcgccactgcactccaacctgggcgactccgtctcaaaaaaaaaaaagaaaacacatcagaattagctggcaggcttgttaaagcacagattgcaggatccattgccagattctgtcactctgggctggagcctgagaacgtgcatttctagtcattgcccggtgatgctgattctgttggtcttggcaccatacgtggaggagcactgctctaaggggaaagggcctcctccccgaggccaaggaattcactgcaacttgatttttctccccgtttaaaaaagttaaaatataactcacataccataaacttagtccttttaaagtgtacaattcagtggtttttaatgtagtcacaaagttgtacaagcatcaccactaattccagaattattttgagacaggatctcactctgttaccctggttggagtgcagtagtgcaatcactgctcattgcagcctcaacctcctgagctcaagtaatcctcctgcctcagcctctggggtagctgggaccacaggctaatttgatttttttgatgaggtctcactatgttgccccaggctggtctcgaactcatggcctcaagtgatcctcctccctcagccttccaaagtgttggaattacacacatgagccactgcatctggtctcagaacatttttcttagccccaaaagaaaccccatacccattggcagtcactccacattctccctacctgccagcgcctcacaattcacttcctgtctttagagatttgcgtattctgaacatttcatgtaagtggagtaatgcagtatgtggccctctgtgtctggtttctttccttaggataatgttttcaaggttcatccatgttgtagcatatgcaatttgattttagctggtgtctgaacagaaaagtctgtctttgagctagcttctttaggacaggagacctggctttatttccaaaagcaaataggaaaagggaaacattaccagagccagtagagcttggaaacaactcctgactgatgttctttcagaacatacaatgtttccccttccttctcagctcctcaagcctcttggatttcctgttctcttatagacaactgctcttttggaaatgtctggaaggtatgtggtggctataatgttcagggacattctaaaaagtggtcactcaaactgcatctcagtctcattttgtaacatctctcttctttgagttggctgctgtgggatgttgaataagaggcagttaaggttactaaaaggccttggtgtgggaagtgctaatccagactgtcctatccaatagctcagcttgagctttcaggtaaaaggagaaagggaagttggggcaaaatcccctgtgtttgccaaactgaattggggtttcttatttattgagagaaagagggtatcactttcttgcccaggctggagtgcaatggtatgatcatgactcattgcttcctcagcctcctggactcaagtgatcctcctgccttagcctcccgagtagcttctttttcctgagttcggctagaatagcatgggtaaaaggttccattgctcgggagaggaggaggaagggaagaagaagaggtatagaagcttccttttgatccaaggtcttttcctcaatcctggctagaaccagaatcctaaaggtttcctgactacaggtacatgccaccatgcccagctaatttttaaattttttgtagacagagggcctcactatgtttcccaggttggtcttgaacccctgacctcaagcaatcctcatgccttggcctcccaaagtgttgggattacaggcgtgagccactacatcccacctggggtttcttagtgatgatgaaacctagcctttatgtggaagacttacaactttttgaggccaggaattagagaccttgtgccatgaaaataatttggtccttccctagtactcaatttttacttctcctctaaggagcttgacttgtggaatggataaatttctaagaaacgagagattggcaaaaatacgtgtcactttttatagtacttggaaaagcaggatcaagataaaggcagaactatggactttcttaagctgagggaagactgacttaactcttacctgtttcccatttttccaacacttaagccaagaacaacttcctctgggctcagatgtgggctagactgggccaggctgtaaaacactttgacaggtttttgagaggaaattgactgctaaagtcaactgtgttatttgccatgggtcttcctttgtccatttattttaccaacttttttttttcttttttttttgagacagagtctcactctgtcacctagggtggagtgcagtggcacagtcttggctcactgcaacctctgcctcccaggttcaagcgattcttctgctttagcctcctgagtagctgggactacaggcatgcaccaccacgcctggctaattttttgtatttttagtagagattgggtttcacaatgttggccaggctcgaactcctgaccatgtgatccgcccacctcggcctcccaaagtgctgggattacaggcaggagccaccgcacctggcctttttttttttttgagacagggtctcactctgttgcccaggctggagtacagtggcacaatcaaggctcattgcagcttcaatctccctagctctggtgattgtcccacctcagcctcccaagtagctgggactacaagtgtgcaccaccatgcttggctaatttggctaatttagtttttttatttttgtagagacagggttctctccatgttgcccaggctggtttcaaactcctgagctcaagggatctacctgcctcagcctcccaaagggctaggattataagcatgagccaccacacctggctattttaccaacattgatcaagctctggttgagccttgtacaggatattataggctttaaaagaagaagaagaaagacctggtatgctgtacaaaaaactgcaaaccaggcacgcagatataagtgttacaagaatccagaagaagcagcaaggagatggggctaggagtttgtaagcagggaactgtatctgtaatatgtaaatgaagttactgggcatctcttcaatggtcagtgtgagtggaatgtgtgggaaaatgtagtggtgagaggtgagataaagagaagtagacagggacgaagtcacagagaggaccgtgttgggaagtttggactctctattctgtaggtagatgaagtatttaaaagaagaggccatgatatagtaatatttggtttaatgtggtatggttgtagtgtgtggcggaaatttgagaggaagaattgtcaacttgcagggcagcagggaagccatttgtatttagctagaagaacatggattgaagcaatggatgatggatttcagagcaatttgtgaagtagaaccagaattttgtccgtcgaacttggggtgacgaagcactatgcctcagataaaggtactatcttctagggaattcaaacggacctaagctgctatttgggcagttgagaccaagagaggcatcctggtaatagtgctgtgcttcaagacaaaagacattaaaatatttttacattgcaa

SEQ ID NO: 181446 - DNA, 606 bp, Homo sapiens
  Payload ID: 15737
  Gene Symbol: SFXN2
  Gene Name: sideroflexin 2
  ENST ID: ENST00000602544
  CDS Start-End: 77-415
gggccagttttcaaggcgggctgtaactggtggcatttgtcccgggaccaggtccacagttttatgtgtgagcaagatggaggctgacctgtctggctttaacatcgatgccccccgttgggaccagcgcaccttcctggggagagtgaagcacttcctaaacatcacggacccccgcactgtctttgtatctgagcgggagctggactgggccaaggtgatggtggagaagagcaggatgggggttgtgcccccaggcacccaagtggagcagctgctgtatgccaagaagctgtatgactcggccttccaccccgacactggggagaagatgaatgtcatcgggcgcatgtctttccagcttcctggcggcatgatcatcacgggcttcatgctccagttctacagctattgagctgggctttgggccgggtgttgggaatgtgaaggcttcagtaacctcccgtcaaggagctcccagttttgttgaggagaccaagaagtaaacagttacagtacagcttggacgatgccggcggtgatcttctggcagtgggtgaaccagtccttcaatgccttagtcaactacaccaacaggaatgcggc

SEQ ID NO: 181447 - DNA, 2324 bp, Homo sapiens
  Payload ID: 15737
  Gene Symbol: SFXN2
  Gene Name: sideroflexin 2
  ENST ID: ENST00000459894
  CDS Start-End: 79-639
agttttcaaggcgggctgtaactggtggcatttgtcccgggaccagtatgccttgtaatttttcactgaaagctggacatgatgtaccctgtgagaggaactgaggggtccacagttttatgtgtgagcaagatggaggctgacctgtctggctttaacatcgatgccccccgttgggaccagcgcaccttcctggggagagtgaagcacttcctaaacatcacggacccccgcactgtctttgtatctgagcgggagctggactgggccaaggtgatggtggagaagagcaggatgggggttgtgcccccaggcacccaagtggagcagctgctgtatgccaagaagctgtatgactcggccttccaccccgacactggggagaagatgaatgtcatcgggcgcatgtctttccagcttcctggcggcatgatcatcacgggcttcatgctccagttctacaggacgatgccggcggtgatcttctggcagtgggtgaaccagtccttcaatgccttagtcaactacaccaacaggaatgcggcttcccccacatcagtcagaaagcgccgcccttggtgggccgctgggtgccctttgccgctgtggctgcggctaactgtgtcaatatccccatgatgcgacagcatcttgctgccagtcatcatggaaaggcttgagaaattgcacttcatgcagaaagtcaaggtcctgcacgccccattgcaggtcatgctgagcgggtgcttcctcatcttcatggtgccagtggcgtgtgggcttttcccacagaaatgtgaattgccagtttcctatctggaaccgaagctccaagacactatcaaggccaagtatggagaacttgagccttatgtctacttcaataagggtctctaaatgccccacttcagcaaggaccagtctattcccatattcaccagctcctccttagctacgtgcacacttgtgtcctccttcccctttgccaacaaggcctgaaggccagggtagattggggggtgggacaatgaatgcctcatacttacaccctggtactggttgattggacctcaggggaaaaaagtgaaaaagggtagcaaaggccaatgtcttctagctgcttcctcaacccctgtcccctggagaccagaagctgaggccctctcagggaggagacatccaagcaaatcatttggaaaagttaggaaacctttaggattctggttccagccagggttgaggaaaagaccttggatcaaaaggaagcttctatacctctttcttcttcgcttcctcctctcccaagcaatggaaacttttacccatgtaattctagctgaactcaggaaaaagaagggggaaaggactctgtccccttggggctcatcacccttccacatcctcctcctcgttgccccctggtcaggcagcttcttttttttttttttcaagatggagtcttgctctgtcgcccaggctggaatgcagtggcgcgatctcggctcactgcaaactctgcctcctggattcaagcgattctcctgcctcagcctctcaagtagctgggattacagggcacctgccaccacgcctggctaatttttgtattttagtggagacggggtttcaccatgctggccagactggtctcgaactcctgacctcaggtgatccgcccgcctcagcctctgaaattgctgggattacaggcatgagccaccacacccagcccggacagcttctttgggagtgctgctaaccttgaaattatcagacacttaggagttattagtgctaaaaaggggaccgtgcaaggcagcagagttacatggttcttcaaatcatgtctgaacctattcttggaatcttctctataataagggaagttctcttaccccactgccacatacctctgttttaaaagataagtccactaactgtgagtaaaaatgatatatataggcattaaccacacactttaatgggtataatttcctggctgcctcccttcctcagcccattaggttaaacaccaaagaaagactggtgtgtactgaataggaaagggaagttttatttggaaccttctaagaggaaatcaaccaggaccaaagagccttaaaggacacacagcaatgcacagccacttcccttccccagcttggctgccctaggtgatttctcaagctccttgggggactgttgtttctcatctggaatcaatgtgtgtatgagttttgtctggtaggattgctgactctgtccaacagatatcactgtgaattgaataaatttgttgaaagagcacacaggcacacatacac

SEQ ID NO: 181448 - DNA, 574 bp, Homo sapiens
  Payload ID: 15737
  Gene Symbol: SFXN2
  Gene Name: sideroflexin 2
  ENST ID: ENST00000602670
  CDS Start-End: 168-371
ttttcaaggcgggctgtaactggtggcatttgtcccgggaccaggctggagtgcaacggtgcgatctcggctcatcacaacctccacctctcgggttcaaacgattctcctgccttagcctcccaagtagctgggattacaggtccacagttttatgtgtgagcaagatggaggctgacctgtctggctttaacatcgatgccccccgttgggaccagcgcaccttcctggggagagtgaagcacttcctaaacatcacggacccccgcactgtctttgtatctgagcgggagctggactgggccaaggatgggggttgtgcccccaggcacccaagtggagcagctgctgtatgccaagaagctgtatgactcggccttccaccccgacactggggagaagatgaatgtcatcgggcgcatgtctttccagcttcctggcggcatgatcatcacgggcttcatgctccagttctacagctattgagctgggctttgggccgggtgttgggaatgtgaaggcttcagtaacctcccgtcaaggagctcccagttttgttgaggagaccaagaag

SEQ ID NO: 181449 - DNA, 642 bp, Homo sapiens
  Payload ID: 15737
  Gene Symbol: SFXN2
  Gene Name: sideroflexin 2
  ENST ID: ENST00000602868
  CDS Start-End: 138-642
acgatgcccagtagctggtgagagcaggcagtctgcaacagtgggacgtgctcaggtcctctgtggtgggctttgatttaggggacagtcatcttcttcctttgtcccttaggtccacagttttatgtgtgagcaagatggaggctgacctgtctggctttaacatcgatgccccccgttgggaccagcgcaccttcctggggagagtgaagcacttcctaaacatcacggacccccgcactgtctttgtatctgagcgggagctggactgggccaaggtgatggtggagaagagcaggatgggggttgtgcccccaggcacccaagtggagcagctgctgtatgccaagaagctgtatgactcggccttccaccccgacactggggagaagatgaatgtcatcgggcgcatgtctttccagcttcctggcggcatgatcatcacgggcttcatgctccagttctacaggacgatgccggcggtgatcttctggcagtgggtgaaccagtccttcaatgccttagtcaactacaccaacaggaatgcggcttcccccacatcagtcaggcagatggccctttcctacttcacagccacaaccactgctgtggccacggctgtgggcatgaacatgttgacaa

SEQ ID NO: 181450 - DNA, 583 bp, Homo sapiens
  Payload ID: 15737
  Gene Symbol: SFXN2
  Gene Name: sideroflexin 2
  ENST ID: ENST00000602647
  CDS Start-End: 527-583
cagttttcaaggcgggctgtaactggtggcatttgtcccgggaccaggtaaggggccttgggacaatggcgctcgccctgtctacctccaatccccacatctcgggtgggtgctgagattgctgtcctgactgcccaggcggggctgcagcgcgggctggacttccacctgcagaagccacgtggcgcgaagtgcgccctggggctgcagatgggcccctctgctctgacccccattgcctaggagtgccaggccgagcggctggggcgttacgagctgtccgggatgggggagtaccgatggggggaggccgtctgtcggagggcaagaagcagcctgggggctggccctgagccctgaggctggagtgcaacggtgcgatctcggctcatcacaacctccacctctcgggttcaaacgattctcctgccttagcctcccaagtagctgggattacaggcaggttctaagtttgacttaaaagaggtgacatccttgatgccaagagacccaagaagaagttggaatgcatttcaggtccacagttttatgtgtgagcaagatggaggctgacctgtctggc

SEQ ID NO: 181451 - DNA, 2315 bp, Homo sapiens
  Payload ID: 15737
  Gene Symbol: SFXN2
  Gene Name: sideroflexin 2
  ENST ID: ENST00000480358
  CDS Start-End: 204-665
acccgggccagttttcaaggcgggctgtaactggtggcatttgtcccgggaccagatggagtttcactcttattgcccaggctggagtgcaacggtgcgatctcggctcatcacaacctccacctctcgggttcaaacgattctcctgccttagcctcccaagtagctgggattacaggtccacagttttatgtgtgagcaagatggaggctgacctgtctggctttaacatcgatgccccccgttgggaccagcgcaccttcctggggagagtgaagcacttcctaaacatcacggacccccgcactgtctttgtatctgagcgggagctggactgggccaaggtgatggtggagaagagcaggatgggggttgtgcccccaggcacccaagtggagcagctgctgtatgccaagaagctgtatgactcggccttccaccccgacactggggagaagatgaatgtcatcgggcgcatgtctttccagcttcctggcggcatgatcatcacgggcttcatgctccagttctacaggacgatgccggcggtgatcttctggcagtgggtgaaccagtccttcaatgccttagtcaactacaccaacaggaatgcggcttcccccacatcagtcagtcttgctgccagtcatcatggaaaggcttgagaaattgcacttcatgcagaaagtcaaggtcctgcacgccccattgcaggtcatgctgagcgggtgcttcctcatcttcatggtgccagtggcgtgtgggcttttcccacagaaatgtgaattgccagtttcctatctggaaccgaagctccaagacactatcaaggccaagtatggagaacttgagccttatgtctacttcaataagggtctctaaatgccccacttcagcaaggaccagtctattcccatattcaccagctcctccttagctacgtgcacacttgtgtcctccttcccctttgccaacaaggcctgaaggccagggtagattggggggtgggacaatgaatgcctcatacttacaccctggtactggttgattggacctcaggggaaaaaagtgaaaaagggtagcaaaggccaatgtcttctagctgcttcctcaacccctgtcccctggagaccagaagctgaggccctctcagggaggagacatccaagcaaatcatttggaaaagttaggaaacctttaggattctggttccagccagggttgaggaaaagaccttggatcaaaaggaagcttctatacctctttcttcttcgcttcctcctctcccaagcaatggaaacttttacccatgtaattctagctgaactcaggaaaaagaagggggaaaggactctgtccccttggggctcatcacccttccacatcctcctcctcgttgccccctggtcaggcagcttcttttttttttttttcaagatggagtcttgctctgtcgcccaggctggaatgcagtggcgcgatctcggctcactgcaaactctgcctcctggattcaagcgattctcctgcctcagcctctcaagtagctgggattacagggcacctgccaccacgcctggctaatttttgtattttagtggagacggggtttcaccatgctggccagactggtctcgaactcctgacctcaggtgatccgcccgcctcagcctctgaaattgctgggattacaggcatgagccaccacacccagcccggacagcttctttgggagtgctgctaaccttgaaattatcagacacttaggagttattagtgctaaaaaggggaccgtgcaaggcagcagagttacatggttcttcaaatcatgtctgaacctattcttggaatcttctctataataagggaagttctcttaccccactgccacatacctctgttttaaaagataagtccactaactgtgagtaaaaatgatatatataggcattaaccacacactttaatgggtataatttcctggctgcctcccttcctcagcccattaggttaaacaccaaagaaagactggtgtgtactgaataggaaagggaagttttatttggaaccttctaagaggaaatcaaccaggaccaaagagccttaaaggacacacagcaatgcacagccacttcccttccccagcttggctgccctaggtgatttctcaagctccttgggggactgttgtttctcatctggaatcaatgtgtgtatgagttttgtctggtaggattgctgactctgtccaacagatatcactgtgaattgaataaatttgttgaaagagcacacaggcacacatacacacaaac

SEQ ID NO: 181452 - DNA, 582 bp, Homo sapiens
  Payload ID: 15737
  Gene Symbol: SFXN2
  Gene Name: sideroflexin 2
  ENST ID: ENST00000602764
  CDS Start-End: 178-582
agttttcaaggcgggctgtaactggtggcatttgtcccgggaccagagacggagtttcgccatgttgcccaggctgggctcgaactcctggggtcaagccatccgcccgcctaggcctcccaaagtgctgagactacaggtgttccaaagtggtccacagttttatgtgtgagcaagatggaggctgacctgtctggctttaacatcgatgccccccgttgggaccagcgcaccttcctggggagagtgaagcacttcctaaacatcacggacccccgcactgtctttgtatctgagcgggagctggactgggccaaggtgatggtggagaagagcaggatgggggttgtgcccccaggcacccaagtggagcagctgctgtatgccaagaagctgtatgactcggccttccaccccgacactggggagaagatgaatgtcatcgggcgcatgtctttccagcttcctggcggcatgatcatcacgggcttcatgctccagttctacaggacgatgccggcggtgatcttctggcagtgggtgaaccagtccttcaatgccttagtcaactacaccaacagg

SEQ ID NO: 181453 - DNA, 770 bp, Homo sapiens
  Payload ID: 15737
  Gene Symbol: SFXN2
  Gene Name: sideroflexin 2
  ENST ID: ENST00000602831
  CDS Start-End: 268-770
ctggcgggagcctcccggcctgggattggtcgaaaaggaggggcgtggggcgggcgtgggggcagttccccagcccaggtcctcctctcacccgggccagttttcaaggcgggctgtaactggtggcatttgtcccgggaccaggctggagtgcaacggtgcgatctcggctcatcacaacctccacctctcgggttcaaacgattctcctgccttagcctcccaagtagctgggattacaggtccacagttttatgtgtgagcaagatggaggctgacctgtctggctttaacatcgatgccccccgttgggaccagcgcaccttcctggggagagtgaagcacttcctaaacatcacggacccccgcactgtctttgtatctgagcgggagctggactgggccaaggtgatggtggagaagagcaggatgggggttgtgcccccaggcacccaagtggagcagctgctgtatgccaagaagctgtatgactcggccttccaccccgacactggggagaagatgaatgtcatcgggcgcatgtctttccagcttcctggcggcatgatcatcacgggcttcatgctccagttctacaggacgatgccggcggtgatcttctggcagtgggtgaaccagtccttcaatgccttagtcaactacaccaacaggaatgcggcttcccccacatcagtcaggcagatggccctttcctacttcacagccacaaccactgctgtggccacggctgtgggcatgaacatgttgac

SEQ ID NO: 181454 - DNA, 554 bp, Homo sapiens
  Payload ID: 15737
  Gene Symbol: SFXN2
  Gene Name: sideroflexin 2
  ENST ID: ENST00000602439
  CDS Start-End: 141-554
agttttcaaggcgggctgtaactggtggcatttgtcccgggaccagcttgctctaggcagccttgaccttaatccttgcctgtctcagtggtctttgtgtctgaccttctggggtctttggctaccttgatcttcctctgatgtccacagttttatgtgtgagcaagatggaggctgacctgtctggctttaacatcgatgccccccgttgggaccagcgcaccttcctggggagagtgaagcacttcctaaacatcacggacccccgcactgtctttgtatctgagcgggagctggactgggccaaggtgatggtggagaagagcaggatgggggttgtgcccccaggcacccaagtggagcagctgctgtatgccaagaagctgtatgactcggccttccaccccgacactggggagaagatgaatgtcatcgggcgcatgtctttccagcttcctggcggcatgatcatcacgggcttcatgctccagttctacaggacgatgccggcggtgatcttctggcagtgggtgaaccagtccttcaatgcctta

SEQ ID NO: 181455 - DNA, 3089 bp, Homo sapiens
  Payload ID: 15738
  Gene Symbol: SFXN3
  Gene Name: sideroflexin 3
  Uniprot ID: Q9BWM7
  ENST ID: ENST00000224807
  CDS Start-End: 457-1434
ggcacctcccttaggcgccagggacagccgagcgttacctggtcccgggcagcggagttctttacccaccccagttctggttctgacgccctagctcattccgcaaatttagggcttgggtctggcttgttcccctccggctcgaaccacctcttctctgagccgagccagctaccggggctcctggaattgccacccctccctgggcacccttgaggcctccgtggagggacgtcacggggcagagcgggacgtgagcctgagtttgctgcaggcgtgctctgtgtggtggctgggttctgccaatccccgtgcccaccgggtgggcgcggccgggaagctcctgcccctccctgctggtcggcgtcacgcgtgacgtcccgcgtgatggctgggagggcccggcggcgacagcggaggcagagaggaaggcggttctgagagcttcagagagcgatggaaagcaaaatgggtgaattgcctttagacatcaacatccaggaacctcgctgggaccaaagtactttcctgggcagagcccggcactttttcactgttactgatcctcgaaatctgctgctgtccggggcacagctggaagcttctcggaacatcgtgcagaactacagggccggcgtggtgaccccagggatcaccgaggaccagctgtggagggccaagtatgtgtatgactccgccttccatccggacacaggggagaaggtggtcctgattggccgcatgtcagcccaggtgcccatgaacatgaccatcactggctgcatgctcacattctacaggaagaccccaaccgtggtgttctggcagtgggtgaatcagtccttcaatgccattgttaactactccaaccgcagtggtgacactcccatcactgtgaggcagctggggacagcctatgtgagtgccaccactggagctgtggccacggccctgggactcaaatccctcaccaagcacctgccccccttggtcggcagatttgtgccctttgcagcagtggcagctgccaactgcatcaacatccccctgatgaggcagagagagctgcaggtgggcatcccggtggctgatgaggcaggtcagaggcttggctactcggtgactgcagccaagcagggaatcttccaggtggtgatttcaagaatctgcatggcgattcctgccatggccatcccaccactgatcatggacactctggagaagaaagacttcctgaagcgccgcccctggctgggggcacccctgcaggtgggactggtgggcttctgcctggtatttgcaacccccctgtgctgtgccctattcccccagaagagctccatacacataagcaacctggaaccagagctgagagctcagatccatgagcaaaaccccagcgttgaagtggtctactacaacaaggggctttgaggagggtcagcctctgtcccctccctcacttccttgggctgctgctttagtggagtcatgtcacccctaccacttggctatctgcctagcactgggcaggggccttggtgggcagatggcaattgagggtagcaacctattagggtgggggagggacctccataaggcttttcctcccttctctggtttcaaagatcagagcacataacccctcctgtgcttgagtgtccatgcatatacatacatgatacacatgtgtatgtgtacattgggtcctgaaagctagaagcaggcatgctagcctagtatgttctgacatctggcttcccttctcagcctcatgtccacctgcctgccagccaggctacaggtgtgacttccttctctaaactgttacaccagccaagttatttttgatggcacctcatcccttctagaaataggaggagccccaggatctcaggacagagacttatagacactagtaggacaaagcgggctgaatccttcaggtttctgatacctagctccccaagctgactgggctggcagaggagaacatgttgagacaagggaggcaggggacttatgcatccctcagtgccatcccttgtatcctggaatagctccatttcccctcctcctctctaccagacaaaggagtgcctgtgtcctgtactgccctcgctgtctcccccaccaccctacttgacagcgtgggcatcttcaggcacagccttgggagttcctggtgtgctctgacatcatgacctcaaatctaaatcctccaatcccaactccctttcccaaacaaaaagccacagaggcagagcaagcattcccctttaagagcttccactgcaccccctcccaagggacacagcggtaggaatggtgcttaaactccacaggtatcagagagggtgtaactaggacatcctcaagggcagctaggccccgaatgtacaatgttaagacagggaattttgtgttccattgacttttttttttttttttaatggagtttcactattttgcccaggctggagtgcgatggtgcgatcttggctcactgcaacctctgcctcctgggttcaagtgattctcttgcctcagtctcccgagtagtggaaattacaggtgtgtgctaccacatcttgctagttttgtatttttagcagagatgggggtttcaccatgttggccaggctagtctcgaactcctgacctcaggtgatccacctgccttggcctcccaaagcactgggattacaagcatgagccactgtgcccagcctgttccactgacatttcttagacattcagcaaaacccccaccttaacctcttttctttcttgagggttggtcctgtccccacctccaccctcccaccccctggaagaggaagggcccgggcatcagtggctagtccaaataaaatatgggcttggggatggaatgggtggtggtaagttcacagagtgtagttagatcccaactcccatgacctctggcttcagtggtgggtggggcagggcagatgaaagggcttcagtgggaacctctgagagcattttcctgttccccctatcaaccgcccccagtgataacatctgtgaagccagccattactcaataaactgcaaacttgtct

SEQ ID NO: 181456 - DNA, 3098 bp, Homo sapiens
  Payload ID: 15738
  Gene Symbol: SFXN3
  Gene Name: sideroflexin 3
  ENST ID: ENST00000393459
  CDS Start-End: 474-1439
attccggcacctcccttaggcgccagggacagccgagcgttacctggtcccgggcagcggagttctttacccaccccagttctggttctgacgccctagctcattccgcaaatttagggcttgggtctggcttgttcccctccggctcgaaccacctcttctctgagccgagccagctaccggggctcctggaattgccacccctccctgggcacccttgaggcctccgtggagggacgtcacggggcagagcgggacgtgagcctgagtttgctgcaggcgtgctctgtgtggtggctgggttctgccaatccccgtgcccaccgggtgggcgcggccgggaagctcctgcccctccctgctggtcggcgtcacgcgtgacgtcccgcgtgatggctgggagggcccggcggcgacagcggaggcagagaggaaggcggttctgagagcttcagagagcgatggaaagcaaaatgggtgaattgcctttagacatcaacatccaggaacctcgctgggaccaaagtactttcctgggcagagcccggcactttttcactgttactgatcctcgaaatctgctgctgtccggggcacagctggaagcttctcggaacatcgtgcagaactacagggccggcgtggtgaccccagggatcaccgaggaccagctgtggagggccaagtatgtgtatgactccgccttccatccggacacaggggagaaggtggtcctgattggccgcatgtcagcccaggtgcccatgaacatgaccatcactggctgcatgctcacattctacaggaagaccccaaccgtggtgttctggcagtgggtgaatcagtccttcaatgccattgttaactactccaaccgcagtggtgacactcccatcactgtgaggcagctggggacagcctatgtgagtgccaccactggagctgtggccacggccctgggactcaaatccctcaccaagcacctgccccccttggtcggcagatttgtgccctttgcagcagtggcagctgccaactgcatcaacatccccctgatgaggcagagagagctgcaggtgggcatcccggtggctgatgaggcaggtcagaggcttggctactcggtgactgcagccaagcagggaatcttccaggtggtgatttcaagaatctgcatggcgattcctgccatggccatcccaccactgatcatggacactctggagaagaaagacttcctgaagcgccgcccctggctgggggcacccctgcaggtgggactggtgggcttctgcctggtatttgcaacccccctgtgctgtgccctattcccccagaagagctccatacacataagcaacctggaaccagagctgagagctcagatccatgagcaaaaccccagcgttgaagtggtctactacaacaaggggctttgaggagggtcagcctctgtcccctccctcacttccttgggctgctgctttagtggagtcatgtcacccctaccacttggctatctgcctagcactgggcaggggccttggtgggcagatggcaattgagggtagcaacctattagggtgggggagggacctccataaggcttttcctcccttctctggtttcaaagatcagagcacataacccctcctgtgcttgagtgtccatgcatatacatacatgatacacatgtgtatgtgtacattgggtcctgaaagctagaagcaggcatgctagcctagtatgttctgacatctggcttcccttctcagcctcatgtccacctgcctgccagccaggctacaggtgtgacttccttctctaaactgttacaccagccaagttatttttgatggcacctcatcccttctagaaataggaggagccccaggatctcaggacagagacttatagacactagtaggacaaagcgggctgaatccttcaggtttctgatacctagctccccaagctgactgggctggcagaggagaacatgttgagacaagggaggcaggggacttatgcatccctcagtgccatcccttgtatcctggaatagctccatttcccctcctcctctctaccagacaaaggagtgcctgtgtcctgtactgccctcgctgtctcccccaccaccctacttgacagcgtgggcatcttcaggcacagccttgggagttcctggtgtgctctgacatcatgacctcaaatctaaatcctccaatcccaactccctttcccaaacaaaaagccacagaggcagagcaagcattcccctttaagagcttccactgcaccccctcccaagggacacagcggtaggaatggtgcttaaactccacaggtatcagagagggtgtaactaggacatcctcaagggcagctaggccccgaatgtacaatgttaagacagggaattttgtgttccattgacttttttttttttttttaatggagtttcactattttgcccaggctggagtgcgatggtgcgatcttggctcactgcaacctctgcctcctgggttcaagtgattctcttgcctcagtctcccgagtagtggaaattacaggtgtgtgctaccacatcttgctagttttgtatttttagcagagatgggggtttcaccatgttggccaggctagtctcgaactcctgacctcaggtgatccacctgccttggcctcccaaagcactgggattacaagcatgagccactgtgcccagcctgttccactgacatttcttagacattcagcaaaacccccaccttaacctcttttctttcttgagggttggtcctgtccccacctccaccctcccaccccctggaagaggaagggcccgggcatcagtggctagtccaaataaaatatgggcttggggatggaatgggtggtggtaagttcacagagtgtagttagatcccaactcccatgacctctggcttcagtggtgggtggggcagggcagatgaaagggcttcagtgggaacctctgagagcattttcctgttccccctatcaaccgcccccagtgataacatctgtgaagccagccattactcaataaactgcaaacttgtctactt

SEQ ID NO: 181457 - DNA, 744 bp, Homo sapiens
  Payload ID: 15738
  Gene Symbol: SFXN3
  Gene Name: sideroflexin 3
  ENST ID: ENST00000489434
  CDS Start-End: 4-537
aaaatgggtgaattgcctttagacatcaacatccaggaacctcgctgggaccaaagtactttcctgggcagagcccggcactttttcactgttactgatcctcgaaatctgctgctgtccggggcacagctggaagcttctcggaacatcgtgcagaactacagggccggcgtggtgaccccagggatcaccgaggaccagctgtggagggccaagtatgtgtatgactccgccttccatccggacacaggggagaaggtggtcctgattggccgcatgtcagcccaggtgcccatgaacatgaccatcactggctgcatgctcacattctacaggaagaccccaaccgtggtgttctggcagtgggtgaatcagtccttcaatgccattgttaactactccaaccgcagtggtgacactcccatcactgtgaggcagctggggacagcctatgtgagtgccaccactggagctgtggccacggccctgggactcaaatccctcaccaagagtccctcaccaccccatggcccttagggccactgaacaacacccttcctccccagcacctgccccccttggtcggcagatttgtgccctttgcagcagtggcagctgccaactgcatcaacatccccctgatgaggcagagagagctgcaggtgggcatcccggtggctgatgaggcaggtcagaggcttggctactcggtgactgcagccaagcagggaatcttccaggtgg

SEQ ID NO: 181458 - DNA, 1363 bp, Homo sapiens
  Payload ID: 15739
  Gene Symbol: SFXN4
  Gene Name: sideroflexin 4
  Uniprot ID: Q6P4A7
  ENST ID: ENST00000355697
  CDS Start-End: 21-1034
gccactctaaccagcgcaaaatgtccctggaacaggaggaggaaacgcaacctgggcggctcctaggacgcagagacgccgtccccgccttcattgagcccaacgtgcgcttctggatcaccgagcgccaatcctttattcgacgatttcttcaatggacagaattattagatcctacaaatgtgttcatttcagttgaaagtatagaaaactcgaggcaactattgtgcacaaatgaagatgtttccagccctgcctcggcggaccaaaggatacaagaagcttggaagcggagtcttgcaacagtgcatcccgacagcagcaacctgatccccaagctttttcgacctgcagcgttcctgcctttcatggcacccacggtatttttgtcaatgacgccactgaaagggatcaagtccgtgattttacctcaggttttcctctgtgcctacatggcagcgttcaacagcatcaatggaaacagaagttacacttgtaagccactagaaagatcattactaatggcgggagccgttgcttcttcaactttcttaggagtaatccctcagtttgtccagatgaagtatggcctgactggcccttggattaaaagactcttacctgtgatcttcctcgtgcaagccagtggaatgaatgtctacatgtcccgaagtcttgaatccattaaggggattgcggtcatggacaaggaaggcaatgtcctgggtcattccagaattgctgggacaaaggctgttagagaaacgctagcatccagaatagtgctgtttgggacctcagctctgattcctgaagtcttcacctacttttttaaaaggacccagtatttcaggaaaaacccagggtcattgtggattttgaaactgtcttgtactgtcctggcaatgggactgatggtgccattttcttttagtatatttccacagattggacagatacagtactgtagtcttgaagagaaaattcagtctccaacagaagaaacagaaatcttttatcacagaggggtgtaggcgtgagttttaggtgaatttatgtggttcctgcttgaaaaccttcccctctccaggttcggtttagagaactttgccacaggtcttctggggaccccagaggtgtctgtgctgacaaggcgacttcagattccatactgagatcgttcccaggctggcgtctctggggtttttaaggctggctggagaagacagtgggagggtgccccgtctgacacccctggggttgctgagggaacggttggagtggggatcggcctgcgaaaggatactgtgaaatcactaattaactaataaacctgtctcaagttgaggatttgaagaaagaa

SEQ ID NO: 181459 - DNA, 1133 bp, Homo sapiens
  Payload ID: 15739
  Gene Symbol: SFXN4
  Gene Name: sideroflexin 4
  ENST ID: ENST00000369131
  CDS Start-End: 600-1133
gtgcgcttctggatcaccgagcgccaagtacggcccgggcccggcgcgactaggggcagggagggggcgggccgggccgcgtggagtcgggctgacccgggtgaccttggccaggccacgtgggcgccccctgtctccgtttcctcctctcggagttgtgccgggaacgcgcaccaccggccttcaccccttagggcgcggcaggggacgcaggggaaatcgaagctgccagatgcccacgaccacaacgtcaccctccagattgccctctcggaggggcccagtccgcgcaggtggctgctccctactgcctgagctgtggctgagcagcagattggggagaaacaggctctcgcaccttgtcctttattcgacgatttcttcaatggacagaattattagatcctacaaatgtgttcatttcagttgaaagtatagaaaactcgaggcaactattgtgcacaaatgaagatgtttccagccctgcctcggcggaccaaaggatacaagaagcttggaagcggagtcttgcaacagtgcatcccgacagcagcaacctgatccccaagctttttcgacctgcagcgttcctgcctttcatggcacccacggtatttttgtcaatgacgccactgaaagggatcaagtccgtgattttacctcaggttttcctctgtgcctacatggcagcgttcaacagcatcaatggaaacagaagttacacttgtaagccactagaaagatcattactaatggcgggagccgttgcttcttcaactttcttaggagtaatccctcagtttgtccagatgaagtatggcctgactggcccttggattaaaagactcttacctgtgatcttcctcgtgcaagccagtggaatgaatgtctacatgtcccgaagtcttgaatccattaaggggattgcggtcatggacaaggaaggcaatgtcctgggtcattccagaattgctgggacaaaggctgttagagaaacgctagcatccagaatagtgctgtttgggacctcagctctgattcctgaagtcttcacctacttttttaaaaggacccagtatttcaggaaaaacccagggtcattgtggattttgaaactgtcttgtactgtcctg

SEQ ID NO: 181460 - DNA, 739 bp, Homo sapiens
  Payload ID: 15739
  Gene Symbol: SFXN4
  Gene Name: sideroflexin 4
  ENST ID: ENST00000419372
  CDS Start-End: 552-739
cgccaagtacggcccgggcccggcgcgactaggggcagggagggggcgggccgggccgcgtggagtcgggctgacccgggtgaccttggccaggccacgtgggcgccccctgtctccgtttcctcctctcggagttgtgccgggaacgcgcaccaccggccttcaccccttagggcgcggcaggggacgcaggggaaatcgaagctgccagatgcccacgaccacaacgtcaccctccagattgccctctcggaggggcccagtccgcgcaggtggctgctccctactgcctgagctgtggctgagcagcagattggggagaaacaggctctcgcaccttgtcctttattcgacgatttcttcaatggacagaattattagatcctacaaatgtgttcatttcagttgaaagtatagaaaactcgaggcaactattgtgcacaaatgaagatgtttccagccctgcctcggcggaccaaagggcaacagtgcatcccgacagcagcaacctgatccccaagctttttcgacctgcagcgttcctgcctttcatggcacccacggtatttttgtcaatgacgccactgaaagggatcaagtccgtgattttacctcaggttttcctctgtgcctacatggcagcgttcaacagcatcaatggaaacagaagttacacttgtaagccactagaaagatcattactaatggcgggagccgttgcttcttcaactttcttagg

SEQ ID NO: 181461 - DNA, 4140 bp, Homo sapiens
  Payload ID: 15740
  Gene Symbol: SFXN5
  Gene Name: sideroflexin 5
  Uniprot ID: Q8TD22
  ENST ID: ENST00000272433
  CDS Start-End: 132-1154
aactacactccccacaacgccttgcgcctcccgctcgctgcggttgattagggccaatcgggagaggcagctgtggcgggggccgaggagggacattttaaaagggccggagattgcgggcgtcagtggccatggcggatacagcgactacagcatcggcggcggcggctagtgccgctagcgcctcgagcgatgcacctcctttccaactgggcaaaccccgcttccagcagacgtccttctatggccgcttcaggcacttcttggatatcatcgaccctcgcacactctttgtcactgagagacgtctcagagaggctgtgcagctgctggaggactataagcatgggaccctgcgcccgggggtcaccaatgaacagctctggagtgcacagaaaatcaagcaggctattctacatccggacaccaatgagaagatcttcatgccatttagaatgtcaggttatattccttttgggacgccaattgtagtcggtcttctcttgcccaaccagacactggcatccactgtcttctggcagtggctgaaccagagccacaatgcctgtgtcaactatgcaaaccgcaatgcgaccaagccttcacctgcatccaagttcatccagggatacctgggagctgtcatcagcgccgtctccattgctgtgggccttaatgtcctggttcagaaagccaacaagttcaccccagccacccgccttctcatccagaggtttgtgccgttccctgctgtagccagtgccaatatctgcaatgtggtcctgatgcggtacggggagctggaggaagggattgatgtcctggacagcgatggcaacctcgtgggctcctccaagatcgcagcccgacacgccctgctggagacggcgctgacgcgagtggtcctgcccatgcccatcctggtgctacccccgatcgtcatgtccatgctggagaagacggctctcctgcaggcacgcccccggctgctcctccctgtgcaaagcctcgtgtgcctggcagccttcggcctggccctgccgctggccatcagcctcttcccgcaaatgtcagagattgaaacatcccaattagagccggagatagcccaggccacgagcagccggacagtggtgtacaacaaggggttgtgagtgtggtcagcggcctggggacggagcactgtgcagccggggagctgaggggcagggccgtagactcacggctgcacctgcagggagcagcacgccaaccccagcagtcctgggccccctgggagagtgctcaacctacagtggagggagactgacccattcacattttaacataggcaagaggagttctaacacatttcgtacaaaaaaataatcaagtgcatttctgggccttatgtggggttgtcaaaactccactcagcacaattatgtgtgaagctgaaaaattgtagagtgcccatggggtagaagtagaatccttttatactttggttccttttttatttttattttttatcagaatcaaatctgagccttagtttcagctgaccagaagtggcaggaggacaggtggaggcgagccagattaggcctggagttgggctggtttggtggccaggctggtaaatttaggatattacaatggccagcccagatggctccctgggctggcatggggaggggagagaaggtggtctgcaccccacaggatgaactagccatgactagggtcctcaggcagtggcccagggaatcagggagcactggaggcctctgcaagattctgtgggcagctggctctgaatgtagccagcccacatccattccagagctgcagaaccagtccctctgagtgaagtccagtgaccctggagctagggtcccccttcgtggagctctaactgattcagggcccctgaagtgaccccagctccaggcaggaaaccccgagaaggaatggtgcttggcaggaaccatggacctgcacttggcctcttcgggaagatcctccttccaggccccaggctggatgctgggttctggggctgagagtggggctagactgggctggctgccttctgcggagcttctccagccaccaaggctgcctgccccatcccatccctttctaagcaggaaggtctcatgcctgagaatgcctaggccagctccttagacacctatcagagaagcagcatcaacctaggagcagtgggccctggctctgtcactaaatggcagtgagatgtcagacaaattcattcccttctctcagcctccactccctgtctgaaaccagaagactggatcaaggggttcccactggctcctccagcaagacctcgtctttgcttgtcctgctcagatgctggtcatcctgggcatgtccccagtgtggactctggactgggaagggggcaggcccctttggacctgcagttggcctcagcagaaggccttgccttgtgtatgtgactccatatcccgggagcagttgacctttgccaaacactttacagttctggaggaggaggtaacatagatgcctgggcctgatggtggggccatacccatgtgtcgcctctcactctggcagcctcagaggccccttgctgctggctcccatctccctcccatttgcagaccaggaaggaagagcaagctgtacaaagggaagcagagcctggggtgggtgtgagcagggtgacccctcatctgaaaggcccaaaccagggggaagcaccagcctcagtgcagccccctcctgaccccacctagaatggaagcctccacctgcagccccaggcctccctcccccggggtctccacctcaggggagacttaggccagaggtgaacattcatgtgtaggaagaggccgctgcagggtggcatcttagggtaggggaagtgtgctgaggtgggccttccatgggcatggccgttgcctctctgccagccgctggtgcccaccagctggctctgcagcacattgccctgaggggcctgccactctcctgaggagcagcccacctgctgcccgtgaggagggggagaagggttagacaagcctggaggacaaaacagcgggagtgtgggggtgccatggtgttggaggggcaggcctttttgagccaatcccaccataatgtgaatatgccagtgactgctgcgctgtgctggtctctaggcctgaactaggtgctggcatgtctgggtcgtcttttgaaaagctcacttcaagctcaccctgctcctacctatcataaggtcttattcttgtgcactttatcttgggaccaaaactgcctacccaccccttcccgccctccccctgccagaggcctggtgccctggcccagcctgtggcctcagcatctcataactcatttgctttgtctcccggatgatttccgtcatgctcccaaatgcagcttcaggtgagccaaggggtctgctcctgtggcggtgcagtggcaaaggatccagatagcctagggtgagggtgacagagggacagtgggctatgccactaggccctggtctggctttggaaagacctgtgaggggaaaccttcacccagcacccatgccccactctgctgaggccagaggaagggaggcctgaggggcagattggttcatgcctggggtggaggctaagcctggacacagtcagggcggggctggccagctgtgcgagaacacaagccacgcctgcgatggtgctgcacccctggtgtccctgcctggccctcctctggtcacttcaaacatgccctcaggcttggggatgcccttcttccattcccagacagcagtgtgagggtgcagggaccaagatgtcaagctggccgtggagtcgagctggccgacggacccctttcacctggttatgagccgacttctttggtgttctggcctctggcctgggaaaagggcaggagcctagaggaggaaaaaggctggtggacagacccagggtggtcttcaagcctggcccagtgagagtgaggcccccgcacgcaagcctcagccactcccaggggcctttgcagcgtctttttaacctcagaaaatttctcaatctatgtgatttgtgtaatactaatgagctttgggcaataaatacgggatttaaagca

SEQ ID NO: 181462 - DNA, 840 bp, Homo sapiens
  Payload ID: 15740
  Gene Symbol: SFXN5
  Gene Name: sideroflexin 5
  ENST ID: ENST00000410065
  CDS Start-End: 20-781
attgcgggcgtcagtggccatggcggatacagcgactacagcatcggcggcggcggctagtgccgctagcgcctcgagcgatgcacctcctttccaactgggcaaaccccgcttccagcagacgtccttctatggccgcttcaggcacttcttggatatcatcgaccctcgcacactctttgtcactgagagacgtctcagagaggctgtgcagctgctggaggactataagcatgggaccctgcgcccgggggtcaccaatgaacagctctggagtgcacagaaaatcaagcaggctattctacatccggacaccaatgagaagatcttcatgccatttagaatgtcaggttatattccttttgggacgccaattgtagtcggtcttctcttgcccaaccagacactggcatccactgtcttctggcagtggctgaaccagagccacaatgcctgtgtcaactatgcaaaccgcaatgcgaccaagccttcacctgcatccaagttcatccagggatacctgggagctgtcatcagcgccgtctccattgctgtgggccttaatgtcctggttcagaaagccaacaagttcaccccagccacccgccttctcatccagaggtttgtgccgttccctgctgtaggacggctctcctgcaggcacgcccccggctgctcctccctgtgcaaagcctcgtgtgcctggcagccttcggcctggccctgccgctggccatcagcctcttcccgcaaatgtcagagattgaaacatcccaattagagccggagatagcccaggccacgagcagccggacagtggtgtacaacaaggggttgtga

SEQ ID NO: 181463 - DNA, 489 bp, Homo sapiens
  Payload ID: 15740
  Gene Symbol: SFXN5
  Gene Name: sideroflexin 5
  ENST ID: ENST00000442582
  CDS Start-End: 21-489
gattgcgggcgtcagtggccatggcggatacagcgactacagcatcggcggcggcggctagtgccgctagcgcctcgagcgatgcacctcctttccaactgggcaaaccccgcttccagcagacgtccttctatggccgcttcaggcacttcttggatatcatcgaccctcgcacactctttgtcactgagagacgtctcagagaggctgtgcagctgctggaggactataagcatgggaccctgcgcccgggggtcaccaatgaacagctctggagtgcacagaaaatcaagcaggttatattccttttgggacgccaatttcggtcttctcttgcccaaccagacactggcatccactgtcttctgtggctgaaccagagccacaatgcctgtgtcaactatgcaaaccgcaatgcgaccaagccttcacctgcatccaagttcatccagggatacctgggagctgtcatcagcgccgtctccattg

SEQ ID NO: 181464 - DNA, 2975 bp, Homo sapiens
  Payload ID: 15740
  Gene Symbol: SFXN5
  Gene Name: sideroflexin 5
  ENST ID: ENST00000450185
  CDS Start-End: 5-271
ggccatggcggatacagcgactacagcatcggcggcggcggctagtgccgctagcgcctcgagcgatgcacctcctttccaactgggcaaaccccgcttccagcagacgtccttctatggccgcttcaggcacttcttggatatcatcgaccctcgcacactctttgtcactgagatggagtcttgcactgtcccccaggctcactgcaacccctgcctcctgggttcagagacgtctcagagaggctgtgcagctgctggaggactataagcatgggaccctgcgcccgggggtcaccaatgaacagctctggagtgcacagaaaatcaagcaggttatattccttttgggacgccaattgtagtcggtcttctcttgcccaaccagacactggcatccactgtcttctggcagtggctgaaccagagccacaatgcctgtgtcaactatgcaaaccgcaatgcgaccaagccttcacctgcatccaagttcatccagggatacctgggagctgtcatcagcgccgtctccattgctgtgagtactccctcccctgctccttcttggctctgctgctctggggccaccccgctcagcattgcaggtggatgcttgtctgagggccaggccaggcaaggatttgggagacaggtttctgtgggtggaggagtcaggacaggctttccaagccgagaagaggctccagtagacagagcacaacctggtgctccctgtaatggagagcaggtggggaggtgaggttgtgcctgggggcactgaggcaggacatctgtcttgagtggggctgcggttgcccagcactctgctcggaagagctgctcctcatgctcggtaacgtggctggagcgagcggggtggggggatgcctctgaatgactctgcaaggcctgcccatgtgcctgctcccctgagctcttgctcagctgccggggcactgcttttccctctctatggccttactggtgtcacacgtccagctcttcctgaagacctgtcagtgcccgaagccaggggcgttaggctcactctgagtctccacagtactttgaggccagagcagctactcagtaggggaggttcagagactgagcgtgagggtacggcaggtgtggctccctgcttcccagaggaggccaggggcaagtgacacagtcagggccctgggccagagccagagtggacgctcaagctgccaggaccttctgcatgcttgtcccacccctgagcccgcccctgtacctacgtctggctgtctctggatccccactaggatggccttctatagccgactccagagggcgaagggccccttcacaactctgtcatttcatccattacacaatacattaatgtaactggtaagaaaaaaaaaattagaaaatgaaaaccaaacaacattcacatagctgagcacagtggggcacacctgtagtcccagctactcaggaggctgaggtaggaggatcattgagcccaggtgttggagtctgtagtgtgctatgattgcagctgtgaacagccactgcactccaacctgggcaacatagcaagaccccatttaaaaaaacaaaaggccgggtgcagtggctcacgcctgtaatcccaacactttggaaggccaaggcgggaagatcacctgagatcaggagttcaagaccagcctggccaacatggtgaaacccctgtctctactaaaaaaaatacaaaaattagtctgcatggtggtgggcacctgtaatcctagctccttgggaggctgaggcaggagaatcgcttgaacctgggaggcagaagttgcagtgagccgagatcacgccactgcactccagcctgggcgacagagtgagactccatctccagaaaaaaaaaaaataaataaataataaaaaatttaagaaattaaaaaaccccaaaaccattcagctgggcaagctggtgtgcccctgtaatcccagctactcaggaggctgagttgggaggattgcttatggccatgttgggcagcatagcaagatcttatctctaatgaaaaagaaaacattcacatataatgaagaattcacatacaataaccttttggtaaaaccccctttgctcatctttccagtgccattaagtaaatactgtataataactgttcacggctgtataattacccattgtaccatacgccacaatttaattcaccattcttctaaaggagggacttggggttgtcctgaaatggcctcatttatttcactcccacatagaccaagtcatctccaaatagctgtgaagtgggatgtcccatttcatgcccaagatctctttcccaaatccttatgtcttcacaaaagcaagaagtgagacattcaggtggctcaccaagagactgctgacctgccacccagcttgtcctgcagcccagcaggagacttcatttgggagtcagacaaattgggggtccctgatactggggacttggtgggtgaaggccaaaggctcccctgagtgggagaaagaactcttgtcacctcctccttgttccttgtgatgagaggagctgatggtctgcttagcttagcagctcaaaaatccccttcctttttttgagactcaggggcaaggtgagaggaggaggctacatagggaaggatgctgagtggccttgaatggaaaggcctgagtgaaggggatcattgtcctggtggacttccttcacctgcaggcctggggctcagagaacaagaatcagcttctcagcctgagtaacatagcaaaaccccatctctacaaaaaatacaaaaaaaattaggtgtggtggtgcacacctgtagtcccagctacctgggaggctgaggtgggagaatcatttgagcctggaaggtcgaggctgcagtgagccacgattgtgcccctgcactccagactgggcgacagagcaaaaccctgtctcaaaaaaaaaaaaaaa

SEQ ID NO: 181465 - DNA, 915 bp, Homo sapiens
  Payload ID: 15740
  Gene Symbol: SFXN5
  Gene Name: sideroflexin 5
  ENST ID: ENST00000411783
  CDS Start-End: 1-757
ggcggctagtgccgctagcgcctcgagcgatgcacctcctttccaactgggcaaaccccgcttccagcagacgtccttctatggccgcttcaggcacttcttggatatcatcgaccctcgcacactctttgtcactgagagacgtctcagagaggctgtgcagctgctggaggactataagcatgggaccctgcgcccgggggtcaccaatgaacagctctggagtgcacagaaaatcaagcaggctattctacatccggacaccaatgagaagatcttcatgccatttagaatgtcaggttatattccttttgggacgccaattgtagtcggtcttctcttgcccaaccagacactggcatccactgtcttctggcagtggctgaaccagagccacaatgcctgtgtcaactatgcaaaccgcaatgcgaccaagccttcacctgcatccaagttcatccagggatacctgggagctgtcatcagcgccgtctccattgctgtgggccttaatgtcctggttcagaaagccaacaagttcaccccagccacccgccttctcatccagaggtttgtgccgttccctgctgtaggccctgctggagacggcgctgacgcgagtggtcctgcccatgcccatcctggtgctacccccgatcgtcatgtccatgctggagaaattgaaacatcccaattagagccggagatagcccaggccacgagcagccggacagtggtgtacaacaaggggttgtgagtgtggtcagcggcctggggacggagcactgtgcagccggggagctgaggggcagggccgtagactcacggctgcacctgcagggagcagcacgccaaccccagcagtcctgggccccctgggagagtgctcaacctacagtggagggagactgaccc

SEQ ID NO: 181466 - DNA, 1708 bp, Homo sapiens
  Payload ID: 15741
  Gene Symbol: SIGLECL1
  Gene Name: SIGLEC family like 1
  Uniprot ID: Q8N7X8
  ENST ID: ENST00000316401
  CDS Start-End: 382-975
agataatgttaacaatgtgatttagagtggaagcaataccagatagtctaacaatgtgatttagaataggggctttggatcaaatggtatcagctcaacttcaggaggagctggatgctaagatccaccatgagggaagtcaccatgttacacgatggaggcccaataaaaacactggacacaaggcttgggtgaacaggccttcacgatgaccagagacagaagcccctgacttggctaaagatacttctgctctccccatccccacatcctctttcagttacgcatcacctcactccttctgaaccatatggttctgatgtcagagccagtgtagtaaagagcttctgctgttcctgagaactgttgctgctggaagtgatgcttccactgctacagctggtacctgctaagctgctcaactcctcttgctccttggagaagacactgcagtgcagctgttccttccatgggattcccacaccctctgtgcagtggtggatgggaggagtccccgtgggtgtggatggcatggatggcagcctccaagtgacttccaccatgcttggcccctgggctaacagcaccatcagcctaactgaagagccagaaatgggcatgagacttctctgtgaggggaagaaccaaaacggaacccatgctttgagcatcctactgatgtcaagaaagagttctttggctgcccaggccttcgtgaaagggctgatccagggtgctatctatgcgggaattgtaattgcgctgctcttcctctgcctcctccctctcatagtgaaacatatcagaaagaagcaggcgaagaaagctgcagcgatcagagcaaaaaagagctctaaagtcagagcaagccaagaacttgagatgtctctgaagcctgaggaaccaggaaaacccgtagtcgccacattttctgagagccggatattggaaaagcaagataaacgagccagctaagcctgtggaacatgcctcatacctggagtcgccattatccctggaattacaaagatctgcaaaatttatagcgctcacagaaaccctggaggctgtaataaacctggagccccctggactctcctcagctcacaaaaccctctcaattcctacacatcccttaacactcattctccattgaataggtggttactcttagacctagtcttagaacctctgaagacacactttgtaatttgttgtttggctaaatgagaagaaatctgtgccaccctgggaaggtgtcaaaagaaggaaaaatacatgtgacaatatgaatcaagtccatcagcaagttacttttgagcgcctactgtgtgtcagtgcctgagatacacctacaagagcgccaggctttcaagccttcatatctggatagaatcccaacttcagtgcttggtggctgtctatctttggacaagatctttcattccccatcctttgaacatcacatgacccatatctgggtggagaatgggtgaaaagtactgttcagagatgcaggtgagaaaaaacatgacgatgggccctgaatgccaagattcattggagctttggagctttatcttgtaggaccttatcctgactcccttagaatgtaagttccaagagaacagggactttgtctgccttgttttctacttttatcaccagcacccagaatgatgcctaaaatacaataagatctcaagaa

SEQ ID NO: 181467 - DNA, 660 bp, Homo sapiens
  Payload ID: 15741
  Gene Symbol: SIGLECL1
  Gene Name: SIGLEC family like 1
  ENST ID: ENST00000597610
  CDS Start-End: 240-660
aaagaatctgcttcgaaagggatccatggggctttgcgcaaggatacaagtgaacaggccttcacgatgaccagagacagaagcccctgacttggctaaagatacttctgctctccccatccccacatcctctttcagttacgcatcacctcactccttctgaaccatatggttctgatgtcagagccagtgtagtaaagagcttctgctgttcctgagaactgttgctgctggaagtgatgcttccactgctacagctggtacctgctaagctgctcaactcctcttgctccttggagaagacactgcagtgcagctgttccttccatgggattcccacaccctctgtgcagtggtggatgggaggagtccccgtgggtgtggatggcatggatggcagcctccaagtgacttccaccatgcttggcccctgggctaacagcaccatcagcctaactgaagagccagaaatgggcatgagacttctctgtgaggggaagaaccaaaacggaacccatgctttgagcatcctactgatgtcaagaaagagttctttggctgcccaggccttcgtgaaagggctgatccagggtgctatctatgcgggaattgtaattgcgctgctcttcctctgcctcctccctctcatagtgaaacata

SEQ ID NO: 181468 - DNA, 912 bp, Homo sapiens
  Payload ID: 15741
  Gene Symbol: SIGLECL1
  Gene Name: SIGLEC family like 1
  ENST ID: ENST00000601727
  CDS Start-End: 659-912
atgcactcacctaaggatgcgagctagcaggtcttgcagcggctatcacgcccctcacgccgctatctctgtgcagccgactgaggatccctagtcgcataaggctgtgcctggcctgttggcgtccctggcagttgttgggttctggcggttgttgggtccctggcagttgttggcggttgttgggttccttcattgaaactgcactaactgggcttccagtcagcgtcagtcagcggatccttgggccgtggggcagccgcaggtcggttaggccaccagggcggctctcgtgccagtgaggcccctgagagccctttggtcagacagaggctaaatctgaacagtcaggcggtgagattaagcatagtcagggagttcgccaggagccagcgttcctcagcctccaccacgtcagtcacctggtcagccagagggcagctggggcgacatccatctaccaagaaggtgaacaggccttcacgatgaccagagacagaagcccctgacttggctaaagatacttctgctctccccatccccacatcctctttcagttacgcatcacctcactccttctgaaccatatggttctgatgtcagagccagtgtagtaaagagcttctgctgttcctgagaactgttgctgctggaagtgatgcttccactgctacagctggtacctgctaagctgctcaactcctcttgctccttggagaagacactgcagtgcagctgttccttccatgggattcccacaccctctgtgcagtggtggatgggaggagtccccgtgggtgtggatggcatggatggcagcctccaagtgacttccaccatgcttggcccctgggctaacagcaccatcagcctaactgaagagccagaaatgggcatgagacttctctgtga

SEQ ID NO: 181469 - DNA, 503 bp, Homo sapiens
  Payload ID: 15741
  Gene Symbol: SIGLECL1
  Gene Name: SIGLEC family like 1
  ENST ID: ENST00000596117
  CDS Start-End: 465-503
attgaaactgcactaactgggcttccagtcagcgtcagtcagcggatccttgggccgtggggcagccgcaggtcggttaggccaccagggcggctctcgtgccagtgaggcccctgagagccctttggtcagacagaggctaaatctgaacagtcaggcggtgagattaagcatagtcagggagttcgccaggagccagcgttcctcagcctccaccacgtcagtcacctggtcagccagagggcagctggggcgacatccatctaccaagaaggtgaacaggccttcacgatgaccagagacagaagcccctgacttggctaaagatacttctgctctccccatccccacatcctctttcagttacgcatcacctcactccttctgaaccatatggttctgatgtcagagccagtgtagtaaagagcttctgctgttcctgagaactgttgctgctggaagtgatgcttccactgctacagctgggtggaaaagacaattca

SEQ ID NO: 181470 - DNA, 870 bp, Homo sapiens
  Payload ID: 15741
  Gene Symbol: SIGLECL1
  Gene Name: SIGLEC family like 1
  ENST ID: ENST00000597824
  CDS Start-End: 163-474
cagaagcccctgacttggctaaagatacttctgctctccccatccccacatcctctttcagttacgcatcacctcactccttctgaaccatatggttctgatgtcagagccagtgtagtaaagagcttctgctgttcctgagaactgttgctgctggaagtgatgcttccactgctacagctgggaaagagttctttggctgcccaggccttcgtgaaagggctgatccagggtgctatctatgcgggaattgtaattgcgctgctcttcctctgcctcctccctctcatagtgaaacatatcagaaagaagcaggcgaagaaagctgcagcgatcagagcaaaaaagagctctaaagtcagagcaagccaagaacttgagatgtctctgaagcctgaggaaccaggaaaacccgtagtcgccacattttctgagagccggatattggaaaagcaagataaacgagccagctaagcctgtggaacatgcctcatacctggagtcgccattatccctggaattacaaagatctgcaaaatttatagcgctcacagaaaccctggaggctgtaataaacctggagccccctggactctcctcagctcacaaaaccctctcaattcctacacatcccttaacactcattctccattgaataggtggttactcttagacctagtcttagaacctctgaagacacactttgtaatttgttgtttggctaaatgagaagaaatctgtgccaccctgggaaggtgtcaaaagaaggaaaaatacatgtgacaatatgaatcaagtccatcagcaagttacttttgagcgcctactgtgtgtcagtgcctgagatacacctacaagagcgccaggctt

SEQ ID NO: 181471 - DNA, 1516 bp, Homo sapiens
  Payload ID: 15741
  Gene Symbol: SIGLECL1
  Gene Name: SIGLEC family like 1
  Uniprot ID: Q8N7X8
  ENST ID: ENST00000614422
  CDS Start-End: 192-785
ggtgaacaggccttcacgatgaccagagacagaagcccctgacttggctaaagatacttctgctctccccatccccacatcctctttcagttacgcatcacctcactccttctgaaccatatggttctgatgtcagagccagtgtagtaaagagcttctgctgttcctgagaactgttgctgctggaagtgatgcttccactgctacagctggtacctgctaagctgctcaactcctcttgctccttggagaagacactgcagtgcagctgttccttccatgggattcccacaccctctgtgcagtggtggatgggaggagtccccgtgggtgtggatggcatggatggcagcctccaagtgacttccaccatgcttggcccctgggctaacagcaccatcagcctaactgaagagccagaaatgggcatgagacttctctgtgaggggaagaaccaaaacggaacccatgctttgagcatcctactgatgtcaagaaagagttctttggctgcccaggccttcgtgaaagggctgatccagggtgctatctatgcgggaattgtaattgcgctgctcttcctctgcctcctccctctcatagtgaaacatatcagaaagaagcaggcgaagaaagctgcagcgatcagagcaaaaaagagctctaaagtcagagcaagccaagaacttgagatgtctctgaagcctgaggaaccaggaaaacccgtagtcgccacattttctgagagccggatattggaaaagcaagataaacgagccagctaagcctgtggaacatgcctcatacctggagtcgccattatccctggaattacaaagatctgcaaaatttatagcgctcacagaaaccctggaggctgtaataaacctggagccccctggactctcctcagctcacaaaaccctctcaattcctacacatcccttaacactcattctccattgaataggtggttactcttagacctagtcttagaacctctgaagacacactttgtaatttgttgtttggctaaatgagaagaaatctgtgccaccctgggaaggtgtcaaaagaaggaaaaatacatgtgacaatatgaatcaagtccatcagcaagttacttttgagcgcctactgtgtgtcagtgcctgagatacacctacaagagcgccaggctttcaagccttcatatctggatagaatcccaacttcagtgcttggtggctgtctatctttggacaagatctttcattccccatcctttgaacatcacatgacccatatctgggtggagaatgggtgaaaagtactgttcagagatgcaggtgagaaaaaacatgacgatgggccctgaatgccaagattcattggagctttggagctttatcttgtaggaccttatcctgactcccttagaatgtaagttccaagagaacagggactttgtctgccttgttttctacttttatcaccagcacccagaatgatgcctaaaatacaataagatctcaag

SEQ ID NO: 181472 - DNA, 1656 bp, Homo sapiens
  Payload ID: 15742
  Gene Symbol: SIGMAR1
  Gene Name: sigma non-opioid intracellular receptor 1
  Uniprot ID: Q99720
  ENST ID: ENST00000277010
  CDS Start-End: 75-746
ctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctgggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcggggcgctactgggctgagatctcggataccatcatctctggcaccttccaccagtggagagagggcaccaccaaaagtgaggtcttctacccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatagacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttcca

SEQ ID NO: 181473 - DNA, 1743 bp, Homo sapiens
  Payload ID: 15742
  Gene Symbol: SIGMAR1
  Gene Name: sigma non-opioid intracellular receptor 1
  ENST ID: ENST00000378892
  CDS Start-End: 429-833
ctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctggtgagcgggcagagggcagggaggggagcggccggcctgggagcggagcctagggttccgaaggcgccatccccggacctaggaccggtgccagccctgactccgccgcccctctgcctccgccagggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcggggcgctactgggctgagatctcggataccatcatctctggcaccttccaccagtggagagagggcaccaccaaaagtgaggtcttctacccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatagacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttcca

SEQ ID NO: 181474 - DNA, 840 bp, Homo sapiens
  Payload ID: 15742
  Gene Symbol: SIGMAR1
  Gene Name: sigma non-opioid intracellular receptor 1
  Uniprot ID: Q99720
  ENST ID: ENST00000477726
  CDS Start-End: 113-691
ggcggtggcgggggagcgcttcgtgggcagccggcgggctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctgggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcgggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatagacaggagcgggcaggcccgcacatatccacttgctggagcccatgtttacagacagggacatacaccatgcagatcctgagttcctgctgtatgagcagggatatccatgcttatgt

SEQ ID NO: 181475 - DNA, 1582 bp, Homo sapiens
  Payload ID: 15742
  Gene Symbol: SIGMAR1
  Gene Name: sigma non-opioid intracellular receptor 1
  Uniprot ID: Q99720
  ENST ID: ENST00000353468
  CDS Start-End: 48-368
ggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctgggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgaggcgctactgggctgagatctcggataccatcatctctggcaccttccaccagtggagagagggcaccaccaaaagtgaggtcttctacccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatagacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttcca

SEQ ID NO: 181476 - DNA, 1082 bp, Homo sapiens
  Payload ID: 15743
  Gene Symbol: SPCS1
  Gene Name: signal peptidase complex subunit 1
  ENST ID: ENST00000233025
  CDS Start-End: 206-715
ggagacgcgggggcgccggcggccgttgggccgcgcaagtactgtcaaggacagttttcgggacgggggacgcggctccaggcacccaacagcactgacggcgaacacttcacgggcgcgcgatgcctcgacaaggcggccgccaccaccacctcagctgccctcgcgggcagcacggcgcggcaaaagcgcacgtcgcctagcgatggcgcggggcggggacacgggctgtaccggcccgtcggagacttccgcttccggggccgccgccatcgctctcccgggcttagaaggcccggctactgacgcgcagtgccagaccttacccctcacggtccttaagtctcggtcgccctcgcctcgcagcctgccacccgcgctcagctgcccgcctcctcagccagccatgctggagcatctgagctcgctgcccacgcagatggattacaagggccagaagctagctgaacagatgtttcagggaattattcttttttctgcaatagttggatttatctacgggtacgtggctgaacagttcgggtggactgtctatatagttatggccggatttgctttttcatgtttgctgacacttcctccatggcccatctatcgccggcatcctctcaagtggttacctgttcaagaatcaagcacagacgacaagaaaccaggggaaagaaaaattaagaggcatgctaaaaataattgaggttttcatgattcagcacctgcttttgtttctgtgagatgagctaaattgctttcataccccagataagagctaaaaccacctaatgctcttatggcacagctgtgtatagatttagttctctttatacttcatttctagcccagttgggttttgatttatataagtagtttagaccttctcttcataatcttgctctgagatggggaacagaacacacaagtatgaagtttctttcaggtgtaaataatgaaaaataaatgcctcataaatgatagtacaatgtaactatcaaagttttataattcattatgagttaaccattttaatgtttccaattaaacctcatagtgcaagttctttgtct

SEQ ID NO: 181477 - DNA, 822 bp, Homo sapiens
  Payload ID: 15743
  Gene Symbol: SPCS1
  Gene Name: signal peptidase complex subunit 1
  ENST ID: ENST00000423431
  CDS Start-End: 235-477
ggcacaaacaaggtgccgtgaatatttgctggttgcatgaatgaggacagcagtcccaccctgtcccgggagtgcctagaattccactgtttgtggccaacccagaatacataacctgggggccggagagccagctgggacccagaggcccgggttcctcagaacggtttctctccaaaacgtgggcatcccacctggctgacggattacaagggccagaagctagctgaacagatgtttcagggaattattcttttttctgcaatagttggatttatctacgggtacgtggctgaacagttcgggtggactgtctatatagttatggccggatttgctttttcatgtttgctgacacttcctccatggcccatctatcgccggcatcctctcaagtggttacctgttcaagaatcaagcacagacgacaagaaaccaggggaaagaaaaattaagaggcatgctaaaaataattgaggttttcatgattcagcacctgcttttgtttctgtgagatgagctaaattgctttcataccccagataagagctaaaaccacctaatgctcttatggcacagctgtgtatagatttagttctctttatacttcatttctagcccagttgggttttgatttatataagtagtttagaccttctcttcataatcttgctctgagatggggaacagaacacacaagtatgaagtttctttcaggtgtaaataatgaaaaataaatgcctcataaatgatagtacaatgtaactatcaaagttttataattcattatgagttaaccattttaatgtttccaattaaacc

SEQ ID NO: 181478 - DNA, 832 bp, Homo sapiens
  Payload ID: 15743
  Gene Symbol: SPCS1
  Gene Name: signal peptidase complex subunit 1
  Uniprot ID: Q9Y6A9
  ENST ID: ENST00000602728
  CDS Start-End: 170-478
cccgtcggagacttccgcttccggggccgccgccatcgctctcccgggcttagaaggcccggctactgacgcgcagtgccagaccttacccctcacggtccttaagtctcggtcgccctcgcctcgcagcctgccacccgcgctcagctgcccgcctcctcagccagccatgctggagcatctgagctcgctgcccacgcagatggattacaagggccagaagctagctgaacagatgtttcagggaattattcttttttctgcaatagttggatttatctacgggtacgtggctgaacagttcgggtggactgtctatatagttatggccggatttgctttttcatgtttgctgacacttcctccatggcccatctatcgccggcatcctctcaagtggttacctgttcaagaatcaagcacagacgacaagaaaccaggggaaagaaaaattaagaggcatgctaaaaataattgaggttttcatgattcagcacctgcttttgtttctgtgagatgagctaaattgctttcataccccagataagagctaaaaccacctaatgctcttatggcacagctgtgtatagatttagttctctttatacttcatttctagcccagttgggttttgatttatataagtagtttagaccttctcttcataatcttgctctgagatggggaacagaacacacaagtatgaagtttctttcaggtgtaaataatgaaaaataaatgcctcataaatgatagtacaatgtaactatcaaagttttataattcattatgagttaaccattttaatgtttccaattaaacctcatagtgc

SEQ ID NO: 181479 - DNA, 4254 bp, Homo sapiens
  Payload ID: 15743
  Gene Symbol: SPCS1
  Gene Name: signal peptidase complex subunit 1
  ENST ID: ENST00000619898
  CDS Start-End: 411-920
aggccccggagcccagcccgttgtctggccgcccgcgttccctgcacgctgggccgagcacacttgccctctagctccgtggcagccgcgcagccccactacgcccagccagcccgcagcggtaaccgctagagcgtcgcgccaagcaggcgccgcggggcagccctgccgccggggtcctcgcagggaaaaaggccgtcgccatggagacgcgggggcgccggcggccgttgggccgcgcaagtactgtcaaggacagttttcgggacgggggacgcggctccaggcacccaacagcactgacggcgaacacttcacgggcgcgcgatgcctcgacaaggcggccgccaccaccacctcagctgccctcgcgggcagcacggcgcggcaaaagcgcacgtcgcctagcgatggcgcggggcggggacacgggctgtaccggcccgtcggagacttccgcttccggggccgccgccatcgctctcccgggcttagaaggcccggctactgacgcgcagtgccagaccttacccctcacggtccttaagtctcggtcgccctcgcctcgcagcctgccacccgcgctcagctgcccgcctcctcagccagccatgctggagcatctgagctcgctgcccacgcagatggattacaagggccagaagctagctgaacagatgtttcagggaattattcttttttctgcaatagttggatttatctacgggtacgtggctgaacagttcgggtggactgtctatatagttatggccggatttgctttttcatgtttgctgacacttcctccatggcccatctatcgccggcatcctctcaagtggttacctgttcaagaatcaagcacagacgacaagaaaccaggggaaagaaaaattaagaggcatgctaaaaataattgaggttttcatgattcagcacctgcttttgtttctgtgagatgagctaaattgctttcataccccagataagagctaaaaccacctaatgctcttatggcacagctgtgtatagatttagttctctttatacttcatttctagcccagttgggttttgatttatataagtagtttagaccttctcttcataatcttgctctgagatggggaacagaacacacaagtatgaagtttctttcaggtgtaaataatgaaaaataaatgcctcataaatgatagtacaatgtaactatcaaagttttataattcattatgagttaaccattttaatgtttccaattaaacctcatagtgcaagttctttgtctaaagggtcttctgttgattattctgcaaggaagataattaataaaagcctaagttagaagttcgtgcttctggccaggtgcagtggctctcacctataatcccagcacttgaggaggctaaggcaggaggatgacttgagcccaggagtttgagacatttcatggtatgtaattaatagttgtcattagaacattagttccatgagaacggggactttgttttgctcactgctgtctacccagtacatagaagagtacacgatgcattgttaagtacttaagatttattgaatgagaactgcattgtacaatatggtgccactagacacgtctatttaattaaaattaaaatataaaactctaaaactagccatgattcaaaggttcaatagctatatgtgactagtggctaccatataaaacatttccatcacaaagttccatttatcagatcttatatagaaccttgaataaaatttaatagacaagtgattttgtatttaacatttcacctttattgaatgcctataaggccatttgaataacggatcatgtacaaagcaacaggaaaaaaaaaactgcaagcagtaaaggttgtgcaggtgatattcagtaacactgcagtgtagccagagcaaggacataaaacttccttagctttgtaagtctgtggaaatcaaaacttctaaaagagaaaaccgaaatcagaattactgacactttaggccaggcatggtgcctcaagcctgtaatcccagcatttagggaggccaaggcaggcagatcacctgaggtcaggagttcaagaccagcctggccaacatggtgaaactccatctctactaaaaataacgaaaatcagccaggcatggtggtgtgtgcctgtaatcccagctactcgggaggctgagggaggggaacttgaacccaggaggcgtaggctgcagtgagccaagatcgcaccactgtactccagcctgggcaacaagaagactccatctcaaaaaaaaaaaaaaaagaatgattgacattttagaaccaatgccaaaagagtaacacatcaaagtctctgaactgtggccaaaggtatattcggaagaaaattcacagtcttaaagatgagtttttaaattaatttaggaagatgaattaagcactcaagtaaaaacgataaaagtgggaagaaaagatgtttaaacaaaataaaaatatacagtatggtaattaataagaaagtatgggggaagtcaggtgtggtggttcatgcctataatcccagcactttcagaggccgatgcaggaggactgcttgaatgcagtttgagaccagcctgggcaacacagacttcctctccacaaaaaattttaaaaattagccaggtgtggtggtgcatgcctgtggtcctagctacttgaggggctgaggtgggaggatcacttaagcccaggaggtcaaggctgcagtgagctatgatcacctcactgcactccaggctgggtgacagagcaagaccctgtctcaaaaaaaaaaaaaaaaaaaaaagatatgggtgagattcctttaattctaataaaatacctactttataccaatacattagaaaaattaagtaaaactgatgactctccagaacgatgtggatttccaaaacatgcacggaaaggtgaatagctcaaggataccaagtttgccaaagatttgttcccaactgggcattgggacttgatggttttgcaagttgagttctagcaaacccttcaaagtgaaaataagagttatcagaaaccaggctgtgagcactgtaaaagggcaggaagtattgttttattcaccactatatccccagctcctggcagagaacctggcacacagtaaactctaaataaaaatctgttaagtgtgccgggcgcggtggctcacgcctgtaatcccagcactttgggaggccgaggcgggcagatcacgaggtcaggagattgagaccatcctggctaacacggtgaaaccctgtctctactaaaaaaatacaaaaaaattagccgggcatggtggcgggcaactgtagtcccagctactcgagaggatgaggtaggagaatggagtgaacctgggaggcggagcttgcagtgatctgagattgggccactgcacttcagcctgggtgacagagcaagactgtgtcttaaaaaaaaaaaaaaattgttaagtggctgtaaagggaacatttcattagagtatttgtgtgtgtgtgtaattttcaaagatagatatatttttagttatagaaactgaaaacagggctgggcacagtggctcattcctgtaatcctggcactttgggaggctgaggtgagtggattgcttgagcccaggagttctgagatcagcctgggcaatgtggtgtaaccctgtctctacaaaaaatacaaaaactagccaggtgtggtggcacacgcctgtggtctcagctactagggaggctcaggcaggaataccacttgagccccagaagtggaggttgcagtgagttgagatcatgccactgcactccagcctgactgacagagtgaaactctgtctcaaaaaaaaaacacctgaaaacatttctggagcaatatttatttttagagtccctcgaatacagaagtgaaaatgtactattcaagacttgtatttaacttcataaaatttctttcctagatgggtattacctcttattaaacaactaataaaatatgtgctatataatcatacatttaaaacatggaaagacaactaatatcttacagtacatgaagacaaacttcaggagacaaacattaaatatatccaaaaactaaatggacctggactttgcttacaaattgcttaaatggaaatgaaatttgtgtttaagaaatgttttcactgatggaaaaataaatctaacaaaaccattatgtaaaaacatactgatttacaaagcc

SEQ ID NO: 181480 - DNA, 2708 bp, Homo sapiens
  Payload ID: 15744
  Gene Symbol: SPCS2
  Gene Name: signal peptidase complex subunit 2
  Uniprot ID: Q15005
  ENST ID: ENST00000263672
  CDS Start-End: 40-720
agacaagtcggaggggagggagacgcagaggcggacaagatggcggcggcagctgtacagggcgggagaagcggtggtagcggaggctgtagtggggctggtggtgcttccaactgcgggacaggaagtggccgtagcggcttgttggataagtggaagatagatgataagcctgtaaaaattgacaagtgggatggatcagctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcctattttgtgatgatggggattctgaccatttatacctcatataaggagaagagcatctttctcgtggcccacaggaaagatcctacaggaatggatcctgatgatatttggcagctgtcctccagtcttaaaaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttaaaatgggtaaagtaagaaatgttaaaaagtccctgttttgtcctgaaattttagtctattctgggtaaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagctttttaatttgtttgaaacagactttctgcctgttacatttttgcttttaaccaattaaagaagccaatggcattttagttttatattgtgttttccactagtatatccctgttgatttgtttgtgccttttattaactgccattttctaaaatttttttcaataaaaggaaggaagatgtgaaaaaaatggagtcatagttttgatggagagaacagagaaacaagtgttaacatctttctactataggtttttttcatttttaggctattttacttgtcaaaggcccctgagaacctgtagctaaggaactcttagctttccagtgataataacaataataacaacattctgtacttactttgtgccagaaatgctccaagtactttacatgtgttaataatgctcacagcaatcctaagaggcaggtgctgttattatccccattttacacatgaggaaactgagatacaaaagttaaataattgtcacacagctagtgatagaactgggattcaaacctggggagtccggcttcagagtttgtggtcctgcagagacaaaacagccgcttttccagtattttcccagtatggtcagagaagacctgggtgcttgccaagatcctttgacctttaggaatatttccctacagccttacaaaacatcaattttggctgagcctagtacccaacactatattcagtttgtaagaaattaccattatcacatttcctgtttgtcttggagaggttgtcctatctcgcaccacatggtagggaattgtgaacaacactggacagaaagttaaagccttggattctgtactcttcattcctgtaaaccttgggtaagtttcggaattctctgtgagcttcttaaagtttttgaaagcatgtaaccggataagtgtatttttacaatggaggagttacagtcatcttggtatttgtgggagattggttccaggatccccaagcataccaaaatccaaggatgctcaagtcccttatataaaatggtatagcatttgcatataacctacacacatcctcccatatacttttaatcacctctggattacctataatacctaatataatgtaaatgctatgtaaatagttatactgcattggttttttaatttatattttttgttattttttaaaatatatttttaatccatggttggttaaatctgtagatatagagggccaactgtactgttagacacaagggtctcgaggcttgcagatagagactgaataaccctctccatgatgatcccttagagttcccccactgtgcctttttctttacatgtgcatgcaaacatgtgtctccacatacattttttttaacaaaaattgaattatgttgatatatgtcctgtaatttgtgttttaaacttaatatatcttaggcattttccctgtgtgtgtgtataatgcagctattaaaaatgagtctgaggccagg

SEQ ID NO: 181481 - DNA, 612 bp, Homo sapiens
  Payload ID: 15744
  Gene Symbol: SPCS2
  Gene Name: signal peptidase complex subunit 2
  ENST ID: ENST00000530257
  CDS Start-End: 26-499
ggagggagacgcagaggcggacaagatggcggcggcagctgtacagggcgggagaagcggtggtagcggaggctgtagtggggctggtggtgcttccaactgcgggacaggaagtggccgtagcggcttgttggataagtggaagatagatgataagcctgtaaaaattgacaagtgggatggatcagctgtgaaaaactctttggatgattctgccaaaaaggagaagagcatctttctcgtggcccacaggaaagatcctacaggaatggatcctgatgatatttggcagctgtcctccagtcttaaaaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttaaaatgggtaaagtaagaaatgttaaaaagtccc

SEQ ID NO: 181482 - DNA, 772 bp, Homo sapiens
  Payload ID: 15744
  Gene Symbol: SPCS2
  Gene Name: signal peptidase complex subunit 2
  ENST ID: ENST00000526361
  CDS Start-End: 204-467
gggagacgcagaggcggacaagatggcggcggcagctgtacagggcgggagaagcggtggtagcggaggctgtagtggggctggtggtgcttccaactgcgggacaggaagtggccgtagcggcttgttggataagtggaagatagatgataagcctgtaaaaattgacaagtgggatggatcagctgtgaaaaactctttggatgattctgccaaaaaggaaagatcctacaggaatggatcctgatgatatttggcagctgtcctccagtcttaaaaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttaaaatgggtaaagtaagaaatgttaaaaagtccctgttttgtcctgaaattttagtctattctgggtaaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttat

SEQ ID NO: 181483 - DNA, 498 bp, Homo sapiens
  Payload ID: 15744
  Gene Symbol: SPCS2
  Gene Name: signal peptidase complex subunit 2
  ENST ID: ENST00000526883
  CDS Start-End: 1-498
atcacaaccctacgcacgcttggagcctgcccttgccctcatcacacttcaaacctggacccggtcctctttagaacttcttcttttctcgcaagtgttctggtcctggtcgccacacctttttcgtggaagatagatgataagcctgtaaaaattgacaagtgggatggatcagctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcctattttgtgatgatggggattctgaccatttatacctcatataaggagaagagcatctttctcgtggcccacaggaaagatcctacaggaatggatcctgatgatatttggcagctgtcctccagt

SEQ ID NO: 181484 - DNA, 839 bp, Homo sapiens
  Payload ID: 15744
  Gene Symbol: SPCS2
  Gene Name: signal peptidase complex subunit 2
  ENST ID: ENST00000532972
  CDS Start-End: 22-795
ggagacgcagaggcggacaagatggcggcggcagctgtacagggcgggagaagcggtggtagcggaggctgtagtggggctggtggtgcttccaactgcgggacaggaagtggccgtagcggcttgttggataagagacaagctctcactatattgcccaggctggactcgagctcctgggctcaagctgttctgccacctcagcctcccaagtatctgggatggcagtggaagatagatgataagcctgtaaaaattgacaagtgggatggatcagctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcctattttgtgatgatggggattctgaccatttatacctcatataaggagaagagcatctttctcgtggcccacaggaaagatcctacaggaatggatcctgatgatatttggcagctgtcctccagtcttaaaaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaatt

SEQ ID NO: 181485 - DNA, 2711 bp, Homo sapiens
  Payload ID: 15744
  Gene Symbol: SPCS2
  Gene Name: signal peptidase complex subunit 2
  ENST ID: ENST00000610881
  CDS Start-End: 40-723
agacaagtcggaggggagggagacgcagaggcggacaagatggcggcggcagctgtacagggcgggagaagcggtggtagcggaggctgtagtggggctggtggtgcttccaactgcgggacaggaagtggccgtagcggcttgttggataagtggaagatagatgataagcctgtaaaaattgacaagtgggatggatcagctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcatcctattttgtgatgatggggattctgaccatttatacctcatataaggagaagagcatctttctcgtggcccacaggaaagatcctacaggaatggatcctgatgatatttggcagctgtcctccagtcttaaaaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttaaaatgggtaaagtaagaaatgttaaaaagtccctgttttgtcctgaaattttagtctattctgggtaaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagctttttaatttgtttgaaacagactttctgcctgttacatttttgcttttaaccaattaaagaagccaatggcattttagttttatattgtgttttccactagtatatccctgttgatttgtttgtgccttttattaactgccattttctaaaatttttttcaataaaaggaaggaagatgtgaaaaaaatggagtcatagttttgatggagagaacagagaaacaagtgttaacatctttctactataggtttttttcatttttaggctattttacttgtcaaaggcccctgagaacctgtagctaaggaactcttagctttccagtgataataacaataataacaacattctgtacttactttgtgccagaaatgctccaagtactttacatgtgttaataatgctcacagcaatcctaagaggcaggtgctgttattatccccattttacacatgaggaaactgagatacaaaagttaaataattgtcacacagctagtgatagaactgggattcaaacctggggagtccggcttcagagtttgtggtcctgcagagacaaaacagccgcttttccagtattttcccagtatggtcagagaagacctgggtgcttgccaagatcctttgacctttaggaatatttccctacagccttacaaaacatcaattttggctgagcctagtacccaacactatattcagtttgtaagaaattaccattatcacatttcctgtttgtcttggagaggttgtcctatctcgcaccacatggtagggaattgtgaacaacactggacagaaagttaaagccttggattctgtactcttcattcctgtaaaccttgggtaagtttcggaattctctgtgagcttcttaaagtttttgaaagcatgtaaccggataagtgtatttttacaatggaggagttacagtcatcttggtatttgtgggagattggttccaggatccccaagcataccaaaatccaaggatgctcaagtcccttatataaaatggtatagcatttgcatataacctacacacatcctcccatatacttttaatcacctctggattacctataatacctaatataatgtaaatgctatgtaaatagttatactgcattggttttttaatttatattttttgttattttttaaaatatatttttaatccatggttggttaaatctgtagatatagagggccaactgtactgttagacacaagggtctcgaggcttgcagatagagactgaataaccctctccatgatgatcccttagagttcccccactgtgcctttttctttacatgtgcatgcaaacatgtgtctccacatacattttttttaacaaaaattgaattatgttgatatatgtcctgtaatttgtgttttaaacttaatatatcttaggcattttccctgtgtgtgtgtataatgcagctattaaaaatgagtctgaggccagg

SEQ ID NO: 181486 - DNA, 4571 bp, Homo sapiens
  Payload ID: 15745
  Gene Symbol: SPCS3
  Gene Name: signal peptidase complex subunit 3
  Uniprot ID: P61009
  ENST ID: ENST00000503362
  CDS Start-End: 114-656
gcgctcccggaacgcgcgcaccgcagacggcgcggatcgcagggagccggtccgccgccggaacgggagcctgggtgtgcgtgtggagtccggactcgtgggagacgatcgcgatgaacacggtgctgtcgcgggcgaactcactgttcgccttctcgctgagcgtgatggcggcgctcaccttcggctgcttcatcaccaccgccttcaaagacaggagcgtcccggtgcggctgcacgtctcgcggatcatgctaaaaaatgtagaagatttcactggacctagagaaagaagtgatctgggatttatcacatttgatataactgctgatctagagaatatatttgattggaatgttaagcagttgtttctttatttatcagcagaatattcaacaaaaaataatgctctgaaccaagttgtcctatgggacaagattgttttgagaggtgataatccgaagctgctgctgaaagatatgaaaacaaaatattttttctttgacgatggaaatggtctcaagggaaacaggaatgtcactttgaccctgtcttggaacgtcgtaccaaatgctggaattctacctcttgtgacaggatcaggacacgtatctgtcccatttccagatacatatgaaataacgaagagttattaaattattctgaatttgaaacaacatatttttatacttaatgaattgtatctcattaatctcttcccttacatcttcatgtattgttggtttgttttttggttttgggtttttttttttttttttttggtataagaactaacatcaaaaggcctgtttaaagggaaaggttaatgggctacttaatattatgaacaaaacaaaaaaacaaggctgccacagtggaatattatcttacaagaataagaactacataaaacagatttgtaaaaaatacatatttgaagtattccctgtatttccattattctttatggaatataaagtaagcatgaaaggtagttaaaactttcaggtgcctgtagagtcataataactgtattttatgccttgcattcacgcaaattcacattggatgtgatttaaaagtagacattctctttttcctcttttaggatatgtttgattactggaaaattaatatggttatttgttagaagtctggtttataaaaaagccaaaagtgatggaatttattccatttgtcttaggaaggcccataatacttgtttttcttacatgtgactagcaactttctccacttaaagactaaatacctctttatatgatgtaaattattctaattcattttaaaatcttttaggtcagcaaaatgtgtgtcttcagtgctttctctaaaaacgttcctttatagctttgtacttttttttttagcgttgccattgaaagttaaaatgtttgcatggtttaccctctgagttatgtttcttctagtgagcatgcctgctgtcactaagtgaattatttactactttttgtaggtctatattttaataattattgggataataataattgtggtatgctttccatttacaaaccactcatatactttagtgtatgtcatcctcaataatctaatgaggtaagtagtataagtgttagctctttgcagataagaaactgaaacccagaagtttattgaattgcttcattgttacctagccagcaaggagtggaattaaaacttgaactcagatcttctaattttctgagctcatcctttctcttatacctcagattgcagactaatcaaattttacttaaaaccttcctgatatttttgttaccctggacaccctttctattctagaaaaggtttcccattttatatggaagtgactaattttcaagctgccaacaacttatatcgaggtaatattttattctctgaataaattcatttcacttatattaaaagcataaggaaatctacatgtatgtaaaaataacttagaaattcagtacataatacatgattgaatacatgatcgtatttaacatgttttttttttctgcagtggacaaataaacatcctcaaagtagcaactgcaaatcagttacccttagaaaagcaagaccaaacactgtagttacactattagcagtgaccaaaaagggctaatattttctaagaatagtttaaattacagacatttgttatatttaccttatgtgaaatacatcactatttaattacattaattttaacatctgttgtgtggagttgtatagttcatgcaaaagcctgtgggtatgggtttttcaaaccagcagaaaggtcaaaggtacctgaatgctaaactgcctggctcccagctttttcattaaacttttcagggtcttggtttctttatctgtaaaatgacagagttggaccagttaactttaatggccatccttttacaccacacaagttgataaaatttatctgttcagcaaagagattgaacaaaaaagcacgttagtaatatgaagacaggaaaacgaatgaaagtctaacacataactcatattgatttactttatttctgttagattttacactctgaaaatttcacctcatttagtttgtacaaatactagacatggaaacttaaaatgtgcaggtgtcaaagcttaaaaatcaggtgtgtcctctttaaaggcatgtgcgataagcctgcagtcttaaccagacctggtaccagtttaacagttcatgatacttctgtgatgagtggatctgttagtctggtagagattaatgttgaaatttacttgaattacagttatttgacaagcccactttttttggagtttggtgaggaagataagtaaaaatgcccaactagtacaatgtggagaaagttttctgtttgcttgactaagggaaattgctcagaaaaagaatgctccaacatgggaataaggaccttcagtctcaggaactcatttttgggtgcagtttctacatttaaaaaattgacttgtgttcagtttgataaccagttcatttgctttagtctcagtgttttaaagaagtctcataatgttctacaaagacacaaagcttcaggcttatacaaaactgagtatgattagaaatacctgagcccagaaatgattctgagaaaagagaataatttgaagacacttatttaaaagtaattatggttagaaatgaattaatttaaaaatgtgttcacatatccctttctctaacagtttaacctagacaaacatctgtatcagtatttttttattcccctgattgattacatttggtttctttattctgaaaggaaaataacaaaaacttcagaaattcctaagggtgtaataagaaagtgggttttgagtttcctttcctggaattattttacagttctttggtgggtctcgtcagccaattcatagctgggctttaagattatcatcttagagatgatagatgggctttttaaagatttcatcttagagatgaaaagctgggctttttctctaagatgataatcttaaagcccagctattaattgataatgaacatttttcactatttttttttctatctgaagcttagagatctagagctttggatctttcgggtatatgtcaatggaggtattattttataatactttgcattgacatgaagtgggttcatgggggaaaaccatgagctgtgaacattggtagcaaacaagcatatattcatttcaaaactttccttgcttttagcagagagaagcctgtatatgttacatgtgtgactttcagtagtttaaagagatgtttcaaaaaattgttgcatgtttttgatgcaatttgggaaattgtttacttcacaatgtagtcattcataaaaaaattcatgaaaatactgaacatatgtttgaggatttttcttttcctttttaaatttttttattttttctgagacggagatctgctcttacgcccaggctagagtgaagtggcgcgatcttggcttactgcaacctccaccccccaggttcaagcgattctcctgcctcagcctccggagtagctgggattacaggcgcccgccaccacgtccggctaatttttgtattttcagtagagacggggttttgctatgttggccaggctggtctcaaactcctgacctcaagtgatccacctgcctcggcctcccaaagtgttaggataacaggtgtgagccaccgtgcccggctgaagatttttcttaattgcaataaatattcagcattttttctaatgaaaatgaattttgtttaccagtaaaagtatgcattttaaaagactttcagatttatgctttttacgtgaagctgctaaactaaaagtaaatggaagaaaccaagtctagtaggttttttctttttttttgtgggggtgggatgggggaggttagttacacttaaaatatcttctccagagactgtatgctcctatactagactgtaagctctttgagggcagtctgtcagatttatctttgtatcttccccagcgcctagtgtagtgccttgcacataataggcgcccaataaatattgatgaagaatgaa

SEQ ID NO: 181487 - DNA, 7372 bp, Homo sapiens
  Payload ID: 15746
  Gene Symbol: SPPL2A
  Gene Name: signal peptide peptidase like 2A
  Uniprot ID: Q8TCT8
  ENST ID: ENST00000261854
  CDS Start-End: 276-1838
gtagcgccgggacgccgggacgcctggataccgggagagcgctgggactctccgagcccggcgcgggggtttccgcatcttacgggcggggccggaagaggaagtcgcgctgctgtggcggccgctgtagcagcggcggtccagtcgtagcccggccgcccgcgcctgtccggtccggtccggccacggaggcagcgcagcggcgggactccgagcctaccccgccgagtgagctgcgccgcaccgtgccgtcccacccggcacccaccagtccgatggggccgcagcggcggctgtcccctgccggggccgccctactctggggcttcctgctccagctgacagccgctcaggaagcaatcttgcatgcgtctggaaatggcacaaccaaggactactgcatgctttataacccttattggacagctcttccaagtaccctagaaaatgcaacttccattagtttgatgaatctgacttccacaccactatgcaacctttctgatattcctcctgttggcataaagagcaaagcagttgtggttccatggggaagctgccattttcttgaaaaagccagaattgcacagaaaggaggtgctgaagcaatgttagttgtcaataacagtgtcctatttcctccctcaggtaacagatctgaatttcctgatgtgaaaatactgattgcatttataagctacaaagactttagagatatgaaccagactctaggagataacattactgtgaaaatgtattctccatcgtggcctaactttgattatactatggtggttatttttgtaattgcggtgttcactgtggcattaggtggatactggagtggactagttgaattggaaaacttgaaagcagtgacaactgaagatagagaaatgaggaaaaagaaggaagaatatttaacttttagtcctcttacagttgtaatatttgtggtcatctgctgtgttatgatggtcttactttatttcttctacaaatggttggtttatgttatgatagcaattttctgcatagcatcagcaatgagtctgtacaactgtcttgctgcactaattcataagataccatatggacaatgcacgattgcatgtcgtggcaaaaacatggaagtgagacttatttttctctctggactgtgcatagcagtagctgttgtttgggctgtgtttcgaaatgaagacaggtgggcttggattttacaggatatcttggggattgctttctgtctgaatttaattaaaacactgaagttgcccaacttcaagtcatgtgtgatacttctaggccttctcctcctctatgatgtattttttgttttcataacaccattcatcacaaagaatggtgagagtatcatggttgaactcgcagctggaccttttggaaataatgaaaagttgccagtagtcatcagagtaccaaaactgatctatttctcagtaatgagtgtgtgcctcatgcctgtttcaatattgggttttggagacattattgtaccaggcctgttgattgcatactgtagaagatttgatgttcagactggttcttcttacatatactatgtttcgtctacagttgcctatgctattggcatgatacttacatttgttgttctggtgctgatgaaaaaggggcaacctgctctcctctatttagtaccttgcacacttattactgcctcagttgttgcctggagacgtaaggaaatgaaaaagttctggaaaggtaacagctatcagatgatggaccatttggattgtgcaacaaatgaagaaaaccctgtgatatctggtgaacagattgtccagcaataatattatgtggaactgctataatgtgtcattgattttctacaaatagacttcgactttttaaattgacttttgaattgacaatctgaaagagtcttcaatgatatgcttgcaaaaatatatttttatgagctggtactgacagttacatcataaataactaaaacgctttgcttttaatgttaaagttgtgccttcacattaaataaaacatatggtctgtgtagtttccgagatgtactatatacagtatatttttctaaaaaaaaatgccttgacccacccctatacttttttttaacgaaatctgtttctttcagctctgatggtagatacaagtagttactatttctgaatgggttttactgtaaagaattatgcaaattggccaggcgcggtggctcacgcctgtaatcccaacactttgggaggccaaggcgggcggatcacgaggtcaggagatcgagaccatcctggctaacacggtgaaacccctctctactaaaaataccaaaaattagctgggcgtggtggagggtgcctgtagtcccagctactgggaaggctgagacaggagaatggcgtgaacccgggaagtggagcttgcagtgagccaagatcacgccactgcactccagcctgggcgacagagtgagactccatcccaaaaaaaaagatttatgcaaattatatctgctctgtagaaataactgtttaacaccatgcaagaaggcggttcaacggtgaaaatttggaccttatatcactgcagaggttagaaatacataattttggaaatataagtgcatatttttgtagtatttttttaaacccaatcctttcataaacttgagaactgaaattacttcagactgcacgtgtattatattaagaacatttttccagatatagagaaacataatatatagaactagtcactaaaaggagacagacactgaaatctagttttcattggtttgacagccttttttttttaaatgtagcttaaatttcagtactaacattcagtttcactttggtatttctgatctttgcaatttggttctgttaatgttaaggtttgattttttaaaaaaattatttttcttaagaaattatgtattaatacatatggctcatcgttgaatacagcattcctaacattatcccacattcccccactcccacccgttatctttttttcttcctgatgcccaccccttttcccataggtaatgattcttaatcttggtggaggatgtacaaagtgcggttcagagaaaagaattggcaacaacagcaagagacttggtgttagtctcagtttaattacaatacaaggaagagttgagtaatttgccgcatctcaagaccttgtatctcagttttctttttttttttttttttttttttgagacggagtctcgctctgtcgcccaggctggagtgcagtggcgggatctcggctcactgcaagctccgcctcccgggttcacgccattctcctgcctcagcctcccaagtagctaggactacaggcgcccgccactacgcccggctattttttgtagttttagtagagacggggtttcaccgttttagccgggatggtctcgatctcctgacctcgtgatccgcccgcctcggcctcccaaagtgctgggattacaggcgtgagccaccgcgcccggccatatctcagttttctaatctgtaaaatgagtaggttagaccagctaatcactctggtaccttccaacttgaaaaaagttttttccccattctttggtaaattttagatgtggcctgaacattctcctggaagtcagaggtcaaattatctttccattttcttttattttagtaagaatttcgcaaatgacaagtgataacaaaggcagcaggatttttcatttctctgtaaataatgtataaaatatgtgaacagaactatatctttcatctaaggccagttcaatttattaaaaataaaactaatgccttttaaaattgatcagacctttgatacttgaactaaattttgcattagagactttttaaaaattgttcgcttttgctgaataaattgcaaatagagaagcttcattgacagtcagtccctctctgcttaatgcagttatgggtcctttcgtttatggcaaatgacttacctgacaagagttaattttgcctccattgtatcaagtttgaatattttccaagaaatctgatttatttggcagactctgagagagagaacagattaagtgccgttttaaaactctgtattttcatttataataataaaatatttgccaaaatacagctgttttgtaaaattatctgcaccctcatccaagctttatatttaatagccttaatcacattttatgaagaatgttaaagaaaattttttttttactacatcgaaatgagataattaatttcttttttttttttttggaaatggagtctccctctgtcacccaggctggagtgcagtagcaagatcttggctcactacaacctctgcctcctggttcaagcaattttcctgcctcagcctcccaagtagacgggattacaggtgcgtgccaccacacctggctaatttttgtatttttagtagagacggggtttcaccttgttggtcaggctggtcttgagctcctgacctcatgatctgcccgcctcagactccccaagtgctgggattgcaggcatgagccaccgcgcctggcaaaataagataatttctcaaaataatttggtttcatataactggagtagtaattaatattttaacttcatcaactagatgtatctcctcagtagcatagtaactggtacatccagaaatctgaaatccgagttacttgatacaaattctactttatctaaccattagttattaaggaggtaaaatcttgttctaatttgctattaaaatcttattggttaaatagaaataagaaaaagtataattaagtttcttcatcctcaatgtcaactttatattgtaattaaatgtgtagcaaccaagctgacaatagtgattaagaaattaaagtacagaaatattttatttggggactcaaaatgaacaaaagatagataagattaaaatttcacttaaaaagctgccatctcttcctctcttgccctcccaccaccaataactttaaggggaagagaagctggttttttccctaaacatgtctttaaaataatgatacactgtatttattaattcttgatgcaaaaaaaaaaaagttagaaaatccctttgaacatttttgtggcttatcaacagaaatcactatctcaaattgtaatgtagattacttttgtctcagtttagtttagcaaaaataaatgtgaggcttgtggggaaagaccttgatattctaatacattatattttcttctagcttgtagatttttttttttttttttttttgagacagagtttcgctctttttgcccaggctggagtgcaatggcatgatatcagctcactgcaatctccgactcccgggttcaagcaattctcctgactcagcctcctgagtagctgggattataggcatgtgccaccacacccggctaatatagtatttttagtagagacggggtttctccatgttgatcaggctggtctcgaactcccaacctgaggtgatccgcccgcctcagcctcctaaagtgctgggattacaggcatgagccaccgtgcctggcacttgtagatttttttttagattagcaattccttagtagaatctgcaatttatttctcttttaaagagaattttaacccatctgctattggcattcttatattttacttgtccatagagattttagtgaattgatacatttataataaatacaaatgagctttccagttttctttgctctttcaatttatgctttagtataagcaaaaattactatttttacatttttaaaaattgtgggtacatgtaggtgtatatatttatggagtgcatgagatgttttgatacaggtatgcaatgtgaaataagcggatcatggagaatggggtatccattccctcaagcatttatcctttgagttatagacatattttacatttgaataaaaaatatttgaactaaggccgggtgcggtggctcacacctgtaatcccagcactttgggaggccaaggcgggtggatcatgaggtcaggagtttgagaccagcctgaccaacatggtgaaaccccgtctctactaaaaatacaaaaattagctgggtgtggtggggctcgcctgtaaccccagctactcaggagactgaggcaggagaatcgcttgaacctgggaggtggaggttgcagtgagtcgagatcacaccactgcactccagcctgggcgacagagcgagactccatctcaaaaaaaaaaaaaaaaaaaaaaaatatatatatgtatatatatatatatatatatgtatatatgaactaatttatttaggcttaatctctaaaatttcagcctgatcttaaccaatgaaatttcaaaaacaaaaactgtacttcagtctacaattgaatggaattcagtgtagaccagtacaatggaatgtactggctgagatgggagggtcccttgagcccaggagtttgaggctgtagtgagctgtgattgtgtctgtgaatagtgactgcactccagcctaggtgacatagcaagatgccatctcaaagaaatatagatatataacataaaataaataactttatacatttcctggaggaaaagtactctgtaaattcaagagatctgaatcaaattactcaaccttttggaatttgatcctctactgtaatactcatatgctagattactgaattttcagagtgaaaaaaaattgacagggtaatatataggccatattatagtgaagatcataagtataaatgtcctcgtttaatctttccatattgaggacagcctctgcatataaaaatgttcattgggagaaaaattatttttaaaactaaatttttatagtagtcctccattactggcaattaaggagcaacccacaaaatgtcattatgtggttctttgattaggcataaaaagtattgcaaacagcttttctattcctttggaatatgaatctttttaatgtctaaagttaacctgcaacattttctagtaggacaagtcaatgtaaattaggtaatttttgcctgttttataccttctgttgcattttgttcaaatgaaaacattttttaaaacatgattgaatttttacttctcagataattggtttgagtgtggaatttcttttttaacactttgatatgtaagttagtgtaaattaatacttttataacactactaggctttatatttttatggaatgttttaaaatttgaaatttttgaagtgttaatttagcagtactttatcattatgtgccaatactgacaagaaaaacaattttttatgtatttaatatactatggtattcaataaattctattttaaaataaaa

SEQ ID NO: 181488 - DNA, 1422 bp, Homo sapiens
  Payload ID: 15746
  Gene Symbol: SPPL2A
  Gene Name: signal peptide peptidase like 2A
  ENST ID: ENST00000558934
  CDS Start-End: 1-1070
tggcattaggtggatactggagtggactagttgaattggaaaacttgaaagcagtgacaactgaagatagagaaatgaggaaaaagaaggaagaatatttaacttttagtcctcttacagttgtaatatttgtggtcatctgctgtgttatgatggtcttactttatttcttctacaaatggttggtttatgttatgatagcaattttctgcatagcatcagcaatgagtctgtacaactgtcttgctgcactaattcataagataccatatggacaatgcacgattgcatgtcgtggcaaaaacatggaagtgagacttatttttctctctggactgtgcatagcagtagctgttgtttgggctgtgtttcgaaatgaagacaggtgggcttggattttacaggatatcttggggattgctttctgtctgaatttaattaaaacactgaagttgcccaacttcaagtcatgtgtgatacttctaggccttctcctcctctatgatgtattttttgttttcataacaccattcatcacaaagaatggtgagagtatcatggttgaactcgcagctggaccttttggaaataatgaaaagaatgatggaaacttggtggaagccactggtcaaccctcagctccccatgagaaattgccagtagtcatcagagtaccaaaactgatctatttctcagtaatgagtgtgtgcctcatgcctgtttcaatattgggttttggagacattattgtaccaggcctgttgattgcatactgtagaagatttgatgttcagactggttcttcttacatatactatgtttcgtctacagttgcctatgctattggcatgatacttacatttgttgttctggtgctgatgaaaaaggggcaacctgctctcctctatttagtaccttgcacacttattactgcctcagttgttgcctggagacgtaaggaaatgaaaaagttctggaaaggtaacagctatcagatgatggaccatttggattgtgcaacaaatgaagaaaaccctgtgatatctggtgaacagattgtccagcaataatattatgtggaactgctataatgtgtcattgattttctacaaatagacttcgactttttaaattgacttttgaattgacaatctgaaagagtcttcaatgatatgcttgcaaaaatatatttttatgagctggtactgacagttacatcataaataactaaaacgctttgcttttaatgttaaagttgtgccttcacattaaataaaacatatggtctgtgtagtttccgagatgtactatatacagtatatttttctaaaaaaaaatgccttgacccacccctatacttttttttaacgaaatctgtttctttcagctctgatggtagatacaagtagttactatttctga

SEQ ID NO: 181489 - DNA, 564 bp, Homo sapiens
  Payload ID: 15746
  Gene Symbol: SPPL2A
  Gene Name: signal peptide peptidase like 2A
  ENST ID: ENST00000558414
  CDS Start-End: 116-564
attagaatgtgtgatttctttgaaagactgttttgctgactctccagtttaagggacagccgctcaggaagcaatcttgcatgcgtctggaaatggcacaaccaaggactactgcatgctttataacccttattggacagctcttccaagtaccctagaaaatgcaacttccattagtttgatgaatctgacttccacaccactatgcaacctttctgatattcctcctgttggcataaagagcaaagcagttgtggttccatggggaagctgccattttcttgaaaaagccagaattgcacagaaaggaggtgctgaagcaatgttagttgtcaataacagtgtcctatttcctccctcaggtaacagatctgaatttcctgatgtgaaaatactgattgcatttataagctacaaagactttagagatatgaaccagactctaggagataacattactgtgaaaatgtattctccatcgtggcctaactttgattatactatggtggttatttttgtaattgcggtgttcactgtggcattaggtggatactggagtggact

SEQ ID NO: 181490 - DNA, 495 bp, Homo sapiens
  Payload ID: 15747
  Gene Symbol: SPPL2B
  Gene Name: signal peptide peptidase like 2B
  ENST ID: ENST00000612623
  CDS Start-End: 1-495
gggcaccgtcgccatcggcggctactgggccgggagtcgggacgtgaagaagtacatgaagcacaagcgcgacgatgggcccgagaagcaggaggacgaggcggtggacgtgacgccggtgatgacctgcgtgtttgtggtgatgtgctgctccatgctggtgctgctctactatttctacgatctcctcgtgtacgtggtcatcgggatcttctgcctggcctccgccaccggcctctacagctgcctggcgccctgtgtgcggcggctgcccttcggcaagtgcaggatccccaacaacagcctgccctacttccacaagcgcccgcaggcccgtatgctgctcctggcgctcttctgcgtggccgtcagcgtggtgtggggcgtcttccgcaacgaggaccagtgggcctgggtcctccaggatgccctgggcatcgccttctgcctctacatgctgaagaccatccgtctgcccaccttcaaggcctgcac

SEQ ID NO: 181491 - DNA, 3456 bp, Homo sapiens
  Payload ID: 15747
  Gene Symbol: SPPL2B
  Gene Name: signal peptide peptidase like 2B
  Uniprot ID: Q8TCT7
  ENST ID: ENST00000613503
  CDS Start-End: 81-1859
tgcgcggcgcatgcgtggcccggggtctcggggcgttgctgggaaacatctgccgttggttgcggcgggcaccggccgacatggcggcagcggtggcggctgcgctggcgcggcttttggcggcctttctgctcctcgcggcccaggtggcctgtgagtacggcatggtgcacgtggtctcccaggccgggggccccgaaggcaaagactactgcatcctctacaacccgcagtgggcccatcttccgcacgacctcagcaaggcatctttcctgcagctgcgcaactggacggcctccctgctctgctccgcagccgacctccccgcccgtggcttcagcaaccagatcccgctggtggcgcgggggaactgcaccttctatgagaaagtgaggctggcccagggcagcggagcacgcgggctgctcatcgtcagcagggagaggctggtccccccggggggtaataagacgcagtatgatgagattggcattcccgtggccctgctcagctacaaagacatgctggacatcttcacgcgtttcggccgcacggtgagggcggcgctgtatgcgcctaaggagccggtgctggactacaacatggtcatcatcttcatcatggctgtgggcaccgtcgccatcggcggctactgggccgggagtcgggacgtgaagaaaaggtacatgaagcacaagcgcgacgatgggcccgagaagcaggaggacgaggcggtggacgtgacgccggtgatgacctgcgtgtttgtggtgatgtgctgctccatgctggtgctgctctactatttctacgatctcctcgtgtacgtggtcatcgggatcttctgcctggcctccgccaccggcctctacagctgcctggcgccctgtgtgcggcggctgcccttcggcaagtgcaggatccccaacaacagcctgccctacttccacaagcgcccgcaggcccgtatgctgctcctggcgctcttctgcgtggccgtcagcgtggtgtggggcgtcttccgcaacgaggaccagtgggcctgggtcctccaggatgccctgggcatcgccttctgcctctacatgctgaagaccatccgtctgcccaccttcaaggcctgcacgctgctgctgctggtgctgttcctctacgacatcttcttcgtgttcatcacgcccttcctgaccaagagtgggagcagcatcatggtggaggtggccactgggccctcggactcagccacccgtgagaagctgcccatggtcctgaaggtgcccaggctgaactcctcacctctggccctgtgtgaccggcccttctccctcctgggtttcggagacattttggtgccagggctgctggtggcctactgccacaggtttgacatccaggtacagtcctccagggtatacttcgtggcctgcaccatcgcctatggcgttggcctccttgtgacattcgtggcactggccctgatgcagcgtggccagcccgctctcctctacctggtgccctgcacgctggtgacgagctgcgctgtggcgctctggcgccgggagctgggcgtgttctggacgggcagcggctttgcgaaagtcctacctccatctccgtgggccccagcaccagccgacggcccgcagcctcccaaagactctgccacgccactctccccgcagccgcccagcgaagaaccagccacatccccctggcctgctgagcagtccccaaaatcacgcacgtccgaggagatgggggctggagcccccatgcgggagcctgggagcccagctgaatccgagggccgggaccaggcccagccgtccccggtaacccagcctggcgcctcggcctaggggaggggtgagacgctcgctgccgtgcccgccacaccaagatgttggggctgcctggcgcccactggagacagacagacagacgcctgtcccccgggaccgaggcctgtgccgtccccacccgccccaacatggtgctcatccttgccgagacccctgcggtctgtgcccgcgcccagcccagctgccccggctgcacgcctgctgctcccagctcgcccggctgccacaagctctctgcgggtccatcctccccaccggggtccgtcctcgcaggccctgcccggcctctctgcagaccctcaagcgtcgtctgcatgagtgagcaggcgtgggtggactctggccgcggccacacttggtgctcaccagctgcttcggccttcaggtgacctccctccccacggcatcctgctctccgggtggaagagcagctttctgtctcccagaaggcatcgcttttccctcttgagcagatcggagcccctgggaggtttggaagctgcctccaagcctaggacacggaccagtggccggggcggcctctggcccctgacgctggctgagacaggcccgtggggcggggttttggggcgtgaacaaggctggcagtaagtggacaagctgctcccctggctaaggccctgccctgccctcagccagaggtgcctggccatgcctgcacactcctccccattttaataaatggtcgcaacttctagaagtcctgctggtgccacctggtggggtggacgtctctcagactgcccttctgacaagcaggggtgggcgccaggcaggctgggtcaggccctcaggggtccctggagccctgggagggagggactgggtcgtgggaggtcctggtagctcccggcacccaacctcgcttcccgtgtgggccccgtgttgcttttctgctgagaggggcttgggcctcggttctccctgtggcagcggcattggtgcctgggttcttaaccctctggacccagcagctaggagcttctggaacccacgaggacatctgccactggcatggtctactcactgatggggtcctcctgactccagggcagagacgtccgtgcgggaactgaccgaggcgtggccccaggccccggcatcctcccctcgctgcacgtggtcacttccgaagcagcgctccctgtggccgcagagacagagcccgcaccctggctgtctgtggtgcctgggccccagctcccgcccgccacccgccctgttgagtgcggcctccagactcgagtccagaatctgtttctgtcaagtcagtcgtccccagctgcacacggggactgctgagcgctgcgctctcacgggtctgttccggacagagggtggcaggggtgagccctgatcccttacaaaaaataccagcttcccagggagtaatggcgccttcactgaagccattttgtacatggggacggggtggggacgtctcttttttggtgttggacgtttgaccagtggggaggggttcagaggcggcggtcctgtccttggctccgtctgtccgtgtggccttgctgccattccgtctgatcattaaacacagcttttgatacatatg

SEQ ID NO: 181492 - DNA, 2583 bp, Homo sapiens
  Payload ID: 15747
  Gene Symbol: SPPL2B
  Gene Name: signal peptide peptidase like 2B
  Uniprot ID: Q8TCT7
  ENST ID: ENST00000610743
  CDS Start-End: 18-1553
ggcgggcaccggccgacatggcggcagcggtggcggctgcgctggcgcggcttttggcggcctttctgctcctcgcggcccaggtggcctgtgagtacggcatggtgcacgtggtctcccaggccgggggccccgaaggcaaagactactgcatcctctacaacccgcagtgggcccatcttccgcacgacctcagcaaggcatctttcctgcagctgcgcaactggacggcctccctgctctgctccgcagccgacctccccgcccgtggcttcagcaaccagatcccgctggtggcgcgggggaactgcaccttctatgagaaagtgaggctggcccagggcagcggagcacgcgggctgctcatcgtcagcagggagaggctggtccccccggggggtaataagacgcagtatgatgagattggcattcccgtggccctgctcagctacaaagacatgctggacatcttcacgcgtttcggccgcacggtgagggcggcgctgtatgcgcctaaggagccggtgctggactacaacatggtcatcatcttcatcatggctgtgggcaccgtcgccatcggcggctactgggccgggagtcgggacgtgaagaaaaggtacatgaagcacaagcgcgacgatgggcccgagaagcaggaggacgaggcggtggacgtgacgccggtgatgacctgcgtgtttgtggtgatgtgctgctccatgctggtgctgctctactatttctacgatctcctcgtgtacgtggtcatcgggatcttctgcctggcctccgccaccggcctctacagctgcctggcgccctgtgtgcggcggctgcccttcggcaagtgcaggatccccaacaacagcctgccctacttccacaagcgcccgcaggcccgtatgctgctcctggcgctcttctgcgtggccgtcagcgtggtgtggggcgtcttccgcaacgaggaccagtgggcctgggtcctccaggatgccctgggcatcgccttctgcctctacatgctgaagaccatccgtctgcccaccttcaaggcctgcacgctgctgctgctggtgctgttcctctacgacatcttcttcgtgttcatcacgcccttcctgaccaagagtgggagcagcatcatggtggaggtggccactgggccctcggactcagccacccgtgagaagctgcccatggtcctgaaggtgcccaggctgaactcctcacctctggccctgtgtgaccggcccttctccctcctgggtttcggagacattttggtgccagggctgctggtggcctactgccacaggtttgacatccaggtacagtcctccagggtatacttcgtggcctgcaccatcgcctatggcgttggcctccttgtgacattcgtggcactggccctgatgcagcgtggccagcccgctctcctctacctggtgccctgcacgctggtgacgagctgcgctgtggcgctctggcgccgggagctgggcgtgttctggacgggcagcggctttgcggtgaataccagtttgctctgactgtgagaaatactcgcctagtgagccctaactagagttaaaaaagtcctacctccatctccgtgggccccagcaccagccgacggcccgcagcctcccaaagactctgccacgccactctccccgcagccgcccagcgaagaaccagccacatccccctggcctgctgagcagtccccaaaatcacgcacgtccgaggagatgggggctggagcccccatgcgggagcctgggagcccagctgaatccgagggccgggaccaggcccagccgtccccggtaacccagcctggcgcctcggcctaggggaggggtgagacgctcgctgccgtgcccgccacaccaagatgttggggctgcctggcgcccactggagacagacagacagacgcctgtcccccgggaccgaggcctgtgccgtccccacccgccccaacatggtgctcatccttgccgagacccctgcggtctgtgcccgcgcccagcccagctgccccggctgcacgcctgctgctcccagctcgcccggctgccacaagctctctgcgggtccatcctccccaccggggtccgtcctcgcaggccctgcccggcctctctgcagaccctcaagcgtcgtctgcatgagtgagcaggcgtgggtggactctggccgcggccacacttggtgctcaccagctgcttcggccttcaggtgacctccctccccacggcatcctgctctccgggtggaagagcagctttctgtctcccagaaggcatcgcttttccctcttgagcagatcggagcccctgggaggtttggaagctgcctccaagcctaggacacggaccagtggccggggcggcctctggcccctgacgctggctgagacaggcccgtggggcggggttttggggcgtgaacaaggctggcagtaagtggacaagctgctcccctggctaaggccctgccctgccctcagccagaggtgcctggccatgcctgcacactcctccccattttaataaatggtcgcaacttctagaa

SEQ ID NO: 181493 - DNA, 496 bp, Homo sapiens
  Payload ID: 15747
  Gene Symbol: SPPL2B
  Gene Name: signal peptide peptidase like 2B
  ENST ID: ENST00000586332
  CDS Start-End: 52-297
ggggcgttgctgggaaacatctgccgttggttgcggcgggcaccggccgacatggcggcagcggtggcggctgcgctggcgcggcttttggcggcctttctgctcctcgcggcccaggtggcctgtgagtacggcatggtgcacgtggtctcccaggccgggggccccgaaggcaaagactactgcatcctctacaacccgcagtgggcccatcttccgcacgacctcagcaaggcaatgcctggccgtggtggggctgcggtggggacccacttggtcttgctgagtgatctgtgacggctcgcggggtggctcaggtatcaggggacagccatgtctgtgaggactccggccccgctcagatgaggcagcccagcccgtcgcccagggtccggctgtgggagctgcagtagggatggctctgcctaggtgggccgaggccgtgcggggctttagtctttcctgcagctgcgcaactggacggcctccctgctct

SEQ ID NO: 181494 - DNA, 2459 bp, Homo sapiens
  Payload ID: 15747
  Gene Symbol: SPPL2B
  Gene Name: signal peptide peptidase like 2B
  Uniprot ID: Q8TCT7
  ENST ID: ENST00000618220
  CDS Start-End: 15-974
gggcaccggccgacatggcggcagcggtggcggctgcgctggcgcggcttttggcggcctttctgctcctcgcggcccaggtggcctgtgagtacggcatggtgcacgtggtctcccaggccgggggccccgaaggcaaagactactgcatcctctacaacccgcagtgggcccatcttccgcacgacctcagcaaggcatctttcctgcagctgcgcaactggacggcctccctgctctgctccgcagccgacctccccgcccgtggcttcagcaaccagatcccgctggtggcgcgggggaactgcaccttctatgagaaagtgaggctggcccagggcagcggagcacgcgggctgctcatcgtcagcagggagaggctggtccccccggggggtaataagacgcagtatgatgagattggcattcccgtggccctgctcagctacaaagacatgctggacatcttcacgcgtttcggccgcacggtgagggcggcgctgtatgcgcctaaggagccggtgctggactacaacatggtcatcatcttcatcatggctgtgggcaccgtcgccatcggcggctactgggccgggagtcgggacgtgaagaaaaggtacatgaagcacaagcgcgacgatgggcccgagaagcaggaggacgaggcggtggacgtgacgccggtgatgacctgcgtgtttgtggtgatgtgctgctccatgctggtgctgctctactatttctacgatctcctcgtgtacgtggtcatcgggatcttctgcctggcctccgccaccggcctctacagctgcctggcgccctgtgtgcggcggctgcccttcggcaagtgcaggatccccaacaacagcctgccctacttccacaagcgcccgcaggcccgtatgctgctcctggcgctcttctgcgtggccgtcagcgtggtgtggggcgtcttccgcaacgaggaccagtaagtgctgcttcccccgggccccggcgggcagcggagtcctcgggtgcaccagggctcctggggccctgactccctgccctccctggaggccgccccagcctggagctgcttcagcaccgcgtgatgaagagccctggccccgggctgctctgacagggctgcgagggcgtttcacctggggtttgtccgggtgtcatgggaaccctgactggaatccgggaggagaggccggagcccctgtggccaggagccacgtcctccagcctggatgggactcctttgtggggcatcgctgcccagggccacagtctgtcccccgctgtccctttcctggcacccacgtgcacgccgcaggttcgaggcccagggtgtgggcaccagggcacccggtcctcttggtcatgactgctgcggcttctgagcagtggtggaggtggggcaggcactgctccccccacgctcacctcccacgtggcctggacttgtggctgcctcccgctggccgggcctcccccatgaggccgagtgcctggtgccgtgttgggaggacagagctggcccgtccccgcccggtccccaccgctgtcgctgataccatctggcacttcctcccagccttcctgaggcagccaagtacgcttggctttggtgtgtattggagccacggcacgtttaactggcagaaggaagatgtgaaaatattttgaatcctttgtacacaaagagaaaatgaatcttttcagttatttccaagccaggaaactcgctccgtcacatgaagttagagcaggcctcagtcagctgggcgcaggggctcacgcctgggatcccagcatttggtaggccaaggcaggacgatcactttgcccaggagttcaagaccagcctgggcaacaagcgagacgccctatttaagaaataatataaaatcagaaaaaataactggccgcagttctctgggtgcttgaagtacgtggcgcctggaattggctgtaccagcgtctcccatggaggcctctgctgttagcagccgccccgccctggagatgtttttatcccattttcaaatgaagcctttgatgtttgagacgctgaggaacgctggggaactcgtccagcaagtgacaggcagagcctgcattgggggcaggggccagcggggaggggactctggggcttcgtggggccaggagagagccgaagttgcggctggctgcaggggccgtggccttgtgcaggaggcagttctgtgctttgccccagggcaccaaccgcatggcagccccacccactgtggacccagaggttctttgaggaaacctggtgtggcacaagttttaatttaataaacagtttgggcacgggggctcatgcctgtaatcccagcactttgggaggtgaggcgggcagatcacttgaggtcaggagtttgagaccagcctggccaacatgacaaaaccccatctctactaaaaatacaaaaaaa

SEQ ID NO: 181495 - DNA, 1559 bp, Homo sapiens
  Payload ID: 15747
  Gene Symbol: SPPL2B
  Gene Name: signal peptide peptidase like 2B
  ENST ID: ENST00000614794
  CDS Start-End: 234-1109
gttggttgcggcgggcaccggccgacatggcggcagcggtggcggctgcgctggcgcggcttttggcggcctttctgctcctcgcggcccagtagagacgaggtttcaccatgttggtcaggctggtctcgaacttcagacctcaggtgatccacctgcttcggccacccaaagtgctgggatgacaggcgtgagccaccgtgcccggccccgaggtggcctgtgagtacggcatggtgcacgtggtctcccaggccgggggccccgaaggcaaagactactgcatcctctacaacccgcagtgggcccatcttccgcacgacctcagcaaggcatctttcctgcagctgcgcaactggacggcctccctgctctgctccgcagccgacctccccgcccgtggcttcagcaaccagatcccgctggtggcgcgggggaactgcaccttctatgagaaagtgaggctggcccagggcagcggagcacgcgggctgctcatcgtcagcagggagaggctggtccccccggggggtaataagacgcagtatgatgagattggcattcccgtggccctgctcagctacaaagacatgctggacatcttcacgcgtttcggccgcacggtgagggcggcgctgtatgcgcctaaggagccggtgctggactacaacatggtcatcatcttcatcatggctgtgggcaccgtcgccatcggcggctactgggccgggagtcgggacgtgaagaaaaggtacatgaagcacaagcgcgacgatgggcccgagaagcaggaggacgaggcggtggacgtgacgccggtgatgacctgcgtgtttgtggtgatgtgctgctccatgctggtgctgctctactatttctacgatctcctcgtgtacgtggtcatcgggatcttctgcctggcctccgccaccggcctctacagctgcctggcgccctgtgtgcggcggctgcccttcggcaagtgcaggatccccaacaacagcctgccctacttccacaagcgcccgcaggcccgtatgctgctcctggcgctcttctgcgtggccgtcagcgtggtgtggggcgtcttccgcaacgaggaccagtaagtgctgcttcccccgggccccggcgggcagcggagtcctcgggtgcaccagggctcctggggccctgactccctgccctccctggaggccgccccagcctggagctgcttcagcaccgcgtgatgaagagccctggccccgggctgctctgacagggctgcgagggcgtttcacctggggtttgtccgggtgtcatgggaaccctgactggaatccgggaggagaggccggagcccctgtggccaggagccacgtcctccagcctggatgggactcctttgtggggcatcgctgcccagggccacagtctgtcccccgctgtccctttcctggcacccacgtgcacgccgcaggttcgaggcccagggtgtgggcaccagggcacccggtcctcttggtcatgactgctgcggcttctgagcagtggtggaggtggggcaggcactgctc

SEQ ID NO: 181496 - DNA, 1017 bp, Homo sapiens
  Payload ID: 15747
  Gene Symbol: SPPL2B
  Gene Name: signal peptide peptidase like 2B
  ENST ID: ENST00000621568
  CDS Start-End: 38-457
aaacatctgccgttggttgcggcgggcaccggccgacatggcggcagcggtggcggctgcgctggcgcggcttttggcggcctttctgctcctcgcggcccaggtggcctgtgagtacggcatggtgcacgtggtctcccaggccgggggccccgaaggcaaagactactgcatcctctacaacccgcagtgggcccatcttccgcacgacctcagcaaggcatctttcctgcagctgcgcaactggacggcctccctgctctgctccgcagccgacctccccgcccgtggcttcagcaaccagatcccgctggtggcgcgggggaactgcaccttctatgagaaagtgaggctggcccagggcagcggagcacgcgggctgctcatcgtcagcagggagaggctgctacaaagacatgctggacatcttcacggcagcgtttcggccgcacggtgagggcggcgctgtatgcgcctaaggagccggtgctggactacaacatggtcatcatcttcatcatggctgtgggcaccgtcgccatcggcggctactgggccgggagtcgggacgtgaagaaaaggtacatgaagcacaagcgcgacgatgggcccgagaagcaggaggacgaggcggtggacgtgacgccggtgatgacctgcgtgtttgtggtgatgtgctgctccatgctggtgctgctctactatttctacgatctcctcgtgtacgtggtcatcgggatcttctgcctggcctccgccaccggcctctacagctgcctggcgccctgtgtgcggcggctgcccttcggcaagtgcaggatccccaacaacagcctgccctacttccacaagcgcccgcaggcccgtatgctgctcctggcgctcttctgcgtggccgtcagcgtggtgtggggcgtcttccgcaacgaggaccagtgggcctgggtcctccaggatgccctgggcatcgccttctgcctctacatgctgaagaccatccgtctgcccaccttcaag

SEQ ID NO: 181497 - DNA, 2238 bp, Homo sapiens
  Payload ID: 15748
  Gene Symbol: SPPL2C
  Gene Name: signal peptide peptidase like 2C
  Uniprot ID: Q8IUH8
  ENST ID: ENST00000329196
  CDS Start-End: 73-2127
aaagggccacgcctgcccctgggaggggtattgggctgccgcccgcagatgttgcagtaggaactgaagaagatggcgtgcctgggcttcctcctccccgtgggcttcctcctcctcatcagcaccgtggccgggggaaagtacggcgtggcccacgtggtgtcggagaattggagcaaggactactgtatcctgttcagctccgactacatcaccctcccccgggacctgcaccacgccccactcctgcccctgtatgatggcaccaaggcaccctggtgcccgggtgaggattccccccaccaggcccagctccgctcccccagccagcggcccctccgccagaccactgccatggtcatgaggggtaactgcagcttccacacgaaaggctggctggctcagggccaaggtgcccacgggctgctcatcgtgagccgggtcagtgaccaacagtgctcagacaccaccctggcaccccaggatccccgccagcccctggcagacctcaccatccctgtggctatgctccactatgctgacatgctggacatcctcagccacactcgtggggaggccgtcgtccgcgtggccatgtacgcacccccagagcccatcatcgactacaacatgctggtcatcttcatcctggctgtgggcacagtggctgcaggcggctactgggccggcctgaccgaagccaaccggctacagcggcgccgtgcccgaagaggaggggggtctggtggtcaccatcagctgcaggaagctgcagcagctgagggagcccagaaggaagataatgaggacatcccagtggacttcacgccggccatgacaggcgtggtggtcaccctgtcctgctcgctcatgctgctgctctacttcttctatgaccactttgtctatgtcaccattgggatctttggcctgggtgctggcattggcctctacagctgcctgtcacccctggtgtgccgcctgtccctgcggcaataccagaggcctccgcacagcctctgggcctctctgccgctgcctctgctgctgctggcgagcctgtgcgcaaccgtgatcatcttctgggtggcctaccgcaatgaggaccgctgggcgtggctcctgcaggacacactgggcatttcctactgcctgttcgtcctgcaccgtgtgcggctgcccactctcaagaactgctcctccttcctgctggccctgctggcctttgatgtcttctttgtcttcgtcacccccttcttcaccaaaaccggtgagagcatcatggcgcaggttgccttgggccctgcagagtcttcaagccatgagaggctgcccatggtactcaaagtgccccggctaagagtctccgccttgaccctgtgcagccagcccttctccatccttggcttcggtgacattgtggtccccggcttcctggttgcttactgttgccgctttgatgtgcaagtctgctcccgtcagatctacttcgtggcctgcaccgtggcctatgctgtgggcctgctggtcacattcatggccatggtcctcatgcagatgggccaacctgccttgctctacctagtgtccagcaccctgctcaccagcctggctgtggctgcctgccgccaagagctcagcctcttctggactggccagggcagagctaagatgtgtgggctcggctgtgccccttcagctggctctaggcagaagcaggagggcgcagcagatgcccacacagccagcacacttgagagaggcaccagccgaggagcaggggacttagacagcaaccctggagaagacaccactgagattgtcaccatatctgagaatgaagccaccaatccagaggaccgcagtgatagctccgagggctggagtgacgcccacttggatcctaatgagctgcccttcatcccccctggggcctcggaggagctgatgccactgatgccaatggccatgctgatcccactcatgcccctgatgcccccgccctcagagctgggccatgtccatgcccaggcccaggcccacgagactggcctgccctgggcgggactccacaagaggaagggtttgaaagtaagaaagagcatgtcgacccaggctcccttgtgaactggaggcactgggacacacgcctctcaaagggctggtggaacattgcagagcaaagccatgcatggcaacaagaaatcagggtatcaaagagatttcatatctacccaa

SEQ ID NO: 181498 - DNA, 2238 bp, Homo sapiens
  Payload ID: 15748
  Gene Symbol: SPPL2C
  Gene Name: signal peptide peptidase like 2C
  ENST ID: ENST00000610319
  CDS Start-End: 73-2127
aaagggccacgcctgcccctgggaggggtattgggctgccgcccgcagatgttgcagtaggaactgaagaagatggcgtgcctgggcttcctcctccccgtgggcttcctcctcctcatcagcaccgtggccgggggaaagtacggcgtggcccacgtggtgtcggagaattggagcaaggactactgtatcctgttcagctccgactacatcaccctcccccgggacctgcaccacgccccactcctgcccctgtatgatggcaccaaggcaccctggtgcccgggtgaggattccccccaccaggcccagctccgctcccccagccagcggcccctccgccagaccactgccatggtcatgaggggtaactgcagcttccacacgaaaggctggctggctcagggccaaggtgcccacgggctgctcatcgtgagccgggtcagtgaccaacagtgctcagacaccaccctggcaccccaggatccccgccagcccctggcagacctcaccatccctgtggctatgctccactatgctgacatgctggacatcctcagccacactcgtggggaggccgtcgtccgcgtggccatgtacgcacccccagagcccatcatcgactacaacatgctggtcatcttcatcctggctgtgggcacagtggctgcaggcggctactgggccggcctgaccgaagccaaccggctacagcggcgccgtgcccgaagaggaggggggcctggtggtcaccatcagctgcaggaagctgcagcagctgagggagcccagaaggaagataatgaggacatcccagtggacttcacgccggccatgacaggcgtggtggtcaccctgtcctgctcgctcatgctgctgctctacttcttctatgaccactttgtctatgtcaccattgggatctttggcctgggtgctggcattggcctctacagctgcctgtcacccctggtgtgccgcctgtccctgcggcaataccagaggcctccgcacagcctctgggcctctctgccgctgcctctgctgctgctggcgagcctgtgcacaaccgtgatcatcttctgggtggcctaccgcaatgaggaccgctgggcgtggctcctgcaggacacactgggcatttcctactgcctgttcgtcctgcaccgtgtgcggctgcccactctcaagaactgctcctccttcctgctggccctgctggcctttgatgtcttctttgtcttcgtcacccccttcttcaccaaaaccggtgagagcatcatggcgcaggttgccttgggccctgcagagtcttcaagccatgagaggctgcccatggtactcaaagtgccccggctaagagtctccgccttgaccctgtgcagccagcccttctccatccttggcttcggtgacattgtggtccccggcttcctggttgcttactgttgcccctttgatgtgcaagtctgctcccgtcaggtctacttcgtggcctgcactgtggcctatgctgtgggcctgctggtcacattcatggccatggtcctcatgcagatgggccaacctgccttgctctacctagtgtccagcaccctgctcaccagcctggctgtggctgcctgccgccaagagctcagcctcttctggactggccagggcagagctaagatgtgtgggctcggctgtgccccttcggctggctctaggcagaagcaggagggcgcagcagacgcccacacagccagcacacttgagagaggcaccagccgaggagcaggggacttagacagcaaccctggagaagacaccactgagattgtcaccatatctgagaatgaagccaccaatccagaggaccgcagtgatagccccgagggctggagtgacgcccacttggatcctaatgagctgcccttcatcccccctagggcctcggaggagctgatgccactgatgccaatggccatgctgatcccactcatgcccctgatgccccggccctcagagctgggccacgtccatgcccaagcccaggcccacgagactggcctgccctgggcgggactccacaagaggaagggtttgaaagtaagaaagagcatgtcgacccaggctcccttgtgaactggaggccctgggacacacgcctctcaaagggctggtggaacattgcagagcaaagccatgcatggcaacaagaaatcagggcatcaaagagatttcatatctacccaa

SEQ ID NO: 181499 - DNA, 2238 bp, Homo sapiens
  Payload ID: 15748
  Gene Symbol: SPPL2C
  Gene Name: signal peptide peptidase like 2C
  ENST ID: ENST00000621383
  CDS Start-End: 73-2127
aaagggccacgcctgcccctgggaggggtattgggctgccgcccgcagatgttgcagtaggaactgaagaagatggcgtgcctgggcttcctcctccccgtgggcttcctcctcctcatcagcaccgtggccgggggaaagtacggcgtggcccacgtggtgtcggagaattggagcaaggactactgtatcctgttcagctccgactacatcaccctcccccgggacctgcaccacgccccactcctgcccctgtatgatggcaccaaggcaccctggtgcccgggtgaggattccccccaccaggcccagctccgctcccccagccagcggcccctccgccagaccactgccatggtcatgaggggtaactgcagcttccacacgaaaggctggctggctcagggccaaggtgcccacgggctgctcatcgtgagccgggtcagtgaccaacagtgctcagacaccaccctggcaccccaggatccccgccagcccctggcagacctcaccatccctgtggctatgctccactatgctgacatgctggacatcctcagccacactcgtggggaggccgtcgtccgcgtggccatgtacgcacccccagagcccatcatcgactacaacatgctggtcatcttcatcctggctgtgggcacagtggctgcaggcggctactgggccggcctgaccgaagccaaccggctacagcggcgccgtgcccgaagaggaggggggtctggtggtcaccatcagctgcaggaagctgcagcagctgagggagcccagaaggaagataatgaggacatcccagtggacttcacgccggccatgacaggcgtggtggtcaccctgtcctgctcgctcatgctgctgctctacttcttctatgaccactttgtctatgtcaccattgggatctttggcctgggtgctggcattggcctctacagctgcctgtcacccctggtgtgccacctgtccctgcggcaataccagaggcctccgcacagcctctgggcctctctgccgctgcctctgctgctgctggcgagcctgtgcgcaaccgtgatcatcttctgggtggcctaccgcaatgaggaccgctgggcgtggctcctgcaggacacactgggcatttcctactgcctgttcgtcctgcaccgtgtgcggctgcccactctcaagaactgctcctccttcctgctggccctgctggcctttgatgtcttctttgtcttcgtcacccccttcttcaccaaaaccggtgagagcatcatggcgcaggttgccttgggccctgcagagtcttcaagccatgagaggctgcccatggtactcaaagtgccccggctaagagtctccgccttgaccctgtgcagccagcccttctccatccttggcttcggtgacattgtggtccccggcttcctggttgcttactgttgccgctttgatgtgcaagtctgctcccgtcagatctacttcgtggcctgcaccgtggcctatgctgtgggcctgctggtcacattcatggccatggtcctcatgcagatgggccaacctgccttgctctacctagtgtccagcaccctgctcaccagcctggctgtggctgcctgccgccaagagctcagcctcttctggactggccagggcagagctaagatgtgtgggctcggctgtgccccttcggctggctctaggcagaagcaggagggcgcagcagatgcccacacagccagcacacttgagagaggcaccagccgaggagcaggggacttagacagcaaccctggagaagacaccactgagattgtcaccatatctgagaatgaagccaccaatccagaggaccgcagtgatagctccgagggctggagtgacgcccacttggatcctaatgagctgcccttcatcccccctggggcctcggaggagctgatgccactgatgccaatggccatgctgatcccactcatgcccctgatgcccccgccctcagagctgggccatgtccatgcccaggcccaggcccacgagactggcctgccctgggcgggactccacaagaggaagggtttgaaagtaagaaagagcatgtcgacccaggctcccttgtgaactggaggcactgggacacacgcctctcaaagggctggtggaacattgcagagcaaagccatgcatggcaacaagaaatcagggcatcaaagagatttcatatctacccaa

SEQ ID NO: 181500 - DNA, 4148 bp, Homo sapiens
  Payload ID: 15749
  Gene Symbol: SPPL3
  Gene Name: signal peptide peptidase like 3
  Uniprot ID: Q8TCT6
  ENST ID: ENST00000353487
  CDS Start-End: 505-1659
gcccccgcccctcctcccctcggcgggtgtgatcgagtggcctcgcctcatcgcctagcgcccccctcagtcgccgccgcctccgcccgccggccatgtcccccggccgccgccgccgccgcccgagcgcggcgctcccgcggccccgcgcgcagtgagcgcgggcccgtcttgccgttcgcccgccccagggcccccttgttctccgcgccgccgccgccgccatgttgggtttggagctgcagcggagccgccgccgccgccgcgggtgagggaggccgagagcggagcccgccccgccccggggcccagggagcggggccgcttcggagcccggcctctccccgccagccgccttcccggcccgccgtgcagccagcgagccagcgagcgagcaagcaagcaagcaccggaccccggccgcgccttcagctacggcccgagcgagcccgccgccgccgggcccggccacagcctgcagcggagcccacgagaggcagcgccatggcggagcagacctactcgtgggcctattccctggtggattccagtcaagtgtctacatttctgatttccattcttcttatagtctatggtagtttcaggtcccttaatatggactttgaaaatcaagataaggagaaagacagtaatagttcttctgggtctttcaatggcaacagcaccaataatagcatccaaacaattgactctacccaggctctgttccttccaattggagcatctgtctctcttttagtaatgttcttcttctttgactcagttcaagtagtttttacaatatgtacagcagttcttgcaacgatagcttttgcttttcttctcctcccgatgtgccagtatttaacaagaccctgctcacctcagaacaagatttcctttggttgctgtggacgtttcactgctgctgagttgctgtcattctctctgtctgtcatgctcgtcctcatctgggttctcactggccattggcttctcatggatgcactggccatgggcctctgtgtcgccatgatcgcctttgtccgcctgccgagcctcaaggtctcctgcctgcttctctcagggcttctcatctatgatgtcttttgggtatttttctcagcctacatcttcaatagcaacgtcatggtgaaggtggccactcagccggctgacaatccccttgacgttctatcccggaagctccacctggggcccaatgttgggcgtgatgttcctcgcctgtctctgcctggaaaactggtcttcccaagctccactggcagccacttctccatgttgggcatcggagacatcgttatgcctggtctcctactatgctttgtccttcgctatgacaactacaaaaagcaagccagtggggactcctgtggggcccctggacctgccaacatctccgggcgcatgcagaaggtctcctactttcactgcaccctcatcggatactttgtaggcctgctcactgctactgtggcgtctcgcattcaccgggccgcccagcccgcccttctctatttggtgccatttactttattgccactcctcacgatggcctatttaaagggcgacctccggcggatgtggtctgagcctttccactccaagtccagcagctcccgattcctggaagtatgatggatcacgtggaaagtgaccagatggccgtcatagtccttttctctcaactcatggtttgtttcctcttagagctggcctggtactcagaaatgtacctgtgtttaaggaactgccgtgtgactggatttggcatttaaagggagctcgtttgcaggagagaggtgctggagccctgtttggttccttctcttcctgcggatgtagaggtggggccccttccaagagggacaggcctctccccagcgcgccttcctcccacgtttttatggatctgcaccagactgttaccttctgggggagatggagatttgactgtttaaaaactgaaaacagcgaggagtctttctagaacttttgaacactaaaaggatgaaaaaaattagcaaaccgaagtttcttcaatgacccctcgagaactttgggaccagtttcctataggggactcagtttcagagaactgagacagaagctcttctgtcgttatattcttctttcctttttttggatttattaaatattttctgtggtgtgaagtgacttattaaatccacagacattgagtgacttcttacaacatccacataagaatttgttgtaatgagttcatgtccacccagatgttgtgttggcagtgaacaagggcacggtttttatacatacgtacatatatatatataaacacacacatagatatatatgaataaacaaaaatgaaatcctgctaagatcacgctgtgtagctgacaggggcttgctgtcgttttgagcatgtcgagcagtttactgtggcttccttgtatatggataagctgctgtccttccccttcacaactgaccccgcagttacaaactagtatagcatttgtgctgattgatgatagactcatggacttcaggagcccttacttggttttgatcagtgtagcaaattagggatgaagagttcaaaccttttggccctttctttcttttctaggcttctccctcgcagggtgttccgtagtttcttctcgagccaatgcatgtattatagcagcaggtgtctttgtgctttctcatcatagtaacgtactacttgtaaatacatttttctattttctatttttttgtatttttttttttgacattttgtttcattggtgtgctgtatattttccatgccctcactcctttaagaaaaaaaaaaaggaaaaaagcaacacaatcctgtccttgctgttgtgattatagtcttggtttacctgtggtgacaaccgggtgttggggacacatgtcaaatgcccctctgagatgggccctaaattccagtaactggggaaagaaccagctgctgtgtcctgagagcctggccctgtgctgtggtctctgctgcaagcccagatttctgggagtaactagtgttaggtctgctgacctttacctaagcagcccctgcctggtaagaaggtgcccattgttcagaggcaaagagaagcctgcggttggcatgaggatgcctgacaacaaaggctggagaagggccctgagttccagcctctccccaagggtccccgccccagtggctgcctctgtcttgacctgtgtaatgaattagtgtgctgtgtcactgtggcttgaagtcactgtggatcgagctcacagggggcacccatcctgttgtcaacagagtctgaagcagtcagggtgttggattcctctgttgttgtcatcaattcctgctgaggggtttctggggttttgtttttaataaatgactcctttgtagcctttgtcacataatcttcactttggttgttggtaccaaacagagctcccagccatctcctccctgttctggaagactgatgggaagactctgtctgtccccagacctggtcatctgcagctctggcccagtcatagatacatcaaagaactgaagcttctgctgtccacagaactcaaaactgcctctgcattgggtgaagactaaaaatccacttgcggactctcccttccttccttctcagccctcgaggatgcatatagctaattaagcaggcccagagacagagaggggggctccaaaatgactcggattaagggcaagtgccagtgatgggtagaaataacgttatccttcatgcctgtaatcccagcactttgggaggccgaggcaggtggatcacaaggttgggagctcgagaccagcctggccaacatggtgaaaccccgtctctactaaaaacacaaaaattagctgggcatggtggcaggcgcctgtaatcccagctatttgggaggctgaggcagaagaatcgcttgaacctggaaggcggaggttgcagtgagcagagattgcgccactgcactcaagtctgggcgacagggtgagactccatctcaaaaaaaaaaaaaaaaaggaaatgttatcctggcagtgggtcattttaatttttctgtctttgttttcataagaaaattaaattccagacagaaggaacgtc

SEQ ID NO: 181501 - DNA, 636 bp, Homo sapiens
  Payload ID: 15749
  Gene Symbol: SPPL3
  Gene Name: signal peptide peptidase like 3
  ENST ID: ENST00000543608
  CDS Start-End: 144-636
agtggagcggccgccgcttggctctgggacagggagcgcagggagagttggtgagggcctattccctggtggattccagtcaagtgtctacatttctgatttccattcttcttatagtctatggtagtttcaggtcccttaatatggactttgaaaatcaagataaggagaaagacagtaatagttcttctgggtctttcaatggcaacagcaccaataatagcatccaaacaattgactctacccaggctctgttccttccaattggagcatctgtctctcttttagtaatgttcttcttctttgactcagttcaagtagtttttacaatatgtacagcagttcttgcaacgatagcttttgcttttcttctcctcccgatgtgccagtatttaacaagaccctgctcacctcagaacaagatttcctttggttgctgtggacgtttcactgctgctgagttgctgtcattctctctgtctgtcatgctcgtcctcatctgggttctcactggccattggcttctcatggatgcactggccatgggcctctgtgtcgccatgatcgcctttgtccgcctgccgagcctcaaggtctcctgcctgcttctctcagggcttctcatctatgatgtct

SEQ ID NO: 181502 - DNA, 508 bp, Homo sapiens
  Payload ID: 15749
  Gene Symbol: SPPL3
  Gene Name: signal peptide peptidase like 3
  ENST ID: ENST00000543854
  CDS Start-End: 202-508
agtggagcggccgccgcttggctctgggacagggagcgcagggagagttggtgagggcctattccctggtggattccagtcaagtgtctacatttctgatttccattcttcttatagtctatggtagtttcaggcatccaaacaattgactctacccaggctctgttccttccaattggagcatctgtctctcttttagtaatgttcttcttctttgactcagttcaagtagtttttacaatatgtacagcagttcttgcaacgatagcttttgcttttcttctcctcccgatgtgccagtatttaacaagaccctgctcacctcagaacaagatttcctttggttgctgtggacgtttcactgctgctgagttgctgtcattctctctgtctgtcatgctcgtcctcatctgggttctcactggccattggcttctcatggatgcactggccatgggcctctgtgtcgccatgatcgcctttgtccgcctgccgagcctcaaggtct

SEQ ID NO: 181503 - DNA, 763 bp, Homo sapiens
  Payload ID: 15749
  Gene Symbol: SPPL3
  Gene Name: signal peptide peptidase like 3
  ENST ID: ENST00000536996
  CDS Start-End: 215-763
gtgtttcctgggcaggaggactcgaaggggtggagagaggcaggccagggcaaagaggccctggatggttgaaagaatagaaaactcagtggtcaagaaatggggaaaatgaaaatgttttactagggcctattccctggtggattccagtcaagtgtctacatttctgatttccattcttcttatagtctatggtagtttcaggtcccttaatatggactttgaaaatcaagataaggagaaagacagtaatagttcttctgggtctttcaatggcaacagcaccaataatagcatccaaacaattgactctacccaggctctgttccttccaattggagcatctgtctctcttttagtaatgttcttcttctttgactcagttcaagtagtttttacaatatgtacagcagttcttgcaacgatagcttttgcttttcttctcctcccgatgtgccagtatttaacaagaccctgctcacctcagaacaagatttcctttggttgctgtggacgtttcactgctgctgagttgctgtcattctctctgtctgtcatgctcgtcctcatctgggttctcactggccattggcttctcatggatgcactggccatgggcctctgtgtcgccatgatcgcctttgtccgcctgccgagcctcaaggtctcctgcctgcttctctcagggcttctcatctatgatgtcttttgggtatttttctcagcctacatcttcaatagcaacgtcatggtgaaggtggcc

SEQ ID NO: 181504 - DNA, 531 bp, Homo sapiens
  Payload ID: 15749
  Gene Symbol: SPPL3
  Gene Name: signal peptide peptidase like 3
  ENST ID: ENST00000540091
  CDS Start-End: 333-531
attccttgagaggatcagctaagatggagagagtatttgtggtggacttgttgactttgaagaacctcctgtaggccatctagatggagaaaatcaataggcagttagaaaaatggaaacggggaattcaggagatgcaggctttacctcatcaccgagcaaaaccagtaaaatactattagagattgaaatgtaactggataaaagtctgattattgagacttttgccattggcacagatctgggcctattccctggtggattccagtcaagtgtctacatttctgatttccattcttcttatagtctatggtagtttcaggtcccttaatatggactttgaaaatcaagataaggagaaagacagtaatagttcttctgggtctttcaatggcaacagcaccaataatagcatccaaacaattgactctacccaggctctgttccttccaattggagcatctgtctctcttttagtaatgttcttcttctttgactcagttcaagtagtttttacaatatgtacagcag

SEQ ID NO: 181505 - DNA, 663 bp, Homo sapiens
  Payload ID: 15749
  Gene Symbol: SPPL3
  Gene Name: signal peptide peptidase like 3
  ENST ID: ENST00000543181
  CDS Start-End: 308-663
taaggatattgtttttcaagatactatcaacatagaagagatcttttaagagggagaagagtttttcaatcaaggaaatgaaaccagtaaaacattttctcaagatttttctgactataaaatgttaagcttccttcgttttgttgtaagagtgacagcacagtgggtcagaggatagatcttagacttcatcgtcagaattcttgatcatctataactggcctattccctggtggattccagtcaagtgtctacatttctgatttccattcttcttatagtctatggtagtttcaggtcccttaatatggactttgaaaatcaagataaggagaaagacagtaatagttcttctgggtctttcaatggcaacagcaccaataatagcatccaaacaattgactctacccaggctctgttccttccaattggagcatctgtctctcttttagtaatgttcttcttctttgactcagttcaagtagtttttacaatatgtacagcagttcttgcaacgatagcttttgcttttcttctcctcccgatgtgccagtatttaacaagaccctgctcacctcagaacaagatttcctttggttgctgtggacgtttcactgctgctgagttgctgtcattctctctgtctgtcatgctcgtcctcat

SEQ ID NO: 181506 - DNA, 2258 bp, Homo sapiens
  Payload ID: 15750
  Gene Symbol: SCUBE1
  Gene Name: signal peptide, CUB domain, EGF-like 1
  ENST ID: ENST00000290460
  CDS Start-End: 63-1106
ggccggtcggtcgggtccccgcgccccgcacgcccgcacgcccagcggggcccgcattgagcatgggcgcggcggccgtgcgctggcacttgtgcgtgctgctggccctgggcacacgcgggcggctggccgggggcagcgggctcccagggtcagtcgacgtggatgagtgctcagagggcacagatgactgccacatcgatgccatctgtcagaacacgcccaagtcctacaaatgcctctgcaagccaggctacaagggggaaggcaagcagtgtgaagacattgacgagtgtgagaatgactactacaatgggggctgtgtccacgagtgcatcaacatcccggggaactacaggtgtacctgctttgatggcttcatgctggcacacgatggacacaactgcctggatgtggacgagtgtcaggacaataatggtggctgccagcagatctgcgtcaatgccatgggcagctacgagtgtcagtgccacagtggcttcttccttagtgacaaccagcatacctgcatccaccgctccaatgagggtatgaactgcatgaacaaagaccatggctgtgcccacatctgccgggagacgcccaaaggtggggtggcctgcgactgcaggcccggctttgaccttgcccaaaaccagaaggactgcacactaacctgtaattatggaaacggaggctgccagcacagctgtgaggacacagacacaggccccacgtgtggttgccaccagaagtacgccctccactcagacggtcgcacgtgcatcgagaaggatgaggctgcaattgagcgctctcagttcaatgccacgtcagtagctgatgtggacaagcgggtgaaacggcggctactcatggagacgtgcgcagtcaataacggaggctgcgaccggacatgcaaggacacagccactggcgtgcgatgcagctgccccgttggattcacactgcagccggacgggaagacatgcaaaggtcagcatgtggagctgtgtgggtgcccctgcctgtactggcctggccaagagcctccgtgtgcttgcatagccgggcccagggctgggctgaacgggggccacgtgtagctgtgggaaaggacacgtggcaatcatttgctttgctgttggagaggccaggaagagggagggctggccagcagcagggtccccagcagagttcgagagaacacaggtcccacggcacatcagcaggttcctgggccaaaaaggcactgatgtcagagaatttggctgcacgctgggttaaacagttaagccagcgtctctactgtgggacttcctgggccctcagtgatagtgtggcttcccaaggcgcgtagaatgtagcgcgtttccgaaccccttgacctttggttgcagtgggtcttgcagagctgatggggacagtctggtgttgggccatctgggacacacaggtctactcatgccaggaaaaataaggacagtgtgtcactactaggggggcgaggctagggggatcccatctgaaaagataaggactcaggacttctgcttgccatcagaaaatgaggagtcaggaagacctgagagtgactggttgaaggaaggagggacagggctggcctgctggtggctggcagtgagggaaggcagaggtgtatcctcccacttgtcccctgagtcaccccacaaagacttactgagtacctcctgggttgaggggaccctcaggaaacaggaagcccagggagctgggagaggagagctgggtgggctctcgagacagccctgcagatgaggaggtccagctacccccaaaggacagacggagccccaagaagctgtgggccctggggcagggtgttaggcctgagtgccggagccctctgtgcagaagggtgaggggcagtgctcagtgcccccagcatcactccagaccaccctccaaacgcccccaccccagcgctgggcagtacccccacactctgccaggaagggagagcctagagagcagggcgtggaggggagaggaactggaacttccaaagtcccatcggggaaaatattgaaagtggaggttagggtgacttaaaatagcttgaggtggactttttttaagcctgtaaaaataaatgtatttttgtacagtgtatgacttcttccttgccaacttgctgggaagaaccgagtgattattgacagaaataacagtgcttccgcctgtttatttgaaaataaagcccttctgtggccacc

SEQ ID NO: 181507 - DNA, 9808 bp, Homo sapiens
  Payload ID: 15750
  Gene Symbol: SCUBE1
  Gene Name: signal peptide, CUB domain, EGF-like 1
  Uniprot ID: Q8IWY4
  ENST ID: ENST00000360835
  CDS Start-End: 128-3094
ggctgggcggctcgggagcccgagcggtggcggagcggcgagcagcgagcagcgcctgcgggagcggccggtcggtcgggtccccgcgccccgcacgcccgcacgcccagcggggcccgcattgagcatgggcgcggcggccgtgcgctggcacttgtgcgtgctgctggccctgggcacacgcgggcggctggccgggggcagcgggctcccagggtcagtcgacgtggatgagtgctcagagggcacagatgactgccacatcgatgccatctgtcagaacacgcccaagtcctacaaatgcctctgcaagccaggctacaagggggaaggcaagcagtgtgaagacattgacgagtgtgagaatgactactacaatgggggctgtgtccacgagtgcatcaacatcccggggaactacaggtgtacctgctttgatggcttcatgctggcacacgatggacacaactgcctggatgtggacgagtgtcaggacaataatggtggctgccagcagatctgcgtcaatgccatgggcagctacgagtgtcagtgccacagtggcttcttccttagtgacaaccagcatacctgcatccaccgctccaatgagggtatgaactgcatgaacaaagaccatggctgtgcccacatctgccgggagacgcccaaaggtggggtggcctgcgactgcaggcccggctttgaccttgcccaaaaccagaaggactgcacactaacctgtaattatggaaacggaggctgccagcacagctgtgaggacacagacacaggccccacgtgtggttgccaccagaagtacgccctccactcagacggtcgcacgtgcatcgagacgtgcgcagtcaataacggaggctgcgaccggacatgcaaggacacagccactggcgtgcgatgcagctgccccgttggattcacactgcagccggacgggaagacatgcaaagacatcaacgagtgcctggtcaacaacggaggctgcgaccacttctgccgcaacaccgtgggcagcttcgagtgcggctgccggaagggctacaagctgctcaccgacgagcgcacctgccaggacatcgacgagtgctccttcgagcggacctgtgaccacatctgcatcaactccccgggcagcttccagtgcctgtgtcaccgcggctacatcctctacgggacaacccactgcggagatgtggacgagtgcagcatgagcaacgggagctgtgaccagggctgcgtcaacaccaagggcagctacgagtgcgtctgtcccccggggaggcggctccactggaacgggaaggattgcgtggagacaggcaagtgtctttctcgcgccaagacctccccccgggcccagctgtcctgcagcaaggcaggcggtgtggagagctgcttcctttcctgcccggctcacacactcttcgtgccagactcggaaaatagctacgtcctgagctgcggagttccagggccgcagggcaaggcgctgcagaaacgcaacggcaccagctctggcctcgggcccagctgctcagatgcccccaccacccccatcaaacagaaggcccgcttcaagatccgagatgccaagtgccacctccggccccacagccaggcacgagcaaaggagaccgccaggcagccgctgctggaccactgccatgtgactttcgtgaccctcaagtgtgactcctccaagaagaggcgccgtggccgcaagtccccatccaaggaggtgtcccacatcacagcagagtttgagatcgagacaaagatggaagaggcctcagacacatgcgaagcggactgcttgcggaagcgagcagaacagagcctgcaggccgccatcaagaccctgcgcaagtccatcggccggcagcagttctatgtccaggtctcaggcactgagtacgaggtagcccagaggccagccaaggcgctggaggggcagggggcatgtggcgcaggccaggtgctacaggacagcaaatgcgttgcctgtgggcctggcacccacttcggtggtgagctcggccagtgtgtgtcatgtatgccaggaacataccaggacatggaaggccagctcagttgcacaccgtgccccagcagcgacgggcttggtctgcctggtgcccgcaacgtgtcggaatgtggaggccagtgttctccaggcttcttctcggccgatggcttcaagccctgccaggcctgccccgtgggcacgtaccagcctgagcccgggcgcaccggctgcttcccctgtggagggggtttgctcaccaaacacgaaggcaccacctccttccaggactgcgaggctaaagtgcactgctcccccggccaccactacaacaccaccacccaccgctgcatccgctgccccgtcggcacctaccagcccgagtttggccagaaccactgcatcacctgtccgggcaacaccagcacagacttcgatggctccaccaacgtcacacactgcaaaaaccagcactgcggcggcgagcttggtgactacaccggctacatcgagtcccccaactaccctggcgactacccagccaacgctgaatgcgtctggcacatcgcgcctcccccaaagcgcaggatcctcatcgtggtccctgagatcttcctgcccatcgaggatgagtgcggcgatgttctggtcatgaggaagagtgcctctcccacgtccatcaccacctatgagacctgccagacctacgagaggcccatcgccttcacctcccgctcccgcaagctctggatccagttcaaatccaatgaaggcaacagcggcaaaggcttccaagtgccctatgtcacctacgatgaggactaccagcaactcatagaggacatcgtgcgcgatgggcgcctgtacgcctcggagaaccaccaggaaattttgaaagacaagaagctgatcaaggccctcttcgacgtgctggcgcatccccagaactacttcaagtacacagcccaggaatccaaggagatgttcccacggtccttcatcaaactgctgcgctccaaagtgtctcggttcctgcggccctacaaataaccggggggagcggccctgcctgggggtggcctggtccgcggagggtgcacctgccctccacagtgggagctgcatgggcctccacaccaccttgggaaccccatggcactgcccttcagggaagccgaccagcccatggagaccgagcccaggcacccttcggacccgctgcccctgtgggagcaccctgcttcaggaagcctccctccctccctctgcctcccttccccaggacaccaagagcgccctctcctgagccctggcagaccgactgcaggtagcaggattgcaggaccctctgcctggcctggcgtttcaggagagaggggaagtggggcctgtgctctgggaggcgtggtcatccgagacaggagtccaggggagagaggaggggacaaaggcgccgtctgggggaggtcgatgagcctgtgctggcatccgcgggccccacgctttgccaactcctccagccacaggcaaggccacggctccgggctgttgcgctctaagggttctgtgattggatggaacagagctgctggggaggagactggaagtttctgcattccttcaacagaacatttaatgaagtactctatatatatatataaatatatatataaatatatatatatacttctatttgtgggtactttaggaaaatgccctttggtcactgtaaatatgaattgtgaccccatcccttcccgcatgagcccagtgagtcccagcagctatcagcctccctgaacgattaaacagctcctcccagcatttgcatttgcccttctgtttctgtgaggccggcagcccttggggctggggagagcacagcttgccttggacttgcttctgaacacgaattcttcgagaactaggctcagatgctctgctggagtgttggcctcaccccagtccccttgccagcaacatcactgcccttggacgagactcagtggaagacacttcccctcggacccgttcccaggaggtgcaggggcccagcaataaacggcgaaaggggccttggctcttgccctgtggcagtgaccttggggtccgtactatgcccaggtgtcagcaggaaacaaggccttgctcacaggagcacaggctgtaccaccacaaggagcctcagagcggccagtgaggaaaggggagagagcagagcttgctgtcagaggccaggctcccagtgcagcctcctcttgctacgccatgccacccccattcacagggaaacctctttccttcctataaaggaaagaggttgaattgactcacatttccacatggcttgggaggcctcaggaaacttacaatcatggcggagggtgaaggggaagcaagcgccttcttcacaaggcagcaggagagagaagcaagcagggaaatgtcgggagaaagagagtctgggctgtgaccgagtgcatgtgtcccacccagccggaaggccagcgcctgggatggagccagcagaaccccatgccgaggtccaggaggccttgcctgctcttcatctgcctgcgagctgtaggacctgcatgggaaatggtctgtgtgtttcaggttaacaaatactgaaaatcccaaggaacctgggagaatctgaaaatgaactccagtcttcagctcgaagttgcctctagggttcctcctggtcacccccgggcccagcctggctggcgagaaacaaacacggtttgagaggctgtggcacactgaggaccacacagatggaggcagccaagtgaggtccctggaggttcagggcttggtgacgaggtaggccgtgatcacatattctacagtccaaaagagggcccggagctcagcaattactcacgccgtcacatgtgcccacagtagcgggctccgcggcgtggctcctgctgccatcagctgccttctctgctgaagtccaactcaagtcggagagagagtggagcctctgcacttggggagtaggtcagtgtcaactaacaagccctgccaggggccactgccgctcctctggtcacagtccacgcaggccagccctggtttctggaaagaggcctccctccctccctttgtggagccgtcagtcatccccaagatgagaggcgagcatcctgccgagtgagcctgcagcaacagctcctgaggaaggtgccgggaggggtgtcgcctcttcacgagtgttctccagagaatcagaacccagaggatacagacgtagatgtgtgaggggctgcattatgggaactggctcacagattctggaggccaacaagtcccacgatcggctgtctgcgattgggagaccaggagaagccacaccgtaactcagtctgagtccaaagcccgagaagccaggggccaccctgtgagtcccagcatccaaagccccgagaacgaggaagatggatgtcccagctcccaaagggaggattctcccttcctcctccttcttttctattggggccctcaacagattggatggagtggatgtcttcactcagtctgccaattcccatcctaacctcttctggaaacaccctagcatgttttcccagctagctgggtatccgttcacccaaccaagacgaccatgcaatcaaccatcacacttaaatgtttttgttttgttttttttgttttgttttttgttttctttttttgttttcttttttttttttttttttttttttgagatggagtctcgctctgtcacccaggctggagtgcagtggcgcgatcttggttcactgcaagctccgcctcccgggttcacgccattctcctgcctcagcctcccgagtagctgggactacaggcacccaccaccttgcccggctaatttttttgtatttttagtagagacagggtttcaccatattagccaggatggtctcgatctcctgacctcgtgatccgcccacctcggcctcccaaagtgctgggattacaggcgtgagccaccacgcccagccagggttttcttttttaatcctttccagaaacagaaagagctcttaacctctctgagctctttctgcaattcctttgggcgatttctgaaagttgccacccacgtactcacagatccactgcccgcctctcctcccctcatgttccaggactcaccaccgtggtcagaccatgcccagtgtgcccagggcaaagttggatgggcaggtgcagacgaggcccagccttcatcctgctttccctcgcaagcccttctatagctcccagcccacgggagaggccatgaggagcgcgaggtcgccagcagccccactgggcctcccacaccatctgagtgacttgaattccagggttgggctctgtcttgagtctccacatcagtctcacaccagggaacttgggggtcccccgttaaactacagctgaccctgggcctcagggcgggatggtcccaaggtgagctccgtggacagcaaagcgcatttcttccagttggcatgttgtcgaagccaatggcagcttgactgatgtgaggtggctattccacctggttcaagatggaggtgtagagaaaagggaagtggggaacaaggactgggccaggtaggacggatccacgtaacgaggcccaagaaaaaatggaagctgggggcagagagtccaggaggcccccatgctgtctgaggggaggccggcatagcccctcctcgactgtcgcctgagcagctgatgaggtccccagcgccgcacgctgtgctccagggagaggagccaagaagcaagcgggctgctgggagtccctgcactgccatctggccgggacggaggcgcctgcccggtctccaggctcctctgagcttgggtcagctcctaatggagcatggcaccccagggaaccagaggaactctgtgaagaaaggcatggaaaaccggggtgtctcccgcacagcttcccaggagtcaggtgggacccaggcgtggggggacctttctgccccacattcctggcattccccccaagtttatttctactttccagaaacaagccacgggaagggaaggaacctgcagcagggtttcgaagacagccaggccctccgtgattgagggctcatatagccgctgagggcagcctgcagccaggtggcctcacctgctgcccagaattaggctgtgccttttcccagtccttccccatgccagagcctctccccatctttccccgcgccagagcctcacagccacagccacaccaacctccctcctctcaagcagcagaatcagcctacgctccccagcctcagtgcccctgccccacacaggtcacgctggcaaggcgatgaccagtttccgaaacgctggatccccaagggtacagtgtggcccagtcctcccccacctccatggtggcccaggctgcagggctcacggtgggcccacggtggaggcctcaggcagctttctctccagctacccattggcttaggacacacagataaagtagagctgaaacacgggccaaaacatccccagacaaggatggcacaagaggccaaatttgaaggccttgggagagaagccatttcccctacctctaacgagcgtagttttctgtctgaatggccccccttttcatgcacgctcgttcttaagagacgcaccatccgcaggcagcgtctcagtgaagcctgtcccctgggcttgtccacggcaggaggcccctggcctgtttaagccataccgatgcttaatttacatttttggagttgaatattattccggtgcctccaccacccccagcagaaaaaataagatactgaaataagttgagtcatttcgcaaacatttactgagcacctcctgtgtgccaggctcctagaaagacagggagttggtgccctgcacagatgacaaactgccccagacagcagacagacaaacaaactgccccggacagcagacagacaaacagacacattgccctggacagcagagagacaaacagacacactgccccggacagcagacagacagacacgttgccccggacagcagacagaaaaactgccccggacagcagacagacagacaaactgccccagacagcagacagacaaactgccccggaaagcagacagcaaactgccccagacagcagacagacagacacacttccccagacagcagatagacagacaccctgccccagacagcagacaagctgccctggacagcctgctcaccttgcctgccacagtgcatgccccacagggagaagccttccttctcacccagggagtccagccattttcacctcccctggtccatgctcaggaagtctggtcaccctggcaaactgcacctgacattgaggtcccttttcaccaaagatgcacaaggtgtccatgccgagccgacatcattcaggccaagggcagaggatgtaatgaggggtggagtgaggatgtggagagagagcagagagcgcctcctattctaccgcggctgcctctgcccccacagcacccacagatccctggcccttccaggagtaagtcctgggcaggcagagctggggttggcctgatcccacctgccttgctcttggaaaggacatcaggtgtgggcaaagcatccttgaagcccagacaacacaggcatggcctgcgtgccctcccagcatctgctgcgatggcctcaaggcctctccagtcccctgctgcaccatgccactcagagcccctgagtgagccccctggaattgtctgcaccccccaagccccaacaggaagaagggaaaggtggggaagctgacgctcactcagtgcccactgggtgccaggctctgggctcaaccctctaatatccacacattccatccccccagccccatgtagatggtggggttaagaccattcttcagatgtggaaatgaaggctctgggagaccacaggacatgcccaaggcaaagagttggtagtccctggatttgggaatcaaactcaagcccatctaatccaagggtaggaaatgtctctaaaacgttgatcaatctgaagcttacagattggaaactgggccaggtcagccctggcggtggagtccagagacagagagaaggctgcagggaggggagagaacaggaggatcccgggccagggtgacttcagtgacattccttccctccttcacaagcacgaaaaactcgttcggagaaaagacagcttctgccttccctaccaggcggacagggtactcactgtgccgacgtgagcagacacagccagaggctcaagtgcccttgccgagtgtccccactgctcttggggaggccccggcacagccctgcagagatgcaagtaagagagtgcccagtgccctcggcagatgggtggcagaaagcaggaggaggaagagggagctgaccgatgccgggtgtcttactccgctgagatcagaacctccaacatgccgagcagacgcaggccacattgctcggggaacaggacaccagggcgctgtgctagcggcccgcagacttcacttctggctcctgtgagggcactgtattgtccagacgcttggcaacgactctgcctgcaagtggcaaataccaacataaccacatcttccttttagttgccacaaatattcagttttgttttatccatcatgtcccccatatgcatgtaatgaaacatttgtgaaaatcactttaataataaacaggaaatgaacct

SEQ ID NO: 181508 - DNA, 524 bp, Homo sapiens
  Payload ID: 15750
  Gene Symbol: SCUBE1
  Gene Name: signal peptide, CUB domain, EGF-like 1
  ENST ID: ENST00000449304
  CDS Start-End: 1-524
ccgggagacgcccaaaggtggggtggcctgcgactgcaggcccggctttgaccttgcccaaaaccagaaggactgcacactaacctgtaattatggaaacggaggctgccagcacagctgtgaggacacagacacaggccccacgtgtggttgccaccagaagtacgccctccactcagacggtcgcacgtgcatcgagaaggatgaggctgcaattgagcgctctcagttcaatgccacgtcagtagctgatgtggacaagcgggtgaaacggcggctactcatggagacgtgcgcagtcaataacggaggctgcgaccggacatgcaaggacacagccactggcgtgcgatgcagctgccccgttggattcacactgcagccggacgggaagacatgcaaagacatcaacgagtgcctggtcaacaacggaggctgcgaccacttctgccgcaacaccgtgggcagcttcgagtgcggctgccggaagggctacaagctgctcaccgacgagcgcacctgcc

SEQ ID NO: 181509 - DNA, 1119 bp, Homo sapiens
  Payload ID: 15750
  Gene Symbol: SCUBE1
  Gene Name: signal peptide, CUB domain, EGF-like 1
  ENST ID: ENST00000615096
  CDS Start-End: 23-1114
cccagcggggcccgcattgagcatgggcgcggcggccgtgcgctggcacttgtgcgtgctgctggccctgggcacacgcgggcggctggccgggggcagcgggctcccagggtcagtcgacgtggatgagtgctcagagggcacagatgactgccacatcgatgccatctgtcagaacacgcccaagtcctacaaatgcctctgcaagccaggctacaagggggaaggcaagcagtgtgaagacattgacgagtgtgagaatgactactacaatgggggctgtgtccacgagtgcatcaacatcccggggaactacaggtgtacctgctttgatggcttcatgctggcacacgatggacacaactgcctggatgtggacgagtgtcaggacaataatggtggctgccagcagatctgcgtcaatgccatgggcagctacgagtgtcagtgccacagtggcttcttccttagtgacaaccagcatacctgcatccaccgctccaatgagggtatgaactgcatgaacaaagaccatggctgtgcccacatctgccgggagacgcccaaaggtggggtggcctgcgactgcaggcccggctttgaccttgcccaaaaccagaaggactgcacactaacctgtaattatggaaacggaggctgccagcacagctgtgaggacacagacacaggccccacgtgtggttgccaccagaagtacgccctccactcagacggtcgcacgtgcatcgagacgtgcgcagtcaataacggaggctgcgaccggacatgcaaggacacagccactggcgtgcgatgcagctgccccgttggattcacactgcagccggacgggaagacatgcaaagacatcaacgagtgcctggtcaacaacggaggctgcgaccacttctgccgcaacaccgtgggcagcttcgagtgcggctgccggaagggctacaagctgctcaccgacgagcgcacctgccaggacatcgacgagtgctccttcgagcggacctgtgaccacatctgcatcaactccccgggcagcttccagtgcctcatcaaactgctgcgctccaaagtgtctcggttcctgcggccctacaaataaccggg

SEQ ID NO: 181510 - DNA, 3727 bp, Homo sapiens
  Payload ID: 15751
  Gene Symbol: SCUBE2
  Gene Name: signal peptide, CUB domain, EGF-like 2
  Uniprot ID: Q9NQ36
  ENST ID: ENST00000309263
  CDS Start-End: 74-3073
gcgcacacctccccgcgccgccgccgccaccgcccgcactccgccgcctctgcccgcaaccgctgagccatccatgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggaagtgaaggggctcctgcccacaagtgtgtcaccccgtgtgtccctgcactgcggtaagagtggtggaggagacgggtgcttcctcagatgtcactctggcattcacctctcttcagatgtcaccaccatcaggacaagtgtaacctttaagctaaatgaaggcaagtgtagtttgaaaaatgctgagctgtttcccgagggtctgcgaccagcactaccagagaagcacagctcagtaaaagagagcttccgctacgtaaaccttacatgcagctctggcaagcaagtcccaggagcccctggccgaccaagcacccctaaggaaatgtttatcactgttgagtttgagcttgaaactaaccaaaaggaggtgacagcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtgtcagttgcagggctgggacctattatgatggagcacgagaacgctgcattttatgtccaaatggaaccttccaaaatgaggaaggacaaatgacttgtgaaccatgcccaagaccaggaaattctggggccctgaagaccccagaagcttggaatatgtctgaatgtggaggtctgtgtcaacctggtgaatattctgcagatggctttgcaccttgccagctctgtgccctgggcacgttccagcctgaagctggtcgaacttcctgcttcccctgtggaggaggccttgccaccaaacatcagggagctacttcctttcaggactgtgaaaccagagttcaatgttcacctggacatttctacaacaccaccactcaccgatgtattcgttgcccagtgggaacataccagcctgaatttggaaaaaataattgtgtttcttgcccaggaaatactacgactgactttgatggctccacaaacataacccagtgtaaaaacagaagatgtggaggggagctgggagatttcactgggtacattgaatccccaaactacccaggcaattacccagccaacaccgagtgtacgtggaccatcaacccaccccccaagcgccgcatcctgatcgtggtccctgagatcttcctgcccatagaggacgactgtggggactatctggtgatgcggaaaacctcttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatgaggactaccaggaactcattgaagacatagttcgagatggcaggctctatgcatctgagaaccatcaggaaatacttaaggataagaaacttatcaaggctctgtttgatgtcctggcccatccccagaactatttcaagtacacagcccaggagtcccgagagatgtttccaagatcgttcatccgattgctacgttccaaagtgtccaggtttttgagaccttacaaatgactcagcccacgtgccactcaatacaaatgttctgctatagggttggtgggacagagctgtcttccttctgcatgtcagcacagtcgggtattgctgcctcccgtatcagtgactcattagagttcaatttttatagataatacagatattttggtaaattgaacttggtttttctttcccagcatcgtggatgtagactgagaatggctttgagtggcatcagcttctcactgctgtgggcggatgtcttggatagatcacgggctggctgagctggactttggtcagcctaggtgagactcacctgtccttctggggtcttactcctcctcaaggagtctgtagtggaaaggaggccacagaataagctgcttattctgaaacttcagcttcctctagcccggccctctctaagggagccctctgcactcgtgtgcaggctctgaccaggcagaacaggcaagaggggagggaaggagacccctgcaggctccctccacccaccttgagacctgggaggactcagtttctccacagccttctccagcctgtgtgatacaagtttgatcccaggaacttgagttctaagcagtgctcgtgaaaaaaaaaagcagaaagaattagaaataaataaaaactaagcacttctggaga

SEQ ID NO: 181511 - DNA, 2912 bp, Homo sapiens
  Payload ID: 15751
  Gene Symbol: SCUBE2
  Gene Name: signal peptide, CUB domain, EGF-like 2
  Uniprot ID: Q9NQ36
  ENST ID: ENST00000450649
  CDS Start-End: 19-2442
gcaaccgctgagccatccatgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtgtcagttgcagggctgggacctattatgatggagcacgagaacgctgcattttatgtccaaatggaaccttccaaaatgaggaaggacaaatgacttgtgaaccatgcccaagaccaggaaattctggggccctgaagaccccagaagcttggaatatgtctgaatgtggaggtctgtgtcaacctggtgaatattctgcagatggctttgcaccttgccagctctgtgccctgggcacgttccagcctgaagctggtcgaacttcctgcttcccctgtggaggaggccttgccaccaaacatcagggagctacttcctttcaggactgtgaaaccagagttcaatgttcacctggacatttctacaacaccaccactcaccgatgtattcgttgcccagtgggaacataccagcctgaatttggaaaaaataattgtgtttcttgcccaggaaatactacgactgactttgatggctccacaaacataacccagtgtaaaacttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatgaggactaccaggaactcattgaagacatagttcgagatggcaggctctatgcatctgagaaccatcaggaaatacttaaggataagaaacttatcaaggctctgtttgatgtcctggcccatccccagaactatttcaagtacacagcccaggagtcccgagagatgtttccaagatcgttcatccgattgctacgttccaaagtgtccaggtttttgagaccttacaaatgactcagcccacgtgccactcaatacaaatgttctgctatagggttggtgggacagagctgtcttccttctgcatgtcagcacagtcgggtattgctgcctcccgtatcagtgactcattagagttcaatttttatagataatacagatattttggtaaattgaacttggtttttctttcccagcatcgtggatgtagactgagaatggctttgagtggcatcagcttctcactgctgtgggcggatgtcttggatagatcacgggctggctgagctggactttggtcagcctaggtgagactcacctgtccttctggggtcttactcctcctcaaggagtctgtagtggaaaggaggccacagaataagctgcttattctgaaacttcagcttcctctagcccggccctctctaagggagccctctgcactcgtgtgcaggctctgaccaggcagaacaggcaagagggga

SEQ ID NO: 181512 - DNA, 3148 bp, Homo sapiens
  Payload ID: 15751
  Gene Symbol: SCUBE2
  Gene Name: signal peptide, CUB domain, EGF-like 2
  ENST ID: ENST00000520467
  CDS Start-End: 72-2987
gcacacctccccgcgccgccgccgccaccgcccgcactccgccgcctctgcccgcaaccgctgagccatccatgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggaagtgaaggggctcctgcccacaagtgtgtcaccccgtgtgtccctgcactgcggtaagagtggtggaggagacgggtgcttcctcagatgtcactctggcattcacctctcttcaggactgcaaggggcctactctgtcacctgtggctcttcctctcctctcaggaacaaacaacaaaaatcaaatgactctgcttttggggatgtcaccaccatcaggacaagtgtaacctttaagctaaatgaaggcaagtgtagtttgaaaaatgctgagctgtttcccgagggtctgcgaccagcactaccagagaagcacagctcagtaaaagagagcttccgctacgtaaaccttacatgcagctctggcaagcaagtcccaggagcccctggccgaccaagcacccctaaggaaatgtttatcactgttgagtttgagcttgaaactaaccaaaaggaggtgacagcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtggtctgtgtcaacctggtgaatattctgcagatggctttgcaccttgccagctctgtgccctgggcacgttccagcctgaagctggtcgaacttcctgcttcccctgtggaggaggccttgccaccaaacatcagggagctacttcctttcaggactgtgaaaccagagttcaatgttcacctggacatttctacaacaccaccactcaccgatgtattcgttgcccagtgggaacataccagcctgaatttggaaaaaataattgtgtttcttgcccaggaaatactacgactgactttgatggctccacaaacataacccagtgtaaaaacagaagatgtggaggggagctgggagatttcactgggtacattgaatccccaaactacccaggcaattacccagccaacaccgagtgtacgtggaccatcaacccaccccccaagcgccgcatcctgatcgtggtccctgagatcttcctgcccatagaggacgactgtggggactatctggtgatgcggaaaacctcttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatgaggactaccaggaactcattgaagacatagttcgagatggcaggctctatgcatctgagaaccatcaggaaatacttaaggataagaaacttatcaaggctctgtttgatgtcctggcccatccccagaactatttcaagtacacagcccaggagtcccgagagatgtttccaagatcgttcatccgattgctacgttccaaagtgtccaggtttttgagaccttacaaatgactcagcccacgtgccactcaatacaaatgttctgctatagggttggtgggacagagctgtcttccttctgcatgtcagcacagtcgggtattgctgcctcccgtatcagtgactcattagagttcaatttttatagataatacagatattttggtaaattg

SEQ ID NO: 181513 - DNA, 537 bp, Homo sapiens
  Payload ID: 15751
  Gene Symbol: SCUBE2
  Gene Name: signal peptide, CUB domain, EGF-like 2
  ENST ID: ENST00000519202
  CDS Start-End: 1-359
ggtacattgaatccccaaactacccaggcaattacccagccaacaccgagtgtacgtggaccatcaacccaccccccaagcgccgcatcctgatcgtggtccctgagatcttcctgcccatagaggacgactgtggggactatctggtgatgcggaaaacctcttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatggtaagcacagcctgcagcacatggaaagagcgtctctgctttgaacagagccaacttcggagccagctggcaaactgctgacaagcacacatgctcagaaaggcaggcaagatgaggggaaaagacattgctgactcacaagtgccaaattttaacaggcatttggggacactgacaataggaggaaaagatgttttataaaatatattaaaagtgagcata

SEQ ID NO: 181514 - DNA, 514 bp, Homo sapiens
  Payload ID: 15751
  Gene Symbol: SCUBE2
  Gene Name: signal peptide, CUB domain, EGF-like 2
  ENST ID: ENST00000531429
  CDS Start-End: 1-514
agtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagaagtgaaggggct

SEQ ID NO: 181515 - DNA, 575 bp, Homo sapiens
  Payload ID: 15751
  Gene Symbol: SCUBE2
  Gene Name: signal peptide, CUB domain, EGF-like 2
  ENST ID: ENST00000519788
  CDS Start-End: 1-575
tgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggtgaaggggctcctgcccacaagtgtgtcaccccgtgtgtccctgcactgcggtaagagtggtggaggagacggg

SEQ ID NO: 181516 - DNA, 536 bp, Homo sapiens
  Payload ID: 15751
  Gene Symbol: SCUBE2
  Gene Name: signal peptide, CUB domain, EGF-like 2
  ENST ID: ENST00000528651
  CDS Start-End: 1-337
gggagatttcactgggtacattgaatccccaaactacccaggcaattacccagccaacaccgagtgtacgtggaccatcaacccaccccccaagcgccgcatcctgatcgtggtccctgagatcttcctgcccatagaggacgactgtggggactatctggtgatgcggaaaacctcttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatgatgcctgaaataatgtcaaacaaacacccaagacaaggagttttagtatctcttggggtggacccaaatgcctcccacatggctctgctgagagagacagagagcctcatctacccaaaagcaaccaactggcaacctctcctatctggaatcaggaagaaagcaaaaagacactgagacttcaaaataaatatggctgttctcaac

SEQ ID NO: 181517 - DNA, 7356 bp, Homo sapiens
  Payload ID: 15752
  Gene Symbol: SCUBE3
  Gene Name: signal peptide, CUB domain, EGF-like 3
  Uniprot ID: Q8IX30
  ENST ID: ENST00000274938
  CDS Start-End: 1-2982
atgggctcggggcgcgtacccgggctctgcctgcttgtcctgctggtccacgcccgcgccgcccagtacagcaaagccgcgcaagatgtggatgagtgtgtggaggggactgacaactgccacatcgatgctatctgccagaacaccccgaggtcatacaagtgcatctgcaagtctggctacacaggggacggcaaacactgcaaagacgtggatgagtgcgagcgagaggataatgcaggttgtgtgcatgactgtgtcaacatccctggcaattaccggtgtacctgctatgatggattccacctggcacatgacggacacaactgtctggatgtggacgagtgtgccgagggcaacggcggctgtcagcagagctgtgtcaacatgatgggcagctatgagtgccactgccgggaaggcttcttcctcagcgacaaccagcatacctgtatccagcggccagaagaaggaatgaattgcatgaacaagaaccacggctgtgcccacatttgccgggagacacccaaggggggtattgcctgtgaatgccgtcctggctttgagcttaccaagaaccaacgggactgtaaattgacatgcaactatggtaacggcggctgccagcacacgtgtgatgacacagagcagggtccccggtgcggctgccatatcaagtttgtgctccataccgacgggaagacatgcatcgagacctgtgctgtcaacaacgggggctgtgacagtaagtgccatgatgcagcgactggtgtccactgcacctgccctgtgggcttcatgctgcagccagacaggaagacgtgcaaagatatagatgagtgccgcttaaacaacgggggctgtgaccatatttgccgcaacacagtgggcagcttcgaatgcagttgcaagaaaggctataagcttctcatcaatgagaggaactgccaggatatagacgagtgttcctttgatcgaacctgtgaccacatatgtgtcaacacaccaggaagcttccagtgtctctgccatcgtggctacctgttgtatggtatcacccactgtggggatgtggatgaatgcagcatcaaccggggaggttgccgctttggctgcatcaacactcctggcagctaccagtgtacctgcccagcaggccagggtcggctgcactggaatggcaaagattgcacagagccactgaagtgtcagggcagtcctggggcctcgaaagccatgctcagctgcaaccggtctggcaagaaggacacctgtgccctgacctgtccctccagggcccgatttttgccagagtctgagaatggcttcacggtgagctgtgggacccccagccccagggctgctccagcccgagctggccacaatgggaacagcaccaactccaaccactgccatgaggctgcagtgctgtccattaaacaacgggcctccttcaagatcaaggatgccaaatgccgtttgcacctgcgaaacaaaggcaaaacagaggaggctggcagaatcacagggccaggtggtgccccctgctctgaatgccaggtcaccttcatccaccttaagtgtgactcctctcggaagggcaagggccgacgggcccggacccctccaggcaaagaggtcacaaggctcaccctggaactggaggcagaggtcagagccgaagaaaccacagccagctgtgggctgccctgcctccgacagcgaatggaacggcggctgaaaggatccctgaagatgctcagaaagtccatcaaccaggaccgcttcctgctgcgcctggcaggccttgattatgagctggcccacaagccgggcctggtagccggggagcgagcagagccgatggagtcctgtaggcccgggcagcaccgtgctgggaccaagtgtgtcagctgcccgcagggaacgtattaccacggccagacggagcagtgtgtgccatgcccagcgggcaccttccaggagagagaagggcagctctcctgcgacctttgccctgggagtgatgcccacgggcctcttggagccaccaacgtcaccacgtgtgcaggtcagtgcccacctggccaacactctgtagatgggttcaagccctgtcagccatgcccacgtggcacctaccaacctgaagcaggacggaccctatgcttcccttgtggtgggggcctcaccaccaagcatgaaggggccatttccttccaagactgtgacaccaaagtccagtgctccccagggcactactacaacaccagcatccaccgctgtattcgctgtgccatgggctcctatcagcccgacttccgtcagaacttctgcagccgctgtccaggaaacacaagcacagactttgatggctctaccagtgtggcccaatgcaagaatcgtcagtgtggtggggagctgggtgagttcactggctatattgagtcccccaactacccgggcaactacccagctggtgtggagtgcatctggaacatcaaccccccacccaagcgcaagatccttatcgtggtaccagagatcttcctgccatctgaggatgagtgtggggacgtcctcgtcatgagaaagaactcatccccatcctccattaccacttatgagacctgccagacctacgagcgtcccattgccttcactgcccgttccaggaagctctggatcaacttcaagacaagcgaggccaacagcgcccgtggcttccagattccctatgttacctatgatgaggactatgagcagctggtagaagacattgtgcgagatggccggctctatgcctctgaaaaccaccaggagattttaaaggacaagaagctcatcaaggccttctttgaggtgctagcccacccccagaactacttcaagtacacagagaaacacaaggagatgctgccaaaatccttcatcaagctgctccgctccaaagtttccagcttcctgaggccctacaaatagtaaccctaggctcagagacccaattttttaagcccccagactccttagccctcagagccggcagccccctaccctcagacaaggaactctctcctctctttttggagggaaaaaaaaaatatcactacacaaaccaggcactctccctttctgtctttctagtttcctttccttgtctctctctgcctgcctctctactgttcccccttttctaacacactacctagaaaagccattcagtactggctctagtccccgtgagatgtaaagaaacagtacagccccttccactgcccattttaccagctcacattcccgaccccatcagcttggaagggtgctagaggcccatcaaggaagtgggtctggtgggaaacggggaggggaaagaagggcttctgccattatagggttgtgccttgctagtcaggggccaaaatgtcccctggctctgctccctagggtgattctaacagcccagggtcctgccaaagaagcctttgatttacaggcttaatgccagcaccagtcctctggggcacatggtttgagctctggacttcccacatggccagctttcttgtctatacagatcctctctttctttccctacgtctgcctggggtctactccataagggtttacaaatggcccacaacactgagttagtggacaccggctaaatgaggaagagcagcaggcattgtcatggtgaatgccccgctgtagctccctgagagaaagactgtaactctgcaggacagaaacaaggttttaaagcattgccaaaaaaaagaaaacagaaagaaaaaatgtatcatctaaaggactagacacagaacaattggaagtcaacttcaaacactaatcccttttcttgtcttccctggcccagccacctcctcagccccatgtgatgctccctgggggagccctactccccttgctacatgttgtccttaaacatggttattgacctgaagccagcctaggccttgccctacagttgtttttcccttgtagccccagctggcttgtgggcttcaccaaagaggaccccactctgaagccagcctggagccacctacctctggcctcaggctgtgggcagcaaaaggaatgtgtgtgcacttggcgagcctcctgcccaccctgtccacacctaataagtgcaatcattttgagtctttctatgttgtctagacggaggggtttttgttttctgggtttgttttttgtttttgtttcttcttcctctattagcaaaaccctatttatagctgcccaagagaaaagagtgtatgtttggagtggaagaaaatcggttttgaatctcatgaaccttgagtgctggagcatctgatctgtctctatgccaccactggccacctagagcccttggctgtggtaatccagggtaattgcgcagaggcatctgatgtgtaggaaagtaattctggggatttgatggagcagaaaggagagagacctatgtttgctaaaccaatcttgctatccctatgcctctccatggagtcagtgtggacctcatgattatagaggccaatggaactggtcagtgattctctaccccaagtagggaaaacctccatcttttccctgtcttcatcctgttatcccctggtgtacacatggaagaggaccaggacataccacctggggatgggctgactcagggtcccgaggccagagacaaagctgtgggagccaagaataagacagaaggcatcagatatttgcctggctctggtcacttccctttgaagttgacttcaagcttagcttcctcaactactgtttttcagaaggaagaaagaatcaaatggaagaagaatcaagtccatgcccaagcccaaagcctgcacacattctgcccttaatccaagtgttgcctataaaattattttctgttttctcactctagttcccccaaagctgtagtcccaatcaatcaaaggctaccaactgagtcctcaggttcatttcttttttttttttttttctttttaactctcctggtaactcacagaacagctcaggttcatttctaggtgactgtcctaggctactgctcccccaggagactcaacactaaataaaggagtctgactccctgccctcccatcagtagcattcatcagccaaaacggccatagcagtaggtagccaatgacacagctagattccctgacaaccattagccaacatcatggtccttgtgggtagagtgtctggctacctttgtctttctgggtcaaggagggccactgtaaagatgcaaaatggctgcttccaaacaagggaaatggtcatttagtatgagtgtctctgtacttcccaggaagcaccatgaaaactgctttaatcaactctgactatcctaattctccaccagaagctaggataactttctttctttctttctttttttttttttttttttttgagatggagtctcgctctgtcacccaggctggagtgtaatggtgctatctcggcctactgcaacctccgcctcccaggctcaagcaattctgcctcggcctcccaagtagctgggattacaggcatgcgccaccgcgcccagctaatttttgtatttttagtagagatggggtttcaccatgttgcccgggctggtcttgaactcttgacctcaggtgatccacccgcctcagtctcccaaagtgctgggattacaggcatgagccaccgcgcccagcctaggataactttctgattcctctctgccagccgttttgcgtctcttggaaagccaaacggtgaccatgcttcttaatttatgccttcagggtctggcttctcctttctcccttcctttcctgtcacaccatgcatacatacatacaaatacacatccttcaaccatttattccatggcttatgagacctgcaaatgagttccacagtacggaaggcatagaccactaggcttcttaattgatgtcaaggcagatcttggtgagcaggtaaaaacctgctattgtccaccaagtttaatttaggtcctccaagttggagggttaagaacccaggcaaagctgctgctgaatctatggaggaggctggccctgggacatcaaactaggggttaactggattgaatgaggagtcaacgctcagggacattctaggtctttacaggtcagacagaagagaggtttttaccattggagggaaatggaaagatggtataaataggatcccttcatgaagcaacccagaggcctctctgcagcgtgtagggtgtggggcgacagtattgtggggcttccattcatcttagtacaaaacctcacctgctctgagcctggaaatgggagggcttcacgcaccaagtaatgcacaccagaaaggcacttatatcctcagcaacatggcagttcctctttacttctctgcctccctctttctatattatcaggccatgcctattcctacaacctgagacaactcttggagtcagaagaaaactgaccagatcctggatctgagctgcctgctccaggcctagaaatccccaaaggctggcactgagctgtgactgctttaacagcccccaagatttggtcagtttgaggtggtggagactcagatttgttgctgaaagttcagtaacacagtcctggtctttggccctagagaaactttttatatgagaagtgttctctatatacatgtttgaggtgactctggaatggattatgaggtcatatctcaaaatgtcagaaaacgttatagagcactcgaacttttgtatttgctgcttaacctcaatattacagccacaaacaaggggtaccaagacaaagtataactgagcataagcagaaaatgttaaccctccaggtttctttcttaagcacaataaaagtgggagcgaacaacacaaggatatttttacatttgacccgtctcaaaagtagcacaccctatccttgtgccattatttgtacaaggaaatatatgattagaaggaatagaacccccagttgtcatcagcttttttagacaccacaggttgtagcagtttgaacaaactgaaaactttatacttctgtgtgagctgaactcaagtttcagaataatcatcgccatgtgggaggctttttgttaaatgcagaagaaatttcaaaatattgtatttatatctgccttccactgctgccaatttagtaagcatctcctatacaatcgacaataaacagcaaatgatgcagttcatagagtattttgcacttggggaaaaatatgtatctgaattgtaaaaagaaatgtttggattttgtatgtcttttttattattattaaaatactaaatgaaactcctca

SEQ ID NO: 181518 - DNA, 1077 bp, Homo sapiens
  Payload ID: 15753
  Gene Symbol: SRP14
  Gene Name: signal recognition particle 14kDa (homologous Alu RNA binding protein)
  Uniprot ID: P37108
  ENST ID: ENST00000267884
  CDS Start-End: 73-483
ccagcctaggccgaacttccggctctcactgctaggggcttaagcggagggagtcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaagggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggctgaagaagagagacaaaaagaacaaaactaagaagaccaaagcagcagcagcagcagcagcagcagcacctgccgcagcagcaacagcaccaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttatcagcactgtctctttattcctttcccaacccattttaatagttctggcaataactactaaatctagaatgatgtgattaatgaataggctttagctctataatatcttctaggttattagaattgaaacctgacagttttataaaaagtcatgttatctcatgagctgcttcccacctggctgtataattttatcatcatggttccccagtttcgatgagttctcacagtcaaatgagagtttgtttaaccaccttaggagaaacatactacaaagtcatcaagaataaaggttccaaagtaat

SEQ ID NO: 181519 - DNA, 468 bp, Homo sapiens
  Payload ID: 15753
  Gene Symbol: SRP14
  Gene Name: signal recognition particle 14kDa (homologous Alu RNA binding protein)
  ENST ID: ENST00000560773
  CDS Start-End: 208-378
taggggcttaagcggagggagtcgagccagcgtcgccgcgatggtgttgttggagagcgagcagatgacggtcgaaccaaacccattccaaagaagggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggctgaagaagagagacaaaaagaacaaaactaagaagaccaaagcagcagcagcagcagcagcagcagcacctgccgcagcagcaacagcaccaacaacagcagcaacaacagcagcaacagcagcacagtaaagggcatacatttcctgctttcaccaattaaccactgaattgctattttttccttttggccagatagctaggtttctggttcccccacag

SEQ ID NO: 181520 - DNA, 578 bp, Homo sapiens
  Payload ID: 15753
  Gene Symbol: SRP14
  Gene Name: signal recognition particle 14kDa (homologous Alu RNA binding protein)
  ENST ID: ENST00000559081
  CDS Start-End: 38-385
gggcttaagcggagggagtcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaagggtactgtggagggctttgagcccgcagacaacaagtgtctgttaagagctaccgatgggaagaagaagatcagcactgtggtgagctccaaggaagtgaataagtttcagatggtgagttttgggtgttccttatgtttcccttctcagggcaagagtcagtatgatagtgaacactgggtaagattgatacttgggttcactgctctccggagataagttttaccagtatgtttcaagtaaaagctgccagggtgtgaatttcaatgctaataccgtcttcctttctagtttttttaagttagattttgtcttaggctgtagatatatgctacctatactatagttgaacaagaagttgcctgcaattttcccttggaaaaaaacgtaaaaaatgtgtgcaactgtctgt

SEQ ID NO: 181521 - DNA, 780 bp, Homo sapiens
  Payload ID: 15753
  Gene Symbol: SRP14
  Gene Name: signal recognition particle 14kDa (homologous Alu RNA binding protein)
  ENST ID: ENST00000558720
  CDS Start-End: 319-489
gcgttactcgagacctgtgcctcctgcaggaggaccagggccttgacgcggcaggacgaggatttggggctggctaacggggctgggcctgttgttttccagttcctgacggagctgaccagacttttccagaagtgccggacgtcgggcagcgtctatatcaccttgaagaagtatgacggtcgaaccaaacccattccaaagaagggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggctgaagaagagagacaaaaagaacaaaactaagaagaccaaagcagcagcagcagcagcagcagcagcacctgccgcagcagcaacagcaccaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttatc

SEQ ID NO: 181522 - DNA, 937 bp, Homo sapiens
  Payload ID: 15754
  Gene Symbol: SRP19
  Gene Name: signal recognition particle 19kDa
  Uniprot ID: P09132
  ENST ID: ENST00000282999
  CDS Start-End: 73-405
agagccgggttcctcccgggtttctgccgggtttctccctgcggctcctgggttgttgagactcttgtgaagatggcttgcgctgccgcgcggtccccggccgaccaggacaggtttatttgtatctatcctgcttatttaaataataagaagaccatcgcagagggaaggcgaatccccataagtaaggctgttgaaaatcctacagctacagagattcaagatgtatgttcagcagttggacttaacgtatttcttgagaaaaataaaatgtactctagagaatggaatcgtgatgtccaatacagaggcagagtccgggtccagctcaaacaggaagatgggagcctctgccttgtacagttcccatcacattatacactaagcctaacttctggttcctaggtaagtcagtaatgttgtatgcagcagaaatgatacctaaactaaaaacaaggacacaaaaaacaggaggtgctgaccaaagtcttcaacaaggagagggaagtaaaaaagggaaaggaaagaaaaagaagtaacctagtatcagcatcaagtatgtggtactactgtaagagacatgaatggagacttctaatttgtatcggagggaaacagaagctttttgtttgcatcatttaactgaactgtgaacccttgtgcctctcatctttatcatcggagttgacagtgaaacaaatttacatcagaagtttgcatctcgcgtatatgccgtataaaagaatttttttgtctttcaatgcagttttttggaagaaaatatttttaaatggacaatggactgtacaataagttacttgaaataagttgtttcagataaatttcaattagatttaaaataaacattttgtccaccttttaagttaatgaaataaaatttgaaactgacttttgcagcttttgcttatatactaat

SEQ ID NO: 181523 - DNA, 2841 bp, Homo sapiens
  Payload ID: 15754
  Gene Symbol: SRP19
  Gene Name: signal recognition particle 19kDa
  Uniprot ID: P09132
  ENST ID: ENST00000505459
  CDS Start-End: 156-590
caaacaggcgatgagaaatcgcggacgcggaaccatttcttgggcaggacttccggcggaaaagcgggctgtctcggaaactcagagccgggttcctcccgggtttctgccgggtttctccctgcggctcctgggttgttgagactcttgtgaagatggcttgcgctgccgcgcggtccccggccgaccaggacaggtttatttgtatctatcctgcttatttaaataataagaagaccatcgcagagggaaggcgaatccccataagtaaggctgttgaaaatcctacagctacagagattcaagatgtatgttcagcagttggacttaacgtatttcttgagaaaaataaaatgtactctagagaatggaatcgtgatgtccaatacagaggcagagtccgggtccagctcaaacaggaagatgggagcctctgccttgtacagttcccatcacgtaagtcagtaatgttgtatgcagcagaaatgatacctaaactaaaaacaaggacacaaaaaacaggaggtgctgaccaaagtcttcaacaaggagagggaagtaaaaaagggaaaggaaagaaaaagaagtaacctagtatcagcatcaagtatgtggtactactgtaagagacatgaatggagacttctaatttgtatcggagggaaacagaagctttttgtttgcatcatttaactgaactgtgaacccttgtgcctctcatctttatcatcggagttgacagtgaaacaaatttacatcagaagtttgcatctcgcgtatatgccgtataaaagaatttttttgtctttcaatgcagttttttggaagaaaatatttttaaatggacaatggactgtacaataagttacttgaaataagttgtttcagataaatttcaattagatttaaaataaacattttgtccaccttttaagttaatgaaataaaatttgaaactgacttttgcagcttttgcttatatactaatgctaggagaggagggataattaagaataaaatatgtagtgaaagtttccatagtgtgaggctaaaactagaagaaactgtggtaggtccttttgtgggtgggggacaggggagtctgtaaaaagccagtctgtagatgatattttaatatattattgtaatcgaatcgttcagttgttttttgacatggaaagtcctggattttaagctttaaatttgcttattttgtaggtttaagaacatgattttcatgggagttgtaaaattaactgtgctttagcaccttgaggtacactttccttcaacaaatgaaattggattggtgctccagaatttcagagcggtttctgaaagtagtgattttgagctatcccaattcctgttcttcctgaggcctggtttagctcttccttgaattctgcaagctatctcatattttcagtaaattccattttttttaagtttgtttgtttgtttgtttttgagatggagtttcactcttgttgcctaggctggagtgcaatggcacgatatcggcgtaccacaacctctgcatcccaggttcaagagattctcctgcctcagcctccctaggagctgggattacaggcatgtgccaccacacccggctaattttgtatttttagtagagacagggtttttccatgttggtcaggctggtctcgaactcccgacctcaggtgatctgcccacctcagcctcccaaagtgctgggattacaggcatgagccaccgtgcccggccttctttacatttttattgctcacagtcaaacattcctattgattgtaaaataagcaaacctagagttgtggagatttatatgtatttatttatttgaattgagacagggtcttaaactcccaggctcaagtgatcctcctgcctcaacctcccaaagtgctgggattacaggcatgagctagctggcctgttgactttttttttttaactctaacaatttctgttttatagtgaacataatagtataagacttagtttatatatttgacttacaaataaatcctggggagaggggagtatgtgtaaaacataattcagagcagccttctttgagaaagtgggtgtgtttggctgtgtaacaaaacaataaggggatgtgtttgctgtgtaacaaaacaatgaaggatttaagcaggatatttttgcctcatatgttaaatccaagtgaggttgctgtggtggttggtttagctctcagtgatgccttttttgtatttttccgctctgctgtccatgacatatttctaacacctttatgattattgttcctgcttgtaaaagggctgatatttacatgagtgcaaggcaggaagaaaaggtagctgtgccagccacttctggcaagcagttctcccaccttagcctcccaagtagctgagaccataggcatgagatttctcaaaattcctcccagcaggctttcacttagtttcattgttgagaactgtgacaggtccatctctagctgcaaaggaggctgagaaagtgaacacagcagtcctccttatccttggggaatacattccaagagtggatccctgaaacagcagatagtactgaaccctatatatactatgtttttgcctatgtatatatacttgatatggtttggctgctacccaacccaaaatctcatcttgaattataatccccaaatccctatgtgttaagggtgggaccaggtggagataattggatcatgggggcaatttcccctgtgctgttcttgagataatgagtgactctcaggagatctgttggttttataagtgcctggcgtttcccctgcttgcagtcactccatcttgc

SEQ ID NO: 181524 - DNA, 660 bp, Homo sapiens
  Payload ID: 15754
  Gene Symbol: SRP19
  Gene Name: signal recognition particle 19kDa
  Uniprot ID: P09132
  ENST ID: ENST00000515463
  CDS Start-End: 68-304
cgggttcctcccgggtttctgccgggtttctccctgcggctcctgggttgttgagactcttgtgaagatggcttgcgctgccgcgcggtccccggccgaccaggacaggctgttgaaaatcctacagctacagagattcaagatgtatgttcagcagttggacttaacgtatttcttgagaaaaataaaatgtactctagagaatggaatcgtgatgtccaatacagaggcagagtccgggtccagctcaaacaggaagatgggagcctctgccttgtacagttcccatcacgtaagtcagtaatgttgtatgcagcagaaatgatacctaaactaaaaacaaggacacaaaaaacaggaggtgctgaccaaagtcttcaacaaggagagggaagtaaaaaagggaaaggaaagaaaaagaagtaacctagtatcagcatcaagtatgtggtactactgtaagagacatgaatggagacttctaatttgtatcggagggaaacagaagctttttgtttgcatcatttaactgaactgtgaacccttgtgcctctcatctttatcatcggagttgacagtgaaacaaatttacatcagaagtttgcatctcgcgtatatgccgtataaaagaatttttttgtctttcaatgcagttttttg

SEQ ID NO: 181525 - DNA, 833 bp, Homo sapiens
  Payload ID: 15754
  Gene Symbol: SRP19
  Gene Name: signal recognition particle 19kDa
  ENST ID: ENST00000445150
  CDS Start-End: 46-360
cgggtttctccctgcggctcctgggttgttgagactcttgtgaagatggcttgcgctgccgcgcggtccccggccgaccaggacaggtttatttgtatctatcctgcttatttaaataataagaagaccatcgcagagggaaggcgaatccccataagtaaggctgttgaaaatcctacagctacagagattcaagatgtatgttcagcagttggacttaacgtatttcttgagaaaaataaaatgtactctagagaatggaatcgtgatgtccaatacagaggcagagtccgggtccagctcaaacaggaagatgggagcctctgccttgtacagttcccatcacgtaagcttgtttaaatgaatcagtggggctcagggataggtttctcctacacaacacaaaaaaggttctaaaactgaaaggtaaaagtcagaatttgcattctgaagattaatttaaagacaggactactgctcatggagagaagcagtagttctaatttctttgaggtgaatgacctctttgaaaatgtaatgagacccactaaacatttttcaaaaaaattgttgtgtgaacattttataaacctctggaagtctgtcattgctcccaggttaagaatataaaattattaaatcgttggatgttaattgccatttcagatcctagaggtccttgaggtctgttaatatctataatatctaatgattctatcattaataaatctgaaaagcaatattgactgaaaaaagcaagagatatacatagtgtggtaccacttaggtaaatttaaatacaaaatattactatttattgatagatgcatatg

SEQ ID NO: 181526 - DNA, 1270 bp, Homo sapiens
  Payload ID: 15754
  Gene Symbol: SRP19
  Gene Name: signal recognition particle 19kDa
  ENST ID: ENST00000621420
  CDS Start-End: 53-415
tttctgccgggtttctccctgcggctcctgggttgttgagactcttgtgaagatggcttgcgctgccgcgcggtccccggccgaccaggacaggtttatttgtatctatcctgcttatttaaataataagaagaccatcgcagagggaaggcgaatccccataagtaagaaaaataaaatgtactctagagaatggaatcgtgatgtccaatacagaggcagagtccgggtccagctcaaacaggaagatgggagcctctgccttgtacagttcccatcacgtaagtcagtaatgttgtatgcagcagaaatgatacctaaactaaaaacaaggacacaaaaaacaggaggtgctgaccaaagtcttcaacaaggagagggaagtaaaaaagggaaaggaaagaaaaagaagtaacctagtatcagcatcaagtatgtggtactactgtaagagacatgaatggagacttctaatttgtatcggagggaaacagaagctttttgtttgcatcatttaactgaactgtgaacccttgtgcctctcatctttatcatcggagttgacagtgaaacaaatttacatcagaagtttgcatctcgcgtatatgccgtataaaagaatttttttgtctttcaatgcagttttttggaagaaaatatttttaaatggacaatggactgtacaataagttacttgaaataagttgtttcagataaatttcaattagatttaaaataaacattttgtccaccttttaagttaatgaaataaaatttgaaactgacttttgcagcttttgcttatatactaatgctaggagaggagggataattaagaataaaatatgtagtgaaagtttccatagtgtgaggctaaaactagaagaaactgtggtaggtccttttgtgggtgggggacaggggagtctgtaaaaagccagtctgtagatgatattttaatatattattgtaatcgaatcgttcagttgttttttgacatggaaagtcctggattttaagctttaaatttgcttattttgtaggtttaagaacatgattttcatgggagttgtaaaattaactgtgctttagcaccttgaggtacactttccttcaacaaatgaaattggattggtgctccagaatttcagagcggtttctgaaagtagtgattttgagctatcccaattcctgttcttcctgaggcctggtttagctcttccttgaattctgcaagctatctcatattttcagtaaattccattttttt

SEQ ID NO: 181527 - DNA, 2279 bp, Homo sapiens
  Payload ID: 15755
  Gene Symbol: SRP54
  Gene Name: signal recognition particle 54kDa
  Uniprot ID: P61011
  ENST ID: ENST00000216774
  CDS Start-End: 352-1866
gagccgcgtagaaggaacgcggcggtgtgccccggaagcggaagtagattctcctatagaaaggctggactacgcggagtggtgacgtttcctcattgggcggaaggttcgctggcactccgttggtcttccagctggtgggagttgacgacgtggtgctgggcgttgggaccctactttatctagttcgggaagttgggttgtggggtcatacctgtctgtctgctcccagctttcttgggtttcttccgacggcgtggggcctcgctaaggaattcccggcccctcagggccacggctttagcggtgtcttttgcgagttcttcgtaagtacatcttaaagctgtcaagatggttctagcagaccttggaagaaaaataacatcagcattacgctcgttgagcaatgccaccattatcaatgaagaggtattgaatgctatgctaaaagaagtctgtaccgctttgttggaagcagatgttaatattaaactagtgaagcaactaagagaaaatgttaagtctgctattgatcttgaagagatggcatctggtcttaacaaaagaaaaatgattcagcatgctgtatttaaagaacttgtgaagcttgtagaccctggagttaaggcatggacacccactaaaggaaaacaaaatgtgattatgtttgttggattgcaagggagtggtaaaacaacaacatgttcaaagctagcatattattaccagaggaaaggttggaagacctgtttaatatgtgcagacacattcagagcaggggcttttgaccaactaaaacagaatgctaccaaagcaagaattccattttatggaagctatacagaaatggatcctgtcatcattgcttctgaaggagtagagaaatttaaaaatgaaaattttgaaattattattgttgatacaagtggccgccacaaacaagaagactctttgtttgaagaaatgcttcaagttgctaatgctatacaacctgataacattgtttatgtgatggatgcctccattgggcaggcttgtgaagcccaggctaaggcttttaaagataaagtagatgtagcctcagtaatagtgacaaaacttgatggccatgcaaaaggaggtggtgcactcagtgcagtcgctgccacaaaaagtccgattattttcattggtacaggggaacatatagatgactttgaacctttcaaaacacagccttttattagcaaacttcttggtatgggcgacattgaaggactgatagataaagtcaacgagttgaagttggatgacaatgaagcacttatagagaagttgaaacatggtcagtttacgttgcgagacatgtatgagcaatttcaaaatatcatgaaaatgggccccttcagtcagatcttggggatgatccctggttttgggacagattttatgagcaaaggaaatgaacaggagtcaatggcaaggctaaagaaattaatgacaataatggatagtatgaatgatcaagaactagacagtacggatggtgccaaagtttttagtaaacaaccaggaagaatccaaagagtagcaagaggatcgggtgtatcaacaagagatgttcaagaacttttgacacaatataccaagtttgcacagatggtaaaaaagatgggaggtatcaaaggacttttcaaaggtggcgacatgtctaagaatgtgagccagtcacagatggcaaaattgaaccaacaaatggccaaaatgatggatcctagggttcttcatcacatgggtggtatggcaggacttcagtcaatgatgaggcagtttcaacagggtgctgctggcaacatgaaaggcatgatgggattcaataatatgtaaagaaaatgccttaatataaactgactcagttgaatacctaatttgctgagacctcagcgtttcccttctttttgcgaattggggggaaagtgtatttttcttgcttatcatgcactctttccttttcttctcgcccgcttttcccctccttttctttttccttccttctttcctccctttaatataagggagaaatacatggtttttgtggaaatcattatatgtttgctttagattttcttctgttttcaccatcataacacttaagttaaatcatgatgtaaaattttagtacttaaaggtttttaattatctcgaaggccaagcattgcatttgtaaacagtcctggtcagtagttaaataatgtttcaattaaagtgctgtaaaataaacttcaaagtggttataagtt

SEQ ID NO: 181528 - DNA, 2187 bp, Homo sapiens
  Payload ID: 15755
  Gene Symbol: SRP54
  Gene Name: signal recognition particle 54kDa
  Uniprot ID: P61011
  ENST ID: ENST00000546080
  CDS Start-End: 407-1774
gagccgcgtagaaggaacgcggcggtgtgccccggaagcggaagtagattctcctatagaaaggctggactacgcggagtggtgacgtttcctcattgggcggaaggttcgctggcactccgttggtcttccagctggtgggagttgacgacgtggtgctgggcgttgggaccctactttatctagttcgggaagttgggttgtggggtcatacctgtctgtctgctcccagctttcttgggtttcttccgacggcgtggggcctcgctaaggaattcccggcccctcagggccacggctttagcggtgtcttttgcgagttcttcgtaagtacatcttaaagctgtcaagatggttctagcagaccttggaagaaaaataacatcagcattacgctcgttgagcaatgccaccattatcaatgaagaggtctgctattgatcttgaagagatggcatctggtcttaacaaaagaaaaatgattcagcatgctgtatttaaagaacttgtgaagcttgtagaccctggagttaaggcatggacacccactaaaggaaaacaaaatgtgattatgtttgttggattgcaagggagtggtaaaacaacaacatgttcaaagctagcatattattaccagaggaaaggttggaagacctgtttaatatgtgcagacacattcagagcaggggcttttgaccaactaaaacagaatgctaccaaagcaagaattccattttatggaagctatacagaaatggatcctgtcatcattgcttctgaaggagtagagaaatttaaaaatgaaaattttgaaattattattgttgatacaagtggccgccacaaacaagaagactctttgtttgaagaaatgcttcaagttgctaatgctatacaacctgataacattgtttatgtgatggatgcctccattgggcaggcttgtgaagcccaggctaaggcttttaaagataaagtagatgtagcctcagtaatagtgacaaaacttgatggccatgcaaaaggaggtggtgcactcagtgcagtcgctgccacaaaaagtccgattattttcattggtacaggggaacatatagatgactttgaacctttcaaaacacagccttttattagcaaacttcttggtatgggcgacattgaaggactgatagataaagtcaacgagttgaagttggatgacaatgaagcacttatagagaagttgaaacatggtcagtttacgttgcgagacatgtatgagcaatttcaaaatatcatgaaaatgggccccttcagtcagatcttggggatgatccctggttttgggacagattttatgagcaaaggaaatgaacaggagtcaatggcaaggctaaagaaattaatgacaataatggatagtatgaatgatcaagaactagacagtacggatggtgccaaagtttttagtaaacaaccaggaagaatccaaagagtagcaagaggatcgggtgtatcaacaagagatgttcaagaacttttgacacaatataccaagtttgcacagatggtaaaaaagatgggaggtatcaaaggacttttcaaaggtggcgacatgtctaagaatgtgagccagtcacagatggcaaaattgaaccaacaaatggccaaaatgatggatcctagggttcttcatcacatgggtggtatggcaggacttcagtcaatgatgaggcagtttcaacagggtgctgctggcaacatgaaaggcatgatgggattcaataatatgtaaagaaaatgccttaatataaactgactcagttgaatacctaatttgctgagacctcagcgtttcccttctttttgcgaattggggggaaagtgtatttttcttgcttatcatgcactctttccttttcttctcgcccgcttttcccctccttttctttttccttccttctttcctccctttaatataagggagaaatacatggtttttgtggaaatcattatatgtttgctttagattttcttctgttttcaccatcataacacttaagttaaatcatgatgtaaaattttagtacttaaaggtttttaattatctcgaaggccaagcattgcatttgtaaacagtcctggtcagtagttaaataatgtttcaattaaagtgctgtaaaataaacttcaaagtggttataagtt

SEQ ID NO: 181529 - DNA, 572 bp, Homo sapiens
  Payload ID: 15755
  Gene Symbol: SRP54
  Gene Name: signal recognition particle 54kDa
  ENST ID: ENST00000554803
  CDS Start-End: 442-572
agtcacacctctatctctcatctttccgctcttagctgggagtgctccgcctagtcacttttcttaaggtggctcgtcgaggcctgacttcttccccgaaatcacgtccctagacagcctcctattttaccactaactttactcctgcagttattcagcggtaggaaactgaaaccaaaaaccagtgtaagcaagtaaacatctaaactgtttcaggagccgcgtagaaggaacgcggcggtgtgccccggaagcggaagtagattctcctatagaaaggctggactacgcggagtggtgacgtttcctcattgggcggaagctttcttgggtttcttccgacggcgtggggcctcgctaaggaattcccggcccctcagggccacggctttagcggtgtcttttgcgagttcttcgtaagtacatcttaaagctgtcaagatggttctagcagaccttggaagaaaaataacatcagcattacgctcgttgagcaatgccaccattatcaatgaagaggtattgaatgctatgctaaaagaagtctgtaccgctttgttggaagcagatgt

SEQ ID NO: 181530 - DNA, 600 bp, Homo sapiens
  Payload ID: 15755
  Gene Symbol: SRP54
  Gene Name: signal recognition particle 54kDa
  ENST ID: ENST00000556380
  CDS Start-End: 145-312
gtcatacctgtctgtctgctcccagctttcttgggtttcttccgacggcgtggggcctcgctaaggaattcccggcccctcagggccacggctttagcggtgtcttttgcgagttcttcgtaagtacatcttaaagctgtcaagatggttctagcagaccttggaagaaaaataacatcagcattacgctcgttgagcaatgccaccattatcaatgaagaggtattgaatgctatgctaaaagaagtctgtaccgctttgttggaagacctgtttaatatgtgcagacacattcagagcaggggcttttgaccaactaaaacagaatgctaccaaagcaagaattccattttatggaagctatacagaaatggatcctgtcatcattgcttctgaaggagtagagaaatttaaaaatgaaaattttgaaattattattgttgatacaagtggccgccacaaacaagaagactctttgtttgaagaaatgcttcaagttgctaatgctatacaacctgataacattgtttatgtgatggatgcctccattgggcaggcttgtgaagcccaggctaaggcttttaaagataaagtagatgt

SEQ ID NO: 181531 - DNA, 558 bp, Homo sapiens
  Payload ID: 15755
  Gene Symbol: SRP54
  Gene Name: signal recognition particle 54kDa
  ENST ID: ENST00000555746
  CDS Start-End: 337-558
atctttccgctcttagctgggagtgctccgcctagtcacttttcttaaggtggctcgtcgaggcctgacttcttccccgaaatcacgtccctagacagcctcctattttaccactaactttactcctgcagttattcagcggtaggaaactgaaaccaaaaaccagtgtaagcaagtaaacatctaaactgtttcaggagccgcgtagaaggaacgcggcggtgtgccccggaagcggaagtagattctcctatagaaaggctggactacgcggagtggtgacgtttcctcattgggcggaagagttcttcgtaagtacatcttaaagctgtcaagatggttctagcagaccttggaagaaaaataacatcagcattacgctcgttgagcaatgccaccattatcaatgaagaggtattgaatgctatgctaaaagaagtctgtaccgctttgttggaagcagatgttaatattaaactagtgaagcaactaagagaaaatgttaagtctgctattgatcttgaagagatggcatctggtcttaacaaaagaaaaatg

SEQ ID NO: 181532 - DNA, 1949 bp, Homo sapiens
  Payload ID: 15755
  Gene Symbol: SRP54
  Gene Name: signal recognition particle 54kDa
  ENST ID: ENST00000555557
  CDS Start-End: 325-1647
cttccagctggtgggagttgacgacgtggtgctgggcgttgggaccctactttatctagttcgggaagttgggttgtggggtcatacctgtctgtctgctcccagctttcttgggtttcttccgacggcgtggggcctcgctaaggaattcccggcccctcagggccacggctttagcggtgtcttttgcgagttcttcgtaagtacatcttaaagctgtcaagatggttctagcagaccttggaagaaaaataacatcagcattacgctcgttgagcaatgccaccattatcaatgaagaggtctgctattgatcttgaagagatggcatctggtcttaacaaaagaaaaatgattcagcatgctgtatttaaagaacttgtgaagcttgtagaccctggagttaaggcatggacacccactaaaggaaaacaaaatgtgattatgtttgttggattgcaagggagtggtaaaacaacaacatgttcaaagctagcatattattaccagaggaaaggttggaagacctgtttaatatgtgcagacacattcagagcaggggcttttgaccaactaaaacagaatgctaccaaagcaagaattccattttatggaagctatacagaaatggatcctgtcatcattgcttctgaaggagtagagaaatttaaaaatgaaaattttgaaattattattgttgatacaagtggccgccacaaacaagaagactctttgtttgaagaaatgcttcaagttgctaatgctatacaacctgataacattgtttatgtgatggatgcctccattgggcaggcttgtgaagcccaggctaaggcttttaaagataaagtagatgtagcctcagtaatagtgacaaaacttgatggccatgcaaaaggaggtggtgcactcagtgcagtcgctgccacaaaaagtccgattattttcattggtacaggggaacatatagatgactttgaacctttcaaaacacagccttttattagcaaacttcttggtatgggcgacattgaaggactgatagataaagtcaacgagttgaagttggatgacaatgaagcacttatagagaagttgaaacatggtcagtttacgttgcgagacatgtatgagcaatttcaaaatatcatgaaaatgggccccttcagtcagatcttggggatgatccctggttttgggacagattttatgagcaaaggaaatgaacaggagtcaatggcaaggctaaagaaattaatgacaataatggatagtatgaatgatcaagaactagacagtacggatggtgccaaagtttttagtaaacaaccaggaagaatccaaagagtagcaagaggatcgggtgtatcaacaagagatgttcaagaacttttgacacaatataccaagtttgcacagatggtaaaaaagatgggaggtatcaaaggacttttcaaaggtggcgacatgtctaagaatgtgagccagtcacagatggcaaaattgaaccaacaaatggccaaaatgatggatcctagggttcttcatcacatgggtggtatggcaggacttcagtcaatgatgaggcagtttcaacagggtgctgctggcaacatgaaaggcatgatgggattcaataatatgtaaagaaaatgccttaatataaactgactcagttgaatacctaatttgctgagacctcagcgtttcccttctttttgcgaattggggggaaagtgtatttttcttgcttatcatgcactctttccttttcttctcgcccgcttttcccctccttttctttttccttccttctttcctccctttaatataagggagaaatacatggtttttgtggaaatcattatatgtttgctttagattttcttctgttttcaccatcataacacttaagttaaatcatgatgtaaaattttagtacttaaagg

SEQ ID NO: 181533 - DNA, 2327 bp, Homo sapiens
  Payload ID: 15755
  Gene Symbol: SRP54
  Gene Name: signal recognition particle 54kDa
  Uniprot ID: P61011
  ENST ID: ENST00000556994
  CDS Start-End: 398-1912
gagatccaagacgcaactcccaccgccaggcggtcgcctcagaagggagccgcgtagaaggaacgcggcggtgtgccccggaagcggaagtagattctcctatagaaaggctggactacgcggagtggtgacgtttcctcattgggcggaaggttcgctggcactccgttggtcttccagctggtgggagttgacgacgtggtgctgggcgttgggaccctactttatctagttcgggaagttgggttgtggggtcatacctgtctgtctgctcccagctttcttgggtttcttccgacggcgtggggcctcgctaaggaattcccggcccctcagggccacggctttagcggtgtcttttgcgagttcttcgtaagtacatcttaaagctgtcaagatggttctagcagaccttggaagaaaaataacatcagcattacgctcgttgagcaatgccaccattatcaatgaagaggtattgaatgctatgctaaaagaagtctgtaccgctttgttggaagcagatgttaatattaaactagtgaagcaactaagagaaaatgttaagtctgctattgatcttgaagagatggcatctggtcttaacaaaagaaaaatgattcagcatgctgtatttaaagaacttgtgaagcttgtagaccctggagttaaggcatggacacccactaaaggaaaacaaaatgtgattatgtttgttggattgcaagggagtggtaaaacaacaacatgttcaaagctagcatattattaccagaggaaaggttggaagacctgtttaatatgtgcagacacattcagagcaggggcttttgaccaactaaaacagaatgctaccaaagcaagaattccattttatggaagctatacagaaatggatcctgtcatcattgcttctgaaggagtagagaaatttaaaaatgaaaattttgaaattattattgttgatacaagtggccgccacaaacaagaagactctttgtttgaagaaatgcttcaagttgctaatgctatacaacctgataacattgtttatgtgatggatgcctccattgggcaggcttgtgaagcccaggctaaggcttttaaagataaagtagatgtagcctcagtaatagtgacaaaacttgatggccatgcaaaaggaggtggtgcactcagtgcagtcgctgccacaaaaagtccgattattttcattggtacaggggaacatatagatgactttgaacctttcaaaacacagccttttattagcaaacttcttggtatgggcgacattgaaggactgatagataaagtcaacgagttgaagttggatgacaatgaagcacttatagagaagttgaaacatggtcagtttacgttgcgagacatgtatgagcaatttcaaaatatcatgaaaatgggccccttcagtcagatcttggggatgatccctggttttgggacagattttatgagcaaaggaaatgaacaggagtcaatggcaaggctaaagaaattaatgacaataatggatagtatgaatgatcaagaactagacagtacggatggtgccaaagtttttagtaaacaaccaggaagaatccaaagagtagcaagaggatcgggtgtatcaacaagagatgttcaagaacttttgacacaatataccaagtttgcacagatggtaaaaaagatgggaggtatcaaaggacttttcaaaggtggcgacatgtctaagaatgtgagccagtcacagatggcaaaattgaaccaacaaatggccaaaatgatggatcctagggttcttcatcacatgggtggtatggcaggacttcagtcaatgatgaggcagtttcaacagggtgctgctggcaacatgaaaggcatgatgggattcaataatatgtaaagaaaatgccttaatataaactgactcagttgaatacctaatttgctgagacctcagcgtttcccttctttttgcgaattggggggaaagtgtatttttcttgcttatcatgcactctttccttttcttctcgcccgcttttcccctccttttctttttccttccttctttcctccctttaatataagggagaaatacatggtttttgtggaaatcattatatgtttgctttagattttcttctgttttcaccatcataacacttaagttaaatcatgatgtaaaattttagtacttaaaggtttttaattatctcgaaggccaagcattgcatttgtaaacagtcctggtcagtagttaaataatgtttcaattaaagtgctgtaaaataaacttcaaagtggttataagttaa

SEQ ID NO: 181534 - DNA, 162 bp, Homo sapiens
  Payload ID: 15755
  Gene Symbol: SRP54
  Gene Name: signal recognition particle 54kDa
  ENST ID: ENST00000630962
  CDS Start-End: 1-162
atggttctagcagaccttggaagaaaaataacatcagcattacgctcgttgagcaatgccaccattatcaatgaagaggtattgaatgctatgctaaaagaagtctgtaccgctttgttggaagacctgtttaatatgtgcagacacattcagagcaggtaa

SEQ ID NO: 181535 - DNA, 2649 bp, Homo sapiens
  Payload ID: 15756
  Gene Symbol: SRP68
  Gene Name: signal recognition particle 68kDa
  Uniprot ID: Q9UHB9
  ENST ID: ENST00000307877
  CDS Start-End: 163-2046
ctcgcgcaggcgcgctccagcacatggcgccctgctgcagcaagggccgacggcggcggagtccgccgctatcccatcagcccggccaggcaggtccagctctcacccgcccaggtcgtcccgcctcccctatcccgtcttgctctgcggcgcaggggcaagatggctgctgagaagcaggtcccaggcggcggcggcggcggcggcagtggcggcggcggtggcagtggcggcggcggtagcggcggtggacgtggtgccggaggggaagaaaataaagaaaacgaacgcccttcggccggatcgaaggcaaacaaagaatttggggatagcctgagtttggagattcttcagattattaaggaatcccagcagcagcatggtttacggcatggagattttcagaggtacaggggctactgttcccgtagacaaagacgtcttcgaaaaacactcaacttcaagatgggtaacagacacaaattcacagggaagaaagtgactgaagagcttctgaccgataatagatacttgcttctggttctgatggatgctgaaagagcctggagctacgccatgcagctgaaacaggaagccaacactgaaccccgaaaacggtttcacttgttatctcgcctacgcaaagccgtgaagcatgcagaggaattggaacgcttgtgtgagagcaatcgcgtggatgccaagaccaaattagaggctcaggcttacacagcttacctctcaggaatgctacgttttgaacatcaagaatggaaagctgccattgaggcttttaacaaatgcaaaactatctatgagaagctagccagtgctttcacagaggagcaggctgtgctgtataaccaacgtgtggaagagatttcacccaacatccgctattgtgcatataatattggggaccagtcagccatcaatgaactcatgcagatgagattgaggtctgggggcactgagggtctcttggctgaaaaattggaggctttgatcactcagactcgagccaaacaggcagctaccatgagtgaagtggagtggagagggagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatccaggtctgcattggcccggggcaagagtttaacatcttcggccctgcattcctacatcttgtgtctgtacacgttcttaagcagcgtgtcaggagagcaccctgttgtcttctggtaaatgtgtgcagggtcatcctgtctcctgtacctcctgggaaaggggccgctgctgtctggtgccctgtgagctgtgattgattgcctttggtcagtaatgcgttcaggagtccacaccaggcacagatggggccttgaaacgctttgtcatgcttcttcagtaccatggatttgaaatgaactcatccttgctgtgagcatccaggagcccttgagaagtttatctatgactatgaaactggcaacgtcaccccagaattacggtcagccttattccccttcacctcccagtgaacgctaagaagtttcagacaagcagagagctctatttttagaagaaatatgttacactcagaaatgatgaaaccaaatcttatattaaaaggcaaagatgacggaga

SEQ ID NO: 181536 - DNA, 2386 bp, Homo sapiens
  Payload ID: 15756
  Gene Symbol: SRP68
  Gene Name: signal recognition particle 68kDa
  Uniprot ID: Q9UHB9
  ENST ID: ENST00000539137
  CDS Start-End: 17-1786
gcggcgcaggggcaagatggctgctgagaagcaggtcccaggcggcggcggcggcggcggcagtggcggcggcggtggcagtggcggcggcggtagcggcggtggacgtggtgccggaggggaagaaaataaagaaaacgaacgcccttcggccggatcgaaggcaaacaaagaatttggggatagcctgagtttggagattcttcagattattaaggaatcccagcagcagcatggtttacggcatggagattttcagaggtacagatacttgcttctggttctgatggatgctgaaagagcctggagctacgccatgcagctgaaacaggaagccaacactgaaccccgaaaacggtttcacttgttatctcgcctacgcaaagccgtgaagcatgcagaggaattggaacgcttgtgtgagagcaatcgcgtggatgccaagaccaaattagaggctcaggcttacacagcttacctctcaggaatgctacgttttgaacatcaagaatggaaagctgccattgaggcttttaacaaatgcaaaactatctatgagaagctagccagtgctttcacagaggagcaggctgtgctgtataaccaacgtgtggaagagatttcacccaacatccgctattgtgcatataatattggggaccagtcagccatcaatgaactcatgcagatgagattgaggtctgggggcactgagggtctcttggctgaaaaattggaggctttgatcactcagactcgagccaaacaggcagctaccatgagtgaagtggagtggagagggagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatccaggtctgcattggcccggggcaagagtttaacatcttcggccctgcattcctacatcttgtgtctgtacacgttcttaagcagcgtgtcaggagagcaccctgttgtcttctggtaaatgtgtgcagggtcatcctgtctcctgtacctcctgggaaaggggccgctgctgtctggtgccctgtgagctgtgattgattgcctttggtcagtaatgcgttcaggagtccacaccaggcacagatggggccttgaaacgctttgtcatgcttcttcagtaccatggatttgaaatgaactcatccttgctgtgagcatccaggagcccttgagaagtttatctatgactatgaaactggcaacgtcaccccagaattacggtcagccttattccccttcacctcccagtgaacgctaagaagtttcagacaagcagagagctctatttttagaagaaatatgttacactcagaaatgatgaaaccaaatcttatattaaaaggcaaagatgacgg

SEQ ID NO: 181537 - DNA, 1941 bp, Homo sapiens
  Payload ID: 15756
  Gene Symbol: SRP68
  Gene Name: signal recognition particle 68kDa
  ENST ID: ENST00000592704
  CDS Start-End: 7-171
ggcaagatggctgctgagaagcaggtcccaggcggcggcggcggcggcggcagtggcggcggcggtggcagtggcggcggcggtagcggcggtggacgtggtgccggaggggaagaaaataaagaaaacgaacgcccttcggccggatcgaaggggctactgttcccgtagacaaagacgtcttcgaaaaacactcaacttcaagatgggtaacagacacaaattcacagggaagaaagtgactgaagagcttctgaccgataatagatacttgcttctggttctgatggatgctgaaagagcctggagctacgccatgcagctgaaacaggaagccaacactgaaccccgaaaacggtttcacttgttatctcgcctacgcaaagccgtgaagcatgcagaggaattggaacgcttgtgtgagagcaatcgcgtggatgccaagaccaaattagaggctcaggcttacacagcttacctctcaggaatgctacgttttgaacatcaagaatggaaagctgccattgaggcttttaacaaatgcaaaactatctatgagaagctagccagtgctttcacagaggagcaggctgtgctgtataaccaacgtgtggaagagatttcacccaacatccgctattgtgcatataatattggggaccagtcagccatcaatgaactcatgcagatgagattgaggtctgggggcactgagggtctcttggctgaaaaattggaggctttgatcactcagactcgagccaaacaggcagctaccatgagtgaagtggagtggagagggagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatccaggtctgcattggcccggggcaagagtttaacatcttcggccctgcattcctacatcttgtgtctgtac

SEQ ID NO: 181538 - DNA, 507 bp, Homo sapiens
  Payload ID: 15756
  Gene Symbol: SRP68
  Gene Name: signal recognition particle 68kDa
  ENST ID: ENST00000591272
  CDS Start-End: 17-208
gcggcgcaggggcaagatggctgctgagaagcaggtcccaggcggcggcggcggcggcggcagtggcggcggcggtggcagtggcggcggcggtagcggcggtggacgtggtgccggaggggaagaaaataaagaaaacgaacgcccttcggccggatcgaaggcaaacaaagaatttggggatagcctgagtttggagaattattaaggaatcccagcagcagcatggtttacggcatggagattttcagaggtacaggggctactgttcccgtagacaaagacgtcttcgaaaaacactcaacttcaagatgggtaacagacacaaattcacagggaagaaagtgactgaagagcttctgaccgataatagatacttgcttctggttctgatggatgctgaaagagcctggagctacgccatgcagctgaaacaggaagccaacactgaaccccgaaaacggtttcacttgttatctcgcctacgcaaagccgtgaagcatgcag

SEQ ID NO: 181539 - DNA, 2037 bp, Homo sapiens
  Payload ID: 15756
  Gene Symbol: SRP68
  Gene Name: signal recognition particle 68kDa
  Uniprot ID: Q9UHB9
  ENST ID: ENST00000602720
  CDS Start-End: 240-1106
ccttcattgctttttaggatgtttgtaaaattcccagtgggaacttagagctttgtgggagcagtggggaggttttttggtttcagcaccttgatgcagaggcttagttaaagggagcagaggtgatacgtggcagtcaagaggttttaaacttgaactgtaccctaccgacaggaaaagaggcaaatcctgtgtagctggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatccaggtctgcattggcccggggcaagagtttaacatcttcggccctgcattcctacatcttgtgtctgtacacgttcttaagcagcgtgtcaggagagcaccctgttgtcttctggtaaatgtgtgcagggtcatcctgtctcctgtacctcctgggaaaggggccgctgctgtctggtgccctgtgagctgtgattgattgcctttggtcagtaatgcgttcaggagtccacaccaggcacagatggggccttgaaacgctttgtcatgcttcttcagtaccatggatttgaaatgaactcatccttgctgtgagcatccaggagcccttgagaagtttatctatgactatgaaactggcaacgtcaccccagaattacggtcagccttattccccttcacctcccagtgaacgctaagaagtttcagacaagcagagagctctatttttagaagaaatatgttacactcagaaatgatgaaaccaaatcttatattaaaaggcaaagatgacggagactgtgcccatttcttatatgccctccctcatgtccagtccccgttctctcctcgggagcctagttgcgtgaagccggtgaggtcaagtgtaacctgacttaccggcaactaggtgaggctgatgccagatacacatgttagaggcactatttttcaggacttcccaatgtgtaatttttagatgccattatattttaatccccttcgttaccccccgtttttccttagtcatcccttttcacttctattataacatcaataatagaagtcacaaaaacaatgtaagaaagcaaggaataaaagtgatttaaacatgtacctgacactt

SEQ ID NO: 181540 - DNA, 165 bp, Homo sapiens
  Payload ID: 15756
  Gene Symbol: SRP68
  Gene Name: signal recognition particle 68kDa
  ENST ID: ENST00000629930
  CDS Start-End: 1-165
atggctgctgagaagcaggtcccaggcggcggcggcggcggcggcagtggcggcggcggtggcagtggcggcggcggtagcggcggtggacgtggtgccggaggggaagaaaataaagaaaacgaacgcccttcggccggatcgaaggggctactgttcccgtag

SEQ ID NO: 181541 - DNA, 3983 bp, Homo sapiens
  Payload ID: 15757
  Gene Symbol: SRP72
  Gene Name: signal recognition particle 72kDa
  Uniprot ID: O76094
  ENST ID: ENST00000342756
  CDS Start-End: 722-2737
gctaagtaacttgtttattgtcagacatctagtgagtcgcagagccagggaactgaccacgggcattttcaccccattacccttccagcttattgccgactgctcccgaagggagcgaaaaggacaggcaaagggtttcaccaaaccctttgtaatgggagattcttgccttcttacctttcctcacgtttgcttctctgccagaatgtcttcccgcactttccccagaacccaagttctcctaatcatctttcaagatccctttccctcaaccacagatgagccgtgcctatttctccttcaaatgactccctatggcttctagttggtagtcttttatttaccacctcatagtccttttatttatatcccataaatgatcgtccggccccgcaccgtgggaccaggacgctgcctcgaccatggcggtctcctggaaacaggctgctttgagccgaaactggtgaccgtttcccaaccccgtccaggagtccgacgcctcttttctccaggccaacttcaagtgaggtgtatcaactctatccgcacaaatttcttgccacgagagcagaagattatgatctctgatgctgccttagggctgaagacactcccaactcggcgacgcttagcaatcatcgacttcctcctcctcttggctgcctcggagatcctgttccggggcagaggtctccccgccccgcccctcgtctcctccaagatggcgagcggcggcagcgggggggtgtcagtacctgcgctgtggagtgaagtgaaccggtatggccagaacggcgacttcacgcgcgctctcaagaccgtcaataagatactacagatcaacaaagatgacgtaactgccctgcattgtaaagtggtatgccttatccagaatggaagtttcaaggaagctttgaatgtcatcaatactcacaccaaagtgttagccaataactctctctcctttgaaaaggcatattgcgagtacaggctgaacagaattgagaatgccttgaagacaatagaaagtgccaaccagcagacagacaaactgaaggagctttatggacaagtgttataccgtttggaacgctatgatgaatgcttagcagtgtatagagatctcgtccgaaactcccaagatgattatgatgaggagaggaaaacaaacctttcagcagttgttgcagctcaaagcaattgggaaaaagtggttccagagaacctgggcctccaagaaggcacacatgagctgtgctacaacactgcatgtgcactgataggccaaggccagctgaaccaggccatgaaaatcctacaaaaagctgaagatctttgccgccgttcattatcagaagacactgatgggactgaggaagacccacaggcagaactggccatcattcatggtcagatggcttatattctgcagcttcagggtcgaacagaggaggctttgcaactttacaatcaaataataaaactaaaaccaacagatgtgggattactagctgtaattgcaaataacatcattaccattaacaaggaccaaaatgtctttgactccaagaagaaagtgaaattaaccaatgcggaaggagtagagtttaagctttccaagaaacaactacaagctatagaatttaacaaagctttacttgctatgtacacaaaccaggctgaacaatgccgcaaaatatctgccagtttacagtcccaaagtcccgagcatctcttacctgtgttaatccaagctgcccagctctgccgtgaaaagcagcacacaaaagcaatagagctgcttcaggaattttcagatcagcatccagaaaatgcagctgaaattaagctgaccatggcacagttgaaaatttctcaaggtaatatttctaaagcatgtctaatattgagaagcatagaggagttaaagcataaaccaggcatggtatctgcattagttaccatgtatagccatgaagaagatattgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaaggacagggagatttgaaaaagaagaaaaagaaaaagaagggaaaattgcctaagaattatgacccaaaagttaccccagatccagaaagatggctgccaatgcgagaacgttcttactaccggggaagaaagaagggtaaaaagaaggatcagattggaaaagggacccagggagcaactgcaggagcttcatctgaactggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacccagtgttctgaggtcacatgggtttggactgtctcaatcagaaagattaatgactgttatcaagaacatgaacattggcttcctccatagagaagaaatcagtatctgagttgcataccaggcagtattaaaatctaacaggtctgtttggcccattgatagatactcaaatggtgtctccttctggttatggattttgaccattgattacctttctcaatgtaatgaagtattttacagtcaatttgtggtgtaaatgttgctcttgtctttccttgcttacaaactactttcacattgaacagctgtgagacagacatattgagatgcctgcccttgttagtattcattttatgctgcccaagatatcatttaatttagacttaacaagtatttccttgtgattatattactctgtccttgttaataaagtgctgctgtgtttgactctgaacatactaccaaaa

SEQ ID NO: 181542 - DNA, 2473 bp, Homo sapiens
  Payload ID: 15757
  Gene Symbol: SRP72
  Gene Name: signal recognition particle 72kDa
  Uniprot ID: O76094
  ENST ID: ENST00000510663
  CDS Start-End: 20-1852
gcccctcgtctcctccaagatggcgagcggcggcagcgggggggtgtcagtacctgcgctgtggagtgaagtgaaccggtatggccagaacggcgacttcacgcgcgctctcaagaccgtcaataagatactacagatcaacaaagatgacgtaactgccctgcattgtaaagtggtatgccttatccagaatggaagtttcaaggaagctttgaatgtcatcaatactcacaccaaagtgttagccaataactctctctcctttgaaaaggcatattgcgagtacaggctgaacagaattgagaatgccttgaagacaatagaaagtgccaaccagcagacagacaaactgaaggagctttatggacaagtgttataccgtttggaacgctatgatgaatgcttagcagtgtatagagatctcgtccgaaactcccaagatgattatgatgaggagaggaaaacaaacctttcagcagttgttgcagctcaaagcaattgggaaaaagtggttccagagaacctgggcctccaagaaggcacacatgagctgtgctacaacactgcatgtgcactgataggccaaggccagctgaaccaggccatgaaaatcctacaaaaagctgaagatctttgccgccgttcattatcagaagacactgaccaaaatgtctttgactccaagaagaaagtgaaattaaccaatgcggaaggagtagagtttaagctttccaagaaacaactacaagctatagaatttaacaaagctttacttgctatgtacacaaaccaggctgaacaatgccgcaaaatatctgccagtttacagtcccaaagtcccgagcatctcttacctgtgttaatccaagctgcccagctctgccgtgaaaagcagcacacaaaagcaatagagctgcttcaggaattttcagatcagcatccagaaaatgcagctgaaattaagctgaccatggcacagttgaaaatttctcaaggtaatatttctaaagcatgtctaatattgagaagcatagaggagttaaagcataaaccaggcatggtatctgcattagttaccatgtatagccatgaagaagatattgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaaggacagggagatttgaaaaagaagaaaaagaaaaagaagggaaaattgcctaagaattatgacccaaaagttaccccagatccagaaagatggctgccaatgcgagaacgttcttactaccggggaagaaagaagggtaaaaagaaggatcagattggaaaagggacccagggagcaactgcaggagcttcatctgaactggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatat

SEQ ID NO: 181543 - DNA, 1071 bp, Homo sapiens
  Payload ID: 15757
  Gene Symbol: SRP72
  Gene Name: signal recognition particle 72kDa
  ENST ID: ENST00000505314
  CDS Start-End: 1-1071
ggagaggaaaacaaacctttcagcagttgttgcagctcaaagcaattgggaaaaagtggttccagagaacctgggcctccaagaaggcacacatgagctgtgctacaacactgcatgtgcactgataggccaaggccagctgaaccaggccatgaaaatcctacaaaaagctgaagatctttgccgccgttcattatcagaagacactgatgggactgaggaagacccacaggcagaactggccatcattcatggtcagatggcttatattctgcagcttcagggtcgaacagaggaggctttgcaactttacaatcaaataataaaactaaaaccaacagatgtgggattactagctgtaattgcaaataacatcattaccattaacaaggctgaacaatgccgcaaaatatctgccagtttacagtcccaaagtcccgagcatctcttacctgtgttaatccaagctgcccagctctgccgtgaaaagcagcacacaaaagcaatagagctgcttcaggaattttcagatcagcatccagaaaatgcagctgaaattaagctgaccatggcacagttgaaaatttctcaaggtaatatttctaaagcatgtctaatattgagaagcatagaggagttaaagcataaaccaggcatggtatctgcattagttaccatgtatagccatgaagaagatattgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaaca

SEQ ID NO: 181544 - DNA, 745 bp, Homo sapiens
  Payload ID: 15757
  Gene Symbol: SRP72
  Gene Name: signal recognition particle 72kDa
  ENST ID: ENST00000504757
  CDS Start-End: 19-681
cccctcgtctcctccaagatggcgagcggcggcagcgggggggtgtcagtacctgcgctgtggagtgaagtgaaccggtatggccagaacggcgacttcacgcgcgctctcaagaccgtcaataagatactacagatcaacaaagatgacgtaactgccctgcattgtaaagtggtatgccttatccagaatggaagtttcaaggaagctttgaatgtcatcaatactcacaccaaagtgttagccaataactctctctcctttgaaaaggcatattgcgagtacaggctgaacagaattgagaatgccttgaagacaatagaaagtgccaaccagcagacagacaaactgaaggagctttatggacaagtgttataccgtttggaacgctatgatgaatgcttagcagtgtatagagatctcgtccgaaactcccaagatgattatgatgaggagaggaaaacaaacctttcagcagttgttgcagctcaaagcaattgggaaaaagtggttccagagaacctgggcctccaagaaggcacacatgagctgtgctacaacactgcatgtgcactgataggccaaggccagctgaaccaggccatgaaaatcctacaaaaagctgaaggttggaagtttgttaaacttatctgtaaatataacgtgcatataactttgtagagtatcttctaaaattgcatttgacttctgtgaaattattaaatggaagttattgatgcagtga

SEQ ID NO: 181545 - DNA, 1480 bp, Homo sapiens
  Payload ID: 15758
  Gene Symbol: SRP9
  Gene Name: signal recognition particle 9kDa
  Uniprot ID: P49458
  ENST ID: ENST00000304786
  CDS Start-End: 113-373
gccatcttggggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagtttgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtattttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatattagataaaatata

SEQ ID NO: 181546 - DNA, 540 bp, Homo sapiens
  Payload ID: 15758
  Gene Symbol: SRP9
  Gene Name: signal recognition particle 9kDa
  ENST ID: ENST00000366838
  CDS Start-End: 7-207
gccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagttcagtggcatttaaattactgtactttaagacatggaattgctggaggcttggaaacttgagtgcaatttccctagtacgacctccaaggagaatagagcaaaacagtgtgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatg

SEQ ID NO: 181547 - DNA, 1596 bp, Homo sapiens
  Payload ID: 15758
  Gene Symbol: SRP9
  Gene Name: signal recognition particle 9kDa
  Uniprot ID: P49458
  ENST ID: ENST00000366839
  CDS Start-End: 105-353
ggggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagttagacagtgtcttgctctattgctcaggctgcagtgcagtggcatgatcatagctcactgcatcctcgacctcctgggctcaagcggtcctcttgcttcagcctcctgaatagcagagactacagtgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtattttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatattagataaaatata

SEQ ID NO: 181548 - DNA, 377 bp, Homo sapiens
  Payload ID: 15758
  Gene Symbol: SRP9
  Gene Name: signal recognition particle 9kDa
  Uniprot ID: P49458
  ENST ID: ENST00000619790
  CDS Start-End: 129-377
ggtgcgaggaggcgccgccatcttggggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagttagacagtgtcttgctctattgctcaggctgcagtgcagtggcatgatcatagctcactgcatcctcgacctcctgggctcaagcggtcctcttgcttcagcctcctga

SEQ ID NO: 181549 - DNA, 329 bp, Homo sapiens
  Payload ID: 15758
  Gene Symbol: SRP9
  Gene Name: signal recognition particle 9kDa
  ENST ID: ENST00000626563
  CDS Start-End: 129-329
ggtgcgaggaggcgccgccatcttggggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagttcagtggcatttaaattactgtactttaagacatggaattgctggaggcttggaaacttga

SEQ ID NO: 181550 - DNA, 3069 bp, Homo sapiens
  Payload ID: 15759
  Gene Symbol: SRPR
  Gene Name: signal recognition particle receptor (docking protein)
  Uniprot ID: P08240
  ENST ID: ENST00000332118
  CDS Start-End: 156-2072
gatggggagggcacccggcgttctgagcggaagtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggaacggggaggtaacaactccttcacccatgaggcactcacactcaagtataaactggacaaccagtttgagctggtgtttgtggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcgtgaagcagaggagagcagtaagatccgtgctcccactaccatgaagaaatttgaagattctgaaaaggccaagaaacctgtgaggtccatgattgagacacggggggaaaagcccaaggaaaaagcaaagaatagcaaaaaaaagggggccaagaaggaaggttctgatggtcctttggctaccagcaaaccagtccctgcagaaaagtcaggtcttccagtgggtcctgagaacggagtagaactttccaaagaggagctgatccgcaggaagcgcgaggagttcattcagaagcatgggaggggtatggagaagtccaacaagtccacgaagtcagatgctccaaaggagaagggcaaaaaagcaccccgggtgtgggaactgggtggctgtgctaacaaagaagtgttggattacagtactcccaccaccaatggaacccctgaggctgccttgtctgaggacatcaacctgattcgagggactgggtctggggggcagcttcaggatctggactgcagcagctctgatgacgaaggggctgctcaaaactctaccaaacctagtgcgaccaagggaacactgggtggcatgtttggtatgctgaagggccttgtgggttcaaagagcttgagtcgtgaagacatggaatctgtgctggacaagatgcgtgatcatctcattgctaagaacgtggctgcagacattgccgtccagctctgtgaatctgttgccaacaagttggaagggaaggtgatggggacgttcagcacggtgacttccacagtaaagcaagccctacaggagtccctggtgcagattctgcagccacagcgtcgtgtagacatgctccgggacatcatggatgcccagcgtcgccagcgcccttatgtcgtcaccttctgcggcgttaatggagtggggaaatctactaatcttgccaagatttccttctggttgttagagaatggcttcagtgtcctcattgctgcctgtgatacatttcgtgctggggccgtggagcagctgcgtacacacacccggcgtttgagtgccctacaccctccagagaagcatggtggccgcaccatggtgcagttgtttgaaaagggctatggcaaggatgctgctggcattgccatggaagccattgcttttgcacgtaaccaaggctttgacgtggtgctggtggacacggcaggccgcatgcaagacaatgcccctctgatgactgccctggccaaactcattactgtcaatacacctgatttggtgctgtttgtaggagaagccttagtaggcaatgaagccgtggaccagctggtcaagttcaacagagccttggctgaccattctatggctcagacacctcggctcattgatggcattgttcttaccaaatttgataccattgatgacaaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagccagcgccaggtcttgaatggcacctctccctaggatacacagcctgcaggtccccaggacctggatgacacccgcctcactgtggcagtgtattgcctgttaattgctgctaattctaattctgatgatgactcctactccattgtttaccccaaagcatcagctaggctggagtgatttgttacaaatgagcaaaagatgagtccttgcttccctcagaaataaaaggagctcagctgcagcgttgcattgggcttcttggcctcccaactcttcccactcccagaatccagaagtaagctctgcatgttccccttcctgggaggaaaccaattgtcagaaggatgtatgatgaccccctcccctcccatccttcacctcctaagcagtcctggcttttcctcatcactcccctctacagtgcctggtagacaagtgctacattgaagaacacaaacctcttgttaagacttgtcctgtagcttgatattacagatgtgctattagtgcaataaggtgaaggctgtctgcccagagaaataagtaatttatataagaaaataaatttcataaataaattgccttttaggtcttgga

SEQ ID NO: 181551 - DNA, 2453 bp, Homo sapiens
  Payload ID: 15759
  Gene Symbol: SRPR
  Gene Name: signal recognition particle receptor (docking protein)
  Uniprot ID: P08240
  ENST ID: ENST00000532259
  CDS Start-End: 179-2011
agtcctgcgcgcccccgggcggagatggggagggcacccggcgttctgagcggaagtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcgtgaagcagaggagagcagtaagatccgtgctcccactaccatgaagaaatttgaagattctgaaaaggccaagaaacctgtgaggtccatgattgagacacggggggaaaagcccaaggaaaaagcaaagaatagcaaaaaaaagggggccaagaaggaaggttctgatggtcctttggctaccagcaaaccagtccctgcagaaaagtcaggtcttccagtgggtcctgagaacggagtagaactttccaaagaggagctgatccgcaggaagcgcgaggagttcattcagaagcatgggaggggtatggagaagtccaacaagtccacgaagtcagatgctccaaaggagaagggcaaaaaagcaccccgggtgtgggaactgggtggctgtgctaacaaagaagtgttggattacagtactcccaccaccaatggaacccctgaggctgccttgtctgaggacatcaacctgattcgagggactgggtctggggggcagcttcaggatctggactgcagcagctctgatgacgaaggggctgctcaaaactctaccaaacctagtgcgaccaagggaacactgggtggcatgtttggtatgctgaagggccttgtgggttcaaagagcttgagtcgtgaagacatggaatctgtgctggacaagatgcgtgatcatctcattgctaagaacgtggctgcagacattgccgtccagctctgtgaatctgttgccaacaagttggaagggaaggtgatggggacgttcagcacggtgacttccacagtaaagcaagccctacaggagtccctggtgcagattctgcagccacagcgtcgtgtagacatgctccgggacatcatggatgcccagcgtcgccagcgcccttatgtcgtcaccttctgcggcgttaatggagtggggaaatctactaatcttgccaagatttccttctggttgttagagaatggcttcagtgtcctcattgctgcctgtgatacatttcgtgctggggccgtggagcagctgcgtacacacacccggcgtttgagtgccctacaccctccagagaagcatggtggccgcaccatggtgcagttgtttgaaaagggctatggcaaggatgctgctggcattgccatggaagccattgcttttgcacgtaaccaaggctttgacgtggtgctggtggacacggcaggccgcatgcaagacaatgcccctctgatgactgccctggccaaactcattactgtcaatacacctgatttggtgctgtttgtaggagaagccttagtaggcaatgaagccgtggaccagctggtcaagttcaacagagccttggctgaccattctatggctcagacacctcggctcattgatggcattgttcttaccaaatttgataccattgatgacaaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagccagcgccaggtcttgaatggcacctctccctaggatacacag

SEQ ID NO: 181552 - DNA, 512 bp, Homo sapiens
  Payload ID: 15760
  Gene Symbol: SRPRB
  Gene Name: signal recognition particle receptor, B subunit
  ENST ID: ENST00000484684
  CDS Start-End: 235-512
atctcttaaaagatgtgtgtgtccctcgacaaataacctgtctgcccctatcgttctgtaggaggacggagtcccagagaactacaactcccatcaagcacttgggggatcgccgcggctgagggagagactatggcttaggaaccaccattcgcgtgaggctctgctccccgcgcctgcgcagagtgcagggccacgtcgcttttgctgtaccggggaccacgcgtctcatccatggcttccgcggactcgcgccgggtggcagatggcggcggtgccgggggcaccttccagccctacctagacaccttgcggcaggagctgcagcagacggacccaacgctgttgtcagtagtggtggcggttcttgcggtgctgctgacgctagtcttctggaagttaatccggagcagaaggagcagtcagagagctgttcttcttgttggcctttgtgattccgggaaaacgttgctctttgtcaggttgttaacaggcctttatagagacactca

SEQ ID NO: 181553 - DNA, 917 bp, Homo sapiens
  Payload ID: 15760
  Gene Symbol: SRPRB
  Gene Name: signal recognition particle receptor, B subunit
  ENST ID: ENST00000466636
  CDS Start-End: 1-482
gtctgaccttgattgaccttcccggccatgagagtttgaggcttcagttcttagagcggtttaagtcttcagccagggctattgtgtttgttgtggatagtgcagcattccagcgagaggtgaaagatgtggctgagtttctgtatcaagtcctcattgacagtatgggtctgaagaatacaccatcattcttaatagcctgcaataagcaagatattgcaatggcaaaatcagcaaagttaattcaacagcagctggagaaagaactcaacaccttacgagttacccgttctgctgcccccagcacactggacagttccagcactgcccctgctcagctggggaagaaaggcaaagagtttgaattctcacagttgcccctcaaagtggagttcctggagtgcagtgccaagggtggaagaggggacgtgggctctgctgacatccaggacttggagaaatggctggctaaaattgcctgagaggcagctctaaagcacaagacctggatgtgtgacacacagttttggaaaaagagatactgaaactggtctggccattgctcccctcagacctgggaacatgactgaatgtttaaggatgacaagaagagagcagcgatagatagcaaggaggcctctgaccaagggaaactgctgccaacagctaccaagccaactagccttggatcacacaactgcagccatggtgctcatgattctgatgtcacaccttcatgttgatgtatgtatgatcacccagcaagttaggagtgatcagaaccaatgtgtttccacttgtaaataggctgtttgctttttccatcttacactcaactttcctgatgcctgcagaacaggagctttgttgataagcttttaagattcacccccttcactcccaccatccccaaaaaa

SEQ ID NO: 181554 - DNA, 2827 bp, Homo sapiens
  Payload ID: 15760
  Gene Symbol: SRPRB
  Gene Name: signal recognition particle receptor, B subunit
  Uniprot ID: Q9Y5M8
  ENST ID: ENST00000466490
  CDS Start-End: 286-1101
gtaggccatggagccgagcagatccgggtcttcgggtggccgcaatgtcccaagtggacgacacccacctagtcccgaggacaaccgacaaagtccttaatgggcccagaaggaggacggagtcccagagaactacaactcccatcaagcacttgggggatcgccgcggctgagggagagactatggcttaggaaccaccattcgcgtgaggctctgctccccgcgcctgcgcagagtgcagggccacgtcgcttttgctgtaccggggaccacgcgtctcatccatggcttccgcggactcgcgccgggtggcagatggcggcggtgccgggggcaccttccagccctacctagacaccttgcggcaggagctgcagcagacggacccaacgctgttgtcagtagtggtggcggttcttgcggtgctgctgacgctagtcttctggaagttaatccggagcagaaggagcagtcagagagctgttcttcttgttggcctttgtgattccgggaaaacgttgctctttgtcaggttgttaacaggcctttatagagacactcagacgtccattactgacagctgtgctgtatacagagtcaacaataacaggggcaatagtctgaccttgattgaccttcccggccatgagagtttgaggcttcagttcttagagcggtttaagtcttcagccagggctattgtgtttgttgtggatagtgcagcattccagcgagaggtgaaagatgtggctgagtttctgtatcaagtcctcattgacagtatgggtctgaagaatacaccatcattcttaatagcctgcaataagcaagatattgcaatggcaaaatcagcaaagttaattcaacagcagctggagaaagaactcaacaccttacgagttacccgttctgctgcccccagcacactggacagttccagcactgcccctgctcagctggggaagaaaggcaaagagtttgaattctcacagttgcccctcaaagtggagttcctggagtgcagtgccaagggtggaagaggggacgtgggctctgctgacatccaggacttggagaaatggctggctaaaattgcctgagaggcagctctaaagcacaagacctggatgtgtgacacacagttttggaaaaaggtctgtggtagtctggagttgatgaggaaggggtacaagatgtggttagaaacatttctttgttctggaaacaaagtactgttgaaaccagcttggaattttttttttttttttttttaagttcagttctcccttatggctgcctttcaaacaagtaccttttatctgatgcctgtatcttccctttgttaaggtgtaacttgatgtagggtcaaggtttttgtgacaacaggcagactccacacagagaggatatgatgagaatatggccatcacctgaaaagttttcttatcttctgtgcttttggtccctggaaacaaatccgcctatgtatgaagctagttgatttccagttgcactatttccagttgcctctgaagttcacaggcaatacattgtctagtcctttgcgaatttctctgatttgtgggcacagttatgaagtttccccacatgtgaagacaggtacaaaatagcagagccaagcagacagtgggtctattcttcattagctcagtgacttgtccacactcgtcttagcacttacgtttcaaaagcttgtcacaaacccttggagtcattcccagataatagaactggaaatgataaatcccctaatgccaagggtctagtgtgttcttagtggttatactgggaagtgtgtggagatttaggtgctgctctgctgctctggatggctgaaggctcctgggccatcttcatgtgctgcttgaagagctcctattttgtactcctggctagaatgctgtggaacaaatacaaagtgaaaaaagttctctgtagatttctgaagtgcatattcattgatgccaagaaaaaaaaaaagttgcctttttgaagtgatgttttttgctgtcttcttaaacacaaggcttttttgaatgattagtatatttcatggtaaagaaaacagcctgtctggctcaaagcaattaaatagaatgtaatggtgagtacaaatgagtgcacatgtcaggactcaggtctaactccttgtctcctgagcctaaagattgcaacatacacaagaacacactcctattcctaccccacacactcagggacaagcccaactaaagcttacaaggagaccagggtggctctgtccaggggagaagccagttatggaacagtgcattgagagccatggtaggagaggcccacagttctctggagcatgcagcaggggcaccccacctggccttgaggatcagggggagtcaaaggataaagcatggggctgatgacgtctgagggagtgtgatcctccatgtatggcctctgcctgctgtctcacatgtcccttctggtggtcacttgggctctaggagtatacgtcacctcagaccatctggcagaaatactccaggctcctaccccaaagcacatgtcagccttgctgctggagcacgaagacaatgtaaatgaaacatgaaatggaggagttgtgagaccctgaccctgagtccttacttgaaagctgctgctggtgttctgagtgtcttttggactcttatttcttgcccttttccttattaggcaagcagtaacttaggaagtaggtaagagcaataaatgtgacatgttatgtcatcatagtaggagctcatgggaataaaagtcagtggcttgatgcttctgttagaggca

SEQ ID NO: 181555 - DNA, 9669 bp, Homo sapiens
  Payload ID: 15761
  Gene Symbol: SSR1
  Gene Name: signal sequence receptor, alpha
  Uniprot ID: P43307
  ENST ID: ENST00000244763
  CDS Start-End: 88-948
cggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgattttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcaggacagagatatttcccagttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaaagcagatagaagttattgtataattgttaatcactttgcaaataggggctatcaaattacctatattggcattgctggattataaactctatatctgtaatataaagtgtttgagtttttaattgggctgttatgatcagtagttgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatggcctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcatttttttttttttagcatagattgagaacagttgaactcttaaatcctcagatgccaggggtctgctctagcatcagtaagtatttagcagaaactaactccgtaatgaatggaattcaattccacacatggtttgttcaagcacacttaataagtagcctattttttaaatgtctttttaaaatgtaaatatttggatgaagtttttctttgttttgatatattcatttgctacaccaactatgttttcagaattcatcttttgaacaacttggtttcagaatatgtaaaatgactttaaggatcttgtgtatcaaacctatccccggatgtgtgagaataatgtgttcataaagcatggatctcgctttggttgtatagcttcctcatttacttcatggtcttacatagctggtgactttcagggctaatctgccctctaaagcattgtcccaggagaggaaaaggaaatgggacctcagaagtagaagcctcagggaaggagtaaagtagaaatcagaagaaaagaagcttcacttgatagtaataaggtttttaacttcaagtaccttcagaaaatgtgattttgataagaggaaagggcaaatttagaccttaaaaaatatggaagaactactgccttaaaagtgcatttgtggcacatcagcctagaactgtatcatggctgtgctggggagaagtaaatggtggtaatgtaacattgccacctttacttaatgatgtgttattttcgaggtacagtagatcaatatagtaataggcgagcctcatatatagcattcatcttgtacaatgatatccatacccttgatatgaaggaaaattgacttggtttgtgcatttgaatactgaaataattttttaaaactcagtgacacataccatctcttgccaagactagaccctgtattttagttcctaaattagatgtttaaatttaaaaacattttcagatgtacttaagtacttccatagtacttttttttttttttttttttttgccccctgagacggagtctctgtgtcacccaggctggagtgcagtggtgcgatctcggctcactgcaacttctgcctcttgggttcaagcagttctccctgtctcagcctcctgagtagcttggattacaggcgcccgtcaccgcacctgcctaatttttgcatttttagtagagacggggtttcgtcatttggccaggctggtcttgaactcctgaccacaggtgatacgcctgccttggcctcccaaagtgtgctgggattacaggcgtgagccactgtgcccggcccactgttcactttttgaatggcatcattttatagctgtagaactaaaatcaatgtttgccccaattttcttaagtaaaactctactttgagctcttacctccaacttagtaaaaagcagcttcacacacaaacaagattcttactggtggaatgttaggtttcgttgttaagttaatctgtctataagctcatccttagaggatatttgaggaggaagaacaccttgcagctgacttgcaaacatctaaataatttatttcgggtgcttatgaatgttactaatggattttgtatgaatttttatcccttttcatttatacaaaaacctgggcttttatgttaattatatcatctgaggttctaaggttttttttttagattttgaaatttagggataatagctcttaggtttgggtaccactttgctgcagtttaagaaagggggaagggaactcatttattaaacatcaatcacgtgctgtgttctgtttgttttctagtcatcatatcacacacctttacgacagctcactgaaggaaggtgatactgttcccattttgtagatggaatagacaaaacctgaatttaagtagcttgctcaaggttccatattgaatatggaaagttcaaatcatctcagtaatgaatataccatatatacttgctgtattgtatctatgataattcagttacccacaatacccttttaaatttctgttaatgacatacctttaaatgtctccttgatgaacagaatcatggtctttaaaaacattttcatgggttgattgcattttcaagctctaaaggattgaaagataaatcttcacgttaaaggtaagagtgaagtatctgctcttgggttacagaaccagatagtactagaactaagattacagggtaaagctgcttttatcttttttctttttctttttctttttttttttgacatggggtctcactgtattgcccaggctggaatgcagtggcatgatctcagctcacggcagcctctgcctcttgggctcaagcgattctcctgcttcagctttccaagtatttgggaccacaggcgcacaccacaggcctggctaatgtttttgttttgtttttggtagagacggggtttcaccatgttgccaggctggtctcgaactcctgagctcaagtgattcacccaccttggcctcacaaagtgtcaggcttacaggcgtgagccactgcgcccggctcacagggtaaggcttctgtctggtgtgttgtattacggattttgcttaataggcacagtgaggcattaaaaagaaaattcagtatgcctgtagaaaggataatccttgtttaaagtctccaaattgcagtcaaagatgttttgactgtgcctttttttgttcccctgctgtcccttatgtagacttctgtcagtacccatggcagcctgtcatcttgttgacatctccttctggactgtgagctctgtatctggcttgtttttcatccccagcttctagttcacaattaggtagaaccctattactctttgaagaaggaacaagaaaatgtgggccagttttcatttgccattcttccatgtgagttagtatggttcgtaagtattcctggtgatacgctagtattggcaattctgtgaggttgaacaaaggggtggtatggtgtgctagcgtgggaattaggagacctctgggtcttgacagtgccctggccactaagcaaaggcagttcatccttggagtctcaatgtgcttttttgttaattgagatatgcttgaagtatcagccctaaatagtctgattctgtgacctacaaacccttacttaattcagtgttactataaatgattcttcccttaaacctactttttacttagcaaaagagaaaaaaaaaaaaaggaaacgctcatgtcaggctgcctgggtttgaaccccagatcccctcttagttggaggcaagttgtatgatgcttcagcttttggttcctgcctcctaaggttgttaggagttactgtgtgtagctgcttagaacattgcctgggtctcagtaagccgcttaagtgactgctctcattttcgctgtaaagcaccatactgtaataacatcccatgaagcatggggcggggaagagtatatggtaccttatggactttgatgtggtggggtagtaggtaaattctgaatatgtaagctacatagtattctttttgtaactaaaggataaaagttttaagatgggcatgtaatatggctagcactggattttaatgatgagccagagtaataaggctggcaaggggagtttttgttttgtaataaatctcttacacctgcacatccagttctttttaaaaacacgtttgaagaggctccatatttctcagtgaagctgttggggttcatgttatttttgaaaatcatcttgcaatttatttcagcatcagactgaaccacccaaagaaaattagtctatttctgaacagttttttcagaaaccatattggtctgatcacccaacatttatagaaataggcgcttaaggcctagaggcatttcagaaaggagaatgagaaatactgtggtcaagagtagtgttcagatggagaacatcaagcatctgctctgcccttccacacacatcctcatttcatcttcacaactgccctaggtaaccttgttatctgtaatgaaacagcctcaaggagcacagaggcactcactcctcacgtttggtctgttgccatttccggcttggttggaatagggtaggagccttttggcagggagcacattctcagtaatgcagagtgcactcacctgggttctagcttcaacacttaggatttgcttgatattttgtattctctgaggcactgcctgtatttgtttctgctatcacagtccagagtcaagcttcatttataaagactgggcagggcatggtggctcactcctgtaattccagcactttgggaggctgaggtgggtggatcactttaggtcaggagttcaagaccagcctggccaacatggtgaaaccccatctctactaaaaaatacaaaaaggccgggcacggtggctcacacctgtaatcccaacactttgggaggccaaggtgggcagaacacctgaggtcaggagttcaagaccatcctggcgaacatagtgaaacctcgcctctactaaaaatacaaaaattagccaggtgtggtggtgcatgcctgtaatcccagctacttgggaggctgaggcaggagaattgcttaaacctgggaggtggagattgtggtgagctgagatcgtgccactgcactccagcctgggagatagaacgagactccatctcaaaaaagaacaaaaacaattagccgagcgaggtggtgcacgcctgtaatcccagctactcatgaggctgaggcaggagaatcacttgaacccaggaggaggaggttgtagtgagtcaaggttgcaccactgcactccagcctgggtgacagagtgagactgtctcaaaaaataagtacataaataataagtaaaagctactaacaattaaaaaataaataaataaagacaagactgtctggaaaatggctctcctaaaaggaccagttgccatcatccacagtggaagattcaaagcagttggtccttggtacgtatgagaagcggatttcattcccttgaattctacagagcagtttattagagtgaatgcattttaaggccttgcatttgatatgtcatccagttcataatcaagttgcctttttctggctaaaacataatgattatgtatttttctcatttggtcctacaagctgctggccctttgtccctccactgtgggaatcagatctagaggaggctgagcctgcagacacagcagtggccaaaaggtcactctaagtgttttgtcttgactccttacttgaagtccacccagctagcacacatctggtttatactgaagccccctgcctagaaatactcatttcaggaaccaccagtaagcatctgtgaccacacaggctttttgactgatggcttcccggatctggtttcaagggataaccccgtctgtgtgcatctatggtcttctctctacagcgaggactttgcagtgctgcttgtggtccacacaaggggctcagagctgagtctgaactgcttcatggtcaccagctcctgtcccttccagtcttgagaggcttttttctccagatggaacctttccttcccgccgttttctcggtctctggctgtttttctcttgtgcccgtctaattggacacctcctggcttccatctctgtggttctcctgcctcacttcctgttctgttgtttttccgttttgtcaaaatatctcctatgttcttggcttccttttcgtcgccaggttttcagctttcctttagctcttcttctaatatggcttctgcccacaaaagcctgctctgtcaggatctcatggttctccacttgccagaaccttcttcagcctcagttcctcggcctcaacttgtacgtttaacccattgaccaccaccccccaaattcaccttcatttctttgaccctgctcctcactccttttctgttgaggaatctgttgactaactccaggctcactcaggctcaccgtcctgctctctgcaccagcctttccagagcgtgccagttctcatggcttcatctgttaactgttgatcacttcagtcctgatttttagacctaaatggtttccttaacgccattctaactgcctgtgactcattttcacttacagtgtttattgtaacgccaaaccaacaaatcacaggtgcttgcttctctccataaatctccccagtctaactttttgtcattcaacatgactcgtttatccaacctgaaatcgcatatagccccaagtatggtgttttgtacacaggtatttaataagtgacttccagttttggctctgctatgaataaaaagagatttcagttctcttcactttgaaatctaacaactcagagaacattgaagaaattggaatttagttgggatgaaatacttgtggtttaaaatatttctgttcatattttctaatttgttgccggaggtcttgggttttctatttgagtgcttgcaaactcaatgtgatttctgtcagcatatcttaggtttgtttgttatgaaacttatgcagtgtgaggttctatctgaaaatgttatttagctatcttctgggactatttaatgaaagtggggtcatgaatccttaaaattcttgtgcagctttgagaaacatttctgttatttgggtatcagtttgtaagtgtggtaaagccaagatggaaacgagcactttgctttcttggttgttgttactggtctaacctcctgcttgaactagtctgctgtcctgtcaaatgcatctttttatttacatgtcccttaaattaaagctgatcatgaaagta

SEQ ID NO: 181556 - DNA, 3248 bp, Homo sapiens
  Payload ID: 15761
  Gene Symbol: SSR1
  Gene Name: signal sequence receptor, alpha
  ENST ID: ENST00000397511
  CDS Start-End: 79-954
gatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcatgcagagtagaagagataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgattttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcaggacagagatatttcccagttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaaagcagatagaagttattgtataattgttaatcactttgcaaataggggctatcaaattacctatattggcattgctggattataaactctatatctgtaatataaagtgtttgagtttttaattgggctgttatgatcagtagttgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatggcctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcatttttttttttttagcatagattgagaacagttgaactcttaaatcctcagatgccaggggtctgctctagcatcagtaagtatttagcagaaactaactccgtaatgaatggaattcaattccacacatggtttgttcaagcacacttaataagtagcctattttttaaatgtctttttaaaatgtaaatatttggatgaagtttttctttgttttgatatattcatttgctacaccaactatgttttcagaattcatcttttgaacaacttggtttcagaatatgtaaaatgactttaaggatcttgtgtatcaaacctatccccggatgtgtgagaataatgtgttcataaagcatggatctcgc

SEQ ID NO: 181557 - DNA, 1094 bp, Homo sapiens
  Payload ID: 15761
  Gene Symbol: SSR1
  Gene Name: signal sequence receptor, alpha
  ENST ID: ENST00000462112
  CDS Start-End: 69-866
aacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagtctggctctttcatccaggatggagtgcagtggcacaatcttgcttactgcaacctccgccttcggggctcaagtcatcctcccacctcagcttcctgagtagtcgaactacaggtgcacgccaccacacccagctaatttttgtatgttttgtagagacagggtttcgccatgttgcccaggctggtctcgaactcctgggctcaagctgtcctctcatgttggtttcccaaagtgttggaattgtaggcatgagccaccacactcagcctgcgttaatactcttaattatagaaacaatccttaattaataaacaagtcctttca

SEQ ID NO: 181558 - DNA, 1118 bp, Homo sapiens
  Payload ID: 15761
  Gene Symbol: SSR1
  Gene Name: signal sequence receptor, alpha
  ENST ID: ENST00000479365
  CDS Start-End: 63-863
attaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcagtaagtaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaa

SEQ ID NO: 181559 - DNA, 1808 bp, Homo sapiens
  Payload ID: 15761
  Gene Symbol: SSR1
  Gene Name: signal sequence receptor, alpha
  ENST ID: ENST00000474597
  CDS Start-End: 88-984
cggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcatgcagagtagaagagataaagcttcaccaagaaggttgcccaggaaacgggcacagaagagatcagtgggatctgatgaacgcaggaggagggagacgcactgatgacatcgggccgctcctgcagctcgggcgcctcgcagtctccaggtgcaaggccagcgcttccgccgtggctgcttcaggacatcccccagcacagccgttcctggagacccggccatcttttctgcatcgttttgcaatttgtgaaacttaggacagcagccgcctgttcaaccgggccctccgccggatggctctgggaagtcaccgctgggcatggctgtgtcactagggctttgtggctgatgaataacagctgtcgtgtgctgtttctgggtggagatgtcccaggaaaccagtcctactctgccagccagtaggatggggatgcaggtcccgccagcaaggactggctgaaccgtgcgacccatgcagtagggcccttgggtcagctgtccccacccactacactgatggtgaatgaggccagaagacagggggctctgcgtgaagcccaccagcccctgccacgtgatggttggaacgcgtaccttagagcttccagttccgtcttaggacattttcaaagatgagcgtcctcaggaggggcggtggagggggcatgtctggagggacctgaggcacggggagcgctcggtgcccaggccgagcagtgccacacgtgcgcacgagttatgcctgcaaacacgggttacgcctgtgagaccagtgggctccttccagccgggctgcctgaggccactgtctgtgtgttggtgcccattgtgggctccggggcgctcttcccttgtgctgacgtgagtggagttgaattgccctgaatcagattagactgaaataaactgaattgaaaggcctacaaa

SEQ ID NO: 181560 - DNA, 640 bp, Homo sapiens
  Payload ID: 15761
  Gene Symbol: SSR1
  Gene Name: signal sequence receptor, alpha
  ENST ID: ENST00000479485
  CDS Start-End: 1-312
atgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcagtaagtagtcttacagacttggctgggaagtttttctcttaagtggaaattaaataccttagatttagtttaaaaaaaaaactttttcagtactatttaacattcatcttttccattacttgtgtagaatctagtatagtgattaattaagaccttaaaggtttattcagtgtgtagtcttcttatgctttaatttggaaattcttccagatctgcagcttatttatgaatgtgtgaattttctgtgttcctaatccatttcctgtctcttttctttctgttgcttcagtgcagagtagaagaggtgaggcatttaatttttttaatggtttttgc

SEQ ID NO: 181561 - DNA, 1893 bp, Homo sapiens
  Payload ID: 15761
  Gene Symbol: SSR1
  Gene Name: signal sequence receptor, alpha
  ENST ID: ENST00000489567
  CDS Start-End: 55-711
cggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgattttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcaggacagagatatttcccagttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagg

SEQ ID NO: 181562 - DNA, 1116 bp, Homo sapiens
  Payload ID: 15762
  Gene Symbol: SSR2
  Gene Name: signal sequence receptor, beta (translocon-associated protein beta)
  Uniprot ID: P43308
  ENST ID: ENST00000295702
  CDS Start-End: 73-624
tttccggtctttcggatgctgacgctctcttcctgtctttgtggctccggaaaggcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattga

SEQ ID NO: 181563 - DNA, 476 bp, Homo sapiens
  Payload ID: 15762
  Gene Symbol: SSR2
  Gene Name: signal sequence receptor, beta (translocon-associated protein beta)
  ENST ID: ENST00000531790
  CDS Start-End: 26-298
cggaaaggcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgccccgtatcctcttggcacttgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaa

SEQ ID NO: 181564 - DNA, 1027 bp, Homo sapiens
  Payload ID: 15762
  Gene Symbol: SSR2
  Gene Name: signal sequence receptor, beta (translocon-associated protein beta)
  ENST ID: ENST00000473699
  CDS Start-End: 60-248
ggatgctgacgctctcttcctgtctttgtggctccggaaaggcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaaggcatgtacatgaagaaaaattgaggcaaggatgaacttggacctattgcctcctggatacttgattattttggtgcttctgagcaatagaatccagtccttgacctggattcttcagtgcaacagaaccaagttgctatattactcatatcttttgcaattctgatttttttggagaagcagtgctgcattagacgtggaactatctgatgattccttccctccagaagactttggcattgtgtctggaatgctcaatgtcaaatgggaccggattgccccgtatcctcttggcacttggtgatgaagggtcggggggcagggagagccttgcctgcaaagcagcaggggtacttcaaataggctggatatgtgtggctgtcctcctgtcatctctctggataagatggagcaagagagattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtg

SEQ ID NO: 181565 - DNA, 895 bp, Homo sapiens
  Payload ID: 15762
  Gene Symbol: SSR2
  Gene Name: signal sequence receptor, beta (translocon-associated protein beta)
  Uniprot ID: P43308
  ENST ID: ENST00000480567
  CDS Start-End: 164-715
cggtaagtccggaggcttagggcgtccgaacgggagaggcgagagcctcgtgtccgcgcatcaccccgtggctgggggttagctaggggagggcgggaagggcagaggacgcggtggctggaggacgtgtaaccttgcaagaggcgggaggcggggggcagagatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctg

SEQ ID NO: 181566 - DNA, 351 bp, Homo sapiens
  Payload ID: 15762
  Gene Symbol: SSR2
  Gene Name: signal sequence receptor, beta (translocon-associated protein beta)
  ENST ID: ENST00000526212
  CDS Start-End: 8-351
gtttgggatgccaacgggtgaagatggtaggagagtctggagaacgggtctgctctggtggcttatggactactctgtggaaggggctgctgttctgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccc

SEQ ID NO: 181567 - DNA, 849 bp, Homo sapiens
  Payload ID: 15762
  Gene Symbol: SSR2
  Gene Name: signal sequence receptor, beta (translocon-associated protein beta)
  ENST ID: ENST00000529008
  CDS Start-End: 31-312
ggctccggaaaggcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgccccctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgctt

SEQ ID NO: 181568 - DNA, 666 bp, Homo sapiens
  Payload ID: 15762
  Gene Symbol: SSR2
  Gene Name: signal sequence receptor, beta (translocon-associated protein beta)
  ENST ID: ENST00000466905
  CDS Start-End: 45-446
cttcctgtctttgtggctccggaaaggcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgaaccaacctcaggactctttggttctacctggtagttgatgggttaatagacataaaatcaaaggctttgctgccactttggaataaagttgtttgcagtgtgctccaaactcttggcttcctctccaagacaaaggaatgtggaccagactcaacccctcctctaataatgtacatttggattggctctaccagtgcacctggacagggaggaatcctggctcagcgggagtttgacaggcgattctcccctcatttt

SEQ ID NO: 181569 - DNA, 825 bp, Homo sapiens
  Payload ID: 15762
  Gene Symbol: SSR2
  Gene Name: signal sequence receptor, beta (translocon-associated protein beta)
  ENST ID: ENST00000496742
  CDS Start-End: 47-307
ctcttcctgtctttgtggctccggaaaggcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctatt

SEQ ID NO: 181570 - DNA, 555 bp, Homo sapiens
  Payload ID: 15762
  Gene Symbol: SSR2
  Gene Name: signal sequence receptor, beta (translocon-associated protein beta)
  ENST ID: ENST00000531917
  CDS Start-End: 115-555
ggcagaggacgcggtggctggaggacgtgtaaccttgcaagaggcgggaggcggggggcagaggtgattgacccccgcccccccgcccgtgggaccaagaaagggatgtgacagatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcatttt

SEQ ID NO: 181571 - DNA, 639 bp, Homo sapiens
  Payload ID: 15762
  Gene Symbol: SSR2
  Gene Name: signal sequence receptor, beta (translocon-associated protein beta)
  ENST ID: ENST00000474377
  CDS Start-End: 28-429
tccggaaaggcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgaaccaacctcaggactctttggttctacctggtagttgatgggttaatagacataaaatcaaaggctttgctgccactttggaataaagttgtttgcagtgtgctccaaactcttggcttcctctccaagacaaaggaatgtggaccagactcaacccctcctctaataatattggctctaccagtgcacctggacagggaggaatcctggctcagcgggagtttgacaggcgattctcccctcatttt

SEQ ID NO: 181572 - DNA, 1671 bp, Homo sapiens
  Payload ID: 15763
  Gene Symbol: SSR4
  Gene Name: signal sequence receptor, delta
  Uniprot ID: P51571
  ENST ID: ENST00000320857
  CDS Start-End: 1085-1606
gccacgcagtggctcagtgtgggagcatggcctagaggtcaaacctcttacccatcagggccaggtgctggctggcagctgcttcagatggtttccagcccacctaggacctaaattaacctcttcttaaataagtgtaaggaaagaagactcggacctgaatacgcaagaccgcacacggagaagagcagaagcaaaacccccgcagcctcagaaaccctagctccttcccattccaggcgcctcgaggggaaggcatctggggctctaagactgggggactatgggggatgactggcaaagtccggttctttgccaccgggataggtggcaaagcggtccacgagagaggaaaccgtggagaaatttgagtcccggaaccggattcccgaagcggtttgagaaaggcgggccgggatacgtgagtgactgcctcagaagggctccttcaaggacactaaggaggtgacagccgccgtggcccactctcccggcccgtccggagggccccccgccacccgatgcagaccccctgggggagccggtccagggccaacttcggccaatcccctcagtgacagcggaggcggccaatcaaccccggcgcgaagccctttccccgcccctggtggggcccctagccaatcggactccagactgcttcgggtgcggctaccccaccgctcccctgcgaccgctgccgcggtcccgtggctctttccctgctcacctcccagggacggcagagaagggctggcccgagcaccgccttcgcggcgctgccggcgacggtcgctaccttcagcgccatgacggaaagtgagagcctccgcacgtcccgacacgcagataccgctctcgcgagagttcgacggggtgcgaagtttcggggacaggcgcggacccggtactgcgcacgcgcgcggtcgcaccgattcacgcccccttccggcgcctagagcaccgctgccgccatgttgagggggggaccgcgaccagctgggcccctggctcagggaggggccacgtcagtgctgccagagacgtcacaatgccggcccagccgttcggcagagaagaggcgatggcggcgatggcatctctcggcgccctggcgctgctcctgctgtccagcctctcccgctgctcagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacagg

SEQ ID NO: 181573 - DNA, 526 bp, Homo sapiens
  Payload ID: 15763
  Gene Symbol: SSR4
  Gene Name: signal sequence receptor, delta
  ENST ID: ENST00000370085
  CDS Start-End: 15-461
gcagagaagaggcgatggcggcgatggcatctctcggcgccctggcgctgctcctgctgtccagcctctcccgctgctcagccgaggcctgcctggagccccagatcaccccttcctactacaccacttctgacgctgtcatttccactgagaccgtcttcattgtggagatctccctgacatgcaagaacagggtccaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacagg

SEQ ID NO: 181574 - DNA, 643 bp, Homo sapiens
  Payload ID: 15763
  Gene Symbol: SSR4
  Gene Name: signal sequence receptor, delta
  Uniprot ID: P51571
  ENST ID: ENST00000370086
  CDS Start-End: 50-571
tcgtgttcatgggagctcgttttcttttcctctaggcagagaagaggcgatggcggcgatggcatctctcggcgccctggcgctgctcctgctgtccagcctctcccgctgctcagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctggg

SEQ ID NO: 181575 - DNA, 745 bp, Homo sapiens
  Payload ID: 15763
  Gene Symbol: SSR4
  Gene Name: signal sequence receptor, delta
  Uniprot ID: P51571
  ENST ID: ENST00000370087
  CDS Start-End: 159-680
ccccaccgctcccctgcgaccgctgccgcggtcccgtggctctttccctgctcacctcccagggacggcagagaagggctggcccgagcaccgccttcgcggcgctgccggcgacggtcgctaccttcagcgccatgacggaaagcagagaagaggcgatggcggcgatggcatctctcggcgccctggcgctgctcctgctgtccagcctctcccgctgctcagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacagg

SEQ ID NO: 181576 - DNA, 3716 bp, Homo sapiens
  Payload ID: 15764
  Gene Symbol: SSR3
  Gene Name: signal sequence receptor, gamma (translocon-associated protein gamma)
  Uniprot ID: Q9UNL2
  ENST ID: ENST00000265044
  CDS Start-End: 96-653
gttagcggatacggcggccgcaggggcggagtcaagggcctttgcccgccttggcggccggctctacgttccctgttctcgcctgcagctccgccatggctcctaaaggcagctccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgaactacatattgtccataagtgcttcatcaggactcatcgccctcctgtctactggctccaaatagaccatgtcagcttcaccccctggctttgtgtctatgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaattaaatgaattgaaagggaaactcagagtactaggacgtttattaaaaggaaaaaaatgtcttgcaatgtgctgtaatcacaagaggagaaaataacttgtttccttgatctgtcagaggtcacagtaacctgggccgagctgttattatttattatataatagtagtaggaagttaataactggttctctgtgttccaagcacaatattacaacttcttttgaaccgtaaatatcagaatgaatcctcttcccaggggattgaacagaagcttaatgtttacaagtgtttgaatttgtgatctgaaataacacaaaattaaaaacatgatttctctaattttccaactagaggaagagaaacttgtggaaaagttctttttttttcttttttttttcttaaagaagggcagccaaggtagtaacctaaaaatagtgcccaggcatatgagagttgtcctacgaggttaaagaacacactgttccactgtatggctttggccctgagtggccagggaggtcaacttgaccctgccatgttggtttgacttactaagacacaggaatcactgttttccttgaccagggtctcacaccctggaggaatgttaagtaagagaaagaacctctttcctgaatattgacatgtaaaagaccaaagtaatttttctgaacttctgcaattctgagaactctccaaggaatttacagtgattttagtgcttgtcagcatttttccatgaggactttcatacatttgactctttagttcacaggttcccattgattgtgagcaagatatttatctctttagcccttggggatccagctgagagcaatctcttgcatttttttacccgtgtatgtacagatatcatttcttgtgtatgccatgacttgaaaaagtttgggaagctctttagcaatatcagctaaaaggatatgaaatcacaggtgatagcagttgtcattcagtaatttcctacaagcagcaccccaaaggaaatatagtcctaatctttactatccacttctaaatttaatgtgaatttcatacatgttattagttgttttctttataattttataaaaattattcatcgggagtttaacttccacttccatgctatcggatgtgttgggctccatgcaagaacttggaagaaaaacaggcaggaatgcatttgcataatgacccagatcatcattttctgcaactgagaattatatttcatcattgcttctagaagtctgcaattctttacttttctttggtgcattattatctaggtgccatcactggataatgtggagtgactagagaagtcacatatcactgtaaggtacagttagggtaacactttagaggtttattatttttaaaaaacttttcttgaactcctggccaacatggtgaaaccccgtctctactaaaaataccaaaattagccaggcgtgatggtgggcgcctgtaatctcagctacttgggaggctgaagcaggagaactgcctgaacccaggaggcagaggttgcggtgagtcgagatcgtgctactactgcctgggtggcaagggtgagactccatctcaaaaaagaaacaaaaaaacccaaaaagttttctttactgttggttaaaaaaaaaagccagaccatagtttgactggtggcatggaatttgtgtatcaaataaatgcatttgcttatttgacaaaccatcagtgtccactatttgttaccagagttgggccactatcttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttctcttgaattaataaactgaagatttgtaggaaaatgagtgagcaaaatttgtttactgttgtgaatttttcctacagcactgtttttaatcttgatgttttccaactttctgtactaatagatacatttctgtgcataagattataaagcatatactcacagttcagtagttttcgttaaggatttactgtgtgagtactttactgtgaggaattgcagaaccttttcccctctactcttgtctaaaagttctgtgtggcacacagagatgcgacctactcaatctgacttagtaaaaccatgctgtagaatttttgtcttaaaaagaccacatacccagcacccatgaaataaaagattcatctgtaattgggattcaaagtgattaaattcctttgttcatactcataaatagcactaaagtgttataacattttcatttacctatttttagttccttcattttaacttaataaaaatcttggattgatattcttttttttttttttttttttttgagacagcgtctcgctctgtcacccaggctggagtacagtggctctatcttggctcactgcgagctccgcctcccaggttcacgccattctcctgcctcagcctgccgagtagctgggactacaggcgcccgccaccacacccggctaatttttttgtatttttagtagagacggggtttcaccctgttagccaggatggtctcgatctcctgacctcgtgatccacctgcctcggcctcccaaagtgctggaattacaggcgtgagccaccgcgcccggcctagattgatattcttaagcaataaaagtttactggttgtcctatttgccatattattgaaacttggaaaggataatttgaaacaaggtttgaagttaactgaaatatggagattgaatttatactcaattcttgtgaaaagtcttgcttaataagtatgattaaactttgcttcttaaaatttg

SEQ ID NO: 181577 - DNA, 596 bp, Homo sapiens
  Payload ID: 15764
  Gene Symbol: SSR3
  Gene Name: signal sequence receptor, gamma (translocon-associated protein gamma)
  ENST ID: ENST00000463503
  CDS Start-End: 133-534
aatctctccagctcccctgagctcggggaggcacggagcctcttctttgggcacagtgttgtcgcttgggattgtcctgtgcagcactcggggaggtcacttgttaaaaggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgaactacatattgtccataagtgcttcatcaggactcatcgccctcctgtctactggctccaaatagaccatgtcagcttcaccccctggctttgtgtctatgggtggcctgtggtatatggaaaagta

SEQ ID NO: 181578 - DNA, 807 bp, Homo sapiens
  Payload ID: 15764
  Gene Symbol: SSR3
  Gene Name: signal sequence receptor, gamma (translocon-associated protein gamma)
  ENST ID: ENST00000476217
  CDS Start-End: 37-561
ggctctacgttccctgttctcgcctgcagctccgccatggctcctaaaggcagctccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgtatccttttcaaggaactacatattgtccataagtgcttcatcaggactcatcgccctcctgtctactggctccaaatagaccatgtcagcttcaccccctggctttgtgtctatgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaattaaatgaattgaaagggaaa

SEQ ID NO: 181579 - DNA, 579 bp, Homo sapiens
  Payload ID: 15764
  Gene Symbol: SSR3
  Gene Name: signal sequence receptor, gamma (translocon-associated protein gamma)
  ENST ID: ENST00000496050
  CDS Start-End: 157-558
attttggaatggcctgtgtttcgcatgctagtaccctgatgaatgaaatttgaagtctgacttgtgattacgttgagccagagtttgttctcattttagaagttgaaatctcatctggactagtaataggaagggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgaactacatattgtccataagtgcttcatcaggactcatcgccctcctgtctactggctccaaatagaccatgtcagcttcaccccct

SEQ ID NO: 181580 - DNA, 1039 bp, Homo sapiens
  Payload ID: 15764
  Gene Symbol: SSR3
  Gene Name: signal sequence receptor, gamma (translocon-associated protein gamma)
  Uniprot ID: Q9UNL2
  ENST ID: ENST00000467789
  CDS Start-End: 61-657
gggcctttgcccgccttggcggccggctctacgttccctgttctcgcctgcagctccgccatggctcctaaaggcagctccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaaggtttgactcctgtttaaagtatggccatcataaaaggggaatcttgtggaagaagaatgaagttgctgattatgaagctacaacattttccatcttctataacaacactctgttcctggtcgtggtcattgttgcttccttcttcatattgaagaacttcaaccccacagtgaactacatattgtccataagtgcttcatcaggactcatcgccctcctgtctactggctccaaatagaccatgtcagcttcaccccctggctttgtgtctatgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaattaaatgaattgaaagggaaactcagagtactaggacgtttattaaaaggaaaaaaatgtcttgcaatgtgctgtaatcacaagaggagaaaataacttgtttccttgatctgtcagaggtcacagtaacctgggccgagctgttattatttattatataatagtagtaggaagttaataactggttctctgtgttccaagcac

SEQ ID NO: 181581 - DNA, 4310 bp, Homo sapiens
  Payload ID: 15765
  Gene Symbol: STAT1
  Gene Name: signal transducer and activator of transcription 1, 91kDa
  Uniprot ID: P42224
  ENST ID: ENST00000361099
  CDS Start-End: 389-2641
gctgagcgcggagccgcccggtgattggtgggggcggaagggggccgggcgccagcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagaaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaacatccagatacacccaaagtatcaggacgagaatgagggtcctttgggaaaggagaagttaagcaacatctagcaaatgttatgcataaagtcagtgcccaactgttataggttgttggataaatcagtggttatttagggaactgcttgacgtaggaacggtaaatttctgtgggagaattcttacatgttttctttgctttaagtgtaactggcagttttccattggtttacctgtgaaatagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagctttactgtttgttatggcttaatgacactagctaatatcaatagaaggatgtacatttccaaattcacaagttgtgtttgatatccaaagctgaatacattctgctttcatcttggtcacatacaattatttttacagttctcccaagggagttaggctattcacaaccactcattcaaaagttgaaattaaccatagatgtagataaactcagaaatttaattcatgtttcttaaatgggctactttgtcctttttgttattagggtggtatttagtctattagccacaaaattgggaaaggagtagaaaaagcagtaactgacaacttgaataatacaccagagataatatgagaatcagatcatttcaaaactcatttcctatgtaactgcattgagaactgcatatgtttcgctgatatatgtgtttttcacatttgcgaatggttccattctctctcctgtactttttccagacacttttttgagtggatgatgtttcgtgaagtatactgtatttttacctttttccttccttatcactgacacaaaaagtagattaagagatgggtttgacaaggttcttcccttttacatactgctgtctatgtggctgtatcttgtttttccactactgctaccacaactatattatcatgcaaatgctgtattcttctttggtggagataaagatttcttgagttttgttttaaaattaaagctaaagtatctgtattgcattaaatataatatgcacacagtgctttccgtggcactgcatacaatctgaggcctcctctctcagtttttatatagatggcgagaacctaagtttcagttgattttacaattgaaatgactaaaaaacaaagaagacaacattaaaacaatattgtttctaattgctgaggtttagctgtcagttctttttgccctttgggaattcggcatggtttcattttactgcactagccaagagactttacttttaagaagtattaaaattctaaaattcta

SEQ ID NO: 181582 - DNA, 2716 bp, Homo sapiens
  Payload ID: 15765
  Gene Symbol: STAT1
  Gene Name: signal transducer and activator of transcription 1, 91kDa
  Uniprot ID: P42224
  ENST ID: ENST00000392322
  CDS Start-End: 307-2445
tcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagaaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagtgtaagtgaacacagaagagtgacatgtttacaaacctcaagccagccttgctcctggctggggcctgttgaagatgcttgtattttacttttccattgtaattgctatcgccatcacagctgaacttgttgagatccccgtgttactgcctatcagcattttactactttaaaaaaaaaaaaaaagccaaaaaccaaatttgtatttaaggtatataaattttcccaaaactgataccctttgaaaaagtataaataaaatgagcaaaagttgat

SEQ ID NO: 181583 - DNA, 2723 bp, Homo sapiens
  Payload ID: 15765
  Gene Symbol: STAT1
  Gene Name: signal transducer and activator of transcription 1, 91kDa
  ENST ID: ENST00000392323
  CDS Start-End: 413-2557
agcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagaaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcagggatacaccagtgcacagaatcctccaccaacatccatcccttcaagtggtgaaaacagacaataatgaaaataaaatatgtggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagtgtaagtgaacacagaagagtgacatgtttacaaacctcaagccagccttgctcctggctggggcctgttgaagatgcttgtattttacttttccattgtaattgctatcgccatcacagctgaacttgttgagatccccgtgttactgcctatcagcattttactacttt

SEQ ID NO: 181584 - DNA, 3097 bp, Homo sapiens
  Payload ID: 15765
  Gene Symbol: STAT1
  Gene Name: signal transducer and activator of transcription 1, 91kDa
  Uniprot ID: P42224
  ENST ID: ENST00000409465
  CDS Start-End: 433-2685
gtgcagttggacgccgggcgaggacgggccgtctgtgctgacccgcgaatagtgatcccagaggaagaacgcgtcctgagtattccaagtgcgagcagtgccacctgttctcggagatggcactgctcagcacgattgtccttgccagtcgtgctctggcagtgaagaggacttgtgaaatataattttcctctagaaggcactgcaccttcccatttaccgtcactttctcccgtttccacccctttccatcagtcacgttttcttcttttcgcagaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaacatccagatacacccaaagtatcaggacgagaatgagggtcctttgggaaaggagaagttaagcaacatctagcaaatgttatgcataaagtcagtgcccaactgttataggttgttggataaatcagtggttatttagggaactgcttgacgtaggaa

SEQ ID NO: 181585 - DNA, 663 bp, Homo sapiens
  Payload ID: 15765
  Gene Symbol: STAT1
  Gene Name: signal transducer and activator of transcription 1, 91kDa
  ENST ID: ENST00000415035
  CDS Start-End: 1-121
tagtcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaagatccacggggtaggaaactgctcactcagcatcctccccatggaagctcaagcatgggaacagcttcgggcctggtgcagctaaggaacattggccgtggtttcaccaaaggaggtgccatctaggtaatgggagggcagtggcaggagccactggcttagactggaagtgaaaatgaaagcacctggaggctgctggagtaaggtgccatcaggcatgtaaagtttagaagcagcagagtgtgctcatagaaaaagaaaaaaaaaggaatttgctgtatgtgataacaactaacattcatgtacttgagctcatttcactaaacacagcttcagag

SEQ ID NO: 181586 - DNA, 477 bp, Homo sapiens
  Payload ID: 15765
  Gene Symbol: STAT1
  Gene Name: signal transducer and activator of transcription 1, 91kDa
  ENST ID: ENST00000423282
  CDS Start-End: 1-175
tcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagtcactgtcttggggtgaatggatgtagccttcatgtaaaaacactgtgtggagcagctttatctgcattcaaacctcaagtcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattc

SEQ ID NO: 181587 - DNA, 2594 bp, Homo sapiens
  Payload ID: 15765
  Gene Symbol: STAT1
  Gene Name: signal transducer and activator of transcription 1, 91kDa
  ENST ID: ENST00000452281
  CDS Start-End: 367-948
gattggtgggggcggaagggggccgggcgccagcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagaaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagtgtaagtgaacacagaagagtgacatgtttacaaacctcaagccagccttgctcctggctggggcctgttgaagatgcttgtattttacttttccattgtaattgctatcgccatcacagctgaacttgttgagatccccgtgttactgcctatcagcattttactactttaaaaaaaaaaaaaaa

SEQ ID NO: 181588 - DNA, 736 bp, Homo sapiens
  Payload ID: 15765
  Gene Symbol: STAT1
  Gene Name: signal transducer and activator of transcription 1, 91kDa
  ENST ID: ENST00000424722
  CDS Start-End: 196-736
gggggccgggcgccagcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagagatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagag

SEQ ID NO: 181589 - DNA, 572 bp, Homo sapiens
  Payload ID: 15765
  Gene Symbol: STAT1
  Gene Name: signal transducer and activator of transcription 1, 91kDa
  ENST ID: ENST00000454414
  CDS Start-End: 123-572
aaactgcaccgcgcaaagccaggggcgtgggcgggcccgggctgctctacctgcgctcggaaagctagggctccaaagcgttcctgagcggtttttgaccgcgaatgtgatagtgctcatggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaag

SEQ ID NO: 181590 - DNA, 567 bp, Homo sapiens
  Payload ID: 15765
  Gene Symbol: STAT1
  Gene Name: signal transducer and activator of transcription 1, 91kDa
  ENST ID: ENST00000432058
  CDS Start-End: 359-567
gcagaccgagcctgaggacgcctatagaaactgccagaccccaacctctggttcaagggcagctacccaggctggctgagggtcacagcttaccagacaggacaagatctgagtcagtgcaagtgcaaactgtgtagatagcgaagtgaagcgggtaaaagagaccttttcaggacaaggaaagaaacggtggaagtgcaaggaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcg

SEQ ID NO: 181591 - DNA, 4216 bp, Homo sapiens
  Payload ID: 15765
  Gene Symbol: STAT1
  Gene Name: signal transducer and activator of transcription 1, 91kDa
  ENST ID: ENST00000540176
  CDS Start-End: 389-970
gctgagcgcggagccgcccggtgattggtgggggcggaagggggccgggcgccagcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagaaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaacatccagatacacccaaagtatcaggacgagaatgagggtcctttgggaaaggagaagttaagcaacatctagcaaatgttatgcataaagtcagtgcccaactgttataggttgttggataaatcagtggttatttagggaactgcttgacgtaggaacggtaaatttctgtgggagaattcttacatgttttctttgctttaagtgtaactggcagttttccattggtttacctgtgaaatagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagctttactgtttgttatggcttaatgacactagctaatatcaatagaaggatgtacatttccaaattcacaagttgtgtttgatatccaaagctgaatacattctgctttcatcttggtcacatacaattatttttacagttctcccaagggagttaggctattcacaaccactcattcaaaagttgaaattaaccatagatgtagataaactcagaaatttaattcatgtttcttaaatgggctactttgtcctttttgttattagggtggtatttagtctattagccacaaaattgggaaaggagtagaaaaagcagtaactgacaacttgaataatacaccagagataatatgagaatcagatcatttcaaaactcatttcctatgtaactgcattgagaactgcatatgtttcgctgatatatgtgtttttcacatttgcgaatggttccattctctctcctgtactttttccagacacttttttgagtggatgatgtttcgtgaagtatactgtatttttacctttttccttccttatcactgacacaaaaagtagattaagagatgggtttgacaaggttcttcccttttacatactgctgtctatgtggctgtatcttgtttttccactactgctaccacaactatattatcatgcaaatgctgtattcttctttggtggagataaagatttcttgagttttgttttaaaattaaagctaaagtatctgtattgcattaaatataatatgcacacagtgctttccgtggcactgcatacaatctgaggcctcctctctcagtttttatatagatggcgagaacctaagtttcagttgattttacaattgaaatgactaaaaaacaaagaagacaacattaaaacaatattgtttctaattgctgaggtttagctgtcagttctttttgccctttgggaattcggcatggtttcattttactgcactagccaagagactttacttttaagaagtattaaaattctaaaattc

SEQ ID NO: 181592 - DNA, 3259 bp, Homo sapiens
  Payload ID: 15766
  Gene Symbol: STAT2
  Gene Name: signal transducer and activator of transcription 2, 113kDa
  Uniprot ID: P52630
  ENST ID: ENST00000314128
  CDS Start-End: 25-2580
actgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaaggcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccactaggtgtgacagaggaactgcacatcatcagcttcacggtcaaatatacctaccagggtctgaagcaggagctgaaaacggacaccctccctgtggtgattatttccaacatgaaccagctctcaattgcctgggcttcagttctctggttcaatttgctcagcccaaaccttcagaaccagcagttcttctccaacccccccaaggccccctggagcttgctgggccctgctctcagttggcagttctcctcctatgttggccgaggcctcaactcagaccagctgagcatgctgagaaacaagctgttcgggcagaactgtaggactgaggatccattattgtcctgggctgacttcactaagcgagagagccctcctggcaagttaccattctggacatggctggacaaaattctggagttggtacatgaccacctgaaggatctctggaatgatggacgcatcatgggctttgtgagtcggagccaggagcgccggctgctgaagaagaccatgtctggcacctttctactgcgcttcagtgaatcgtcagaagggggcattacctgctcctgggtggagcaccaggatgatgacaaggtgctcatctactctgtgcaaccgtacacgaaggaggtgctgcagtcactcccgctgactgaaatcatccgccattaccagttgctcactgaggagaatatacctgaaaacccactgcgcttcctctatccccgaatcccccgggatgaagcttttgggtgctactaccaggagaaagttaatctccaggaacggaggaaatacctgaaacacaggctcattgtggtctctaatagacaggtggatgaactgcaacaaccgctggagcttaagccagagccagagctggagtcattagagctggaactagggctggtgccagagccagagctcagcctggacttagagccactgctgaaggcagggctggatctggggccagagctagagtctgtgctggagtccactctggagcctgtgatagagcccacactatgcatggtatcacaaacagtgccagagccagaccaaggacctgtatcacagccagtgccagagccagatttgccctgtgatctgagacatttgaacactgagccaatggaaatcttcagaaactgtgtaaagattgaagaaatcatgccgaatggtgacccactgttggctggccagaacaccgtggatgaggtttacgtctcccgccccagccacttctacactgatggacccttgatgccttctgacttctaggaaccacatttcctctgttcttttcatatctcttgcccttcctactcctcatagcatgatattgttctccaaggatgggaatcaggcatgtgtcccttccaagctgtgttaactgttcaaactcaggcctgtgtgactccattggggtgagaggtgaaagcataacatgggtacagaggggacaacaatgaatcagaacagatgctgagccataggtctaaataggatcctggaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggcccttggtggggagcacagacacaggataggactccatttctttcttccattccttcatgtctaggataacttgctttcttctttcctttactcctggctcaagccctgaatttcttcttttcctgcaggggttgagagctttctgccttagcctaccatgtgaaactctaccctgaagaaagggatggataggaagtagacctctttttcttaccagtctcctcccctactctgcccctaagctggctgtacctgttcctcccccataaaatgatcctgccaatctaa

SEQ ID NO: 181593 - DNA, 1548 bp, Homo sapiens
  Payload ID: 15766
  Gene Symbol: STAT2
  Gene Name: signal transducer and activator of transcription 2, 113kDa
  ENST ID: ENST00000418572
  CDS Start-End: 77-1459
agctcatactagggacgggaagtcgcgaccagagccattggagggcgcggggactgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaaggcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccactaggtgtgacagaggaactgcacatcatcagcttcacggtcaaatatacctaccagggtctgaagcaggagctgaaagtgagtgaaaatggagggcaaggagagagaaagcagctttggaagaaggcataagaaggggataaacagaagcctcttgggaaccagcagttcttctccaacccccccaaggccccctggagcttgctgggccctgctctcag

SEQ ID NO: 181594 - DNA, 3073 bp, Homo sapiens
  Payload ID: 15766
  Gene Symbol: STAT2
  Gene Name: signal transducer and activator of transcription 2, 113kDa
  Uniprot ID: P52630
  ENST ID: ENST00000557235
  CDS Start-End: 77-2620
agctcatactagggacgggaagtcgcgaccagagccattggagggcgcggggactgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaaggcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccactaggtgtgacagaggaactgcacatcatcagcttcacggtcaaatatacctaccagggtctgaagcaggagctgaaaacggacaccctccctgtggtgattatttccaacatgaaccagctctcaattgcctgggcttcagttctctggttcaatttgctcagcccaaaccttcagaaccagcagttcttctccaacccccccaaggccccctggagcttgctgggccctgctctcagttggcagttctcctcctatgttggccgaggcctcaactcagaccagctgagcatgctgagaaacaagctgttcgggcagaactgtaggactgaggatccattattgtcctgggctgacttcactaagcgagagagccctcctggcaagttaccattctggacatggctggacaaaattctggagttggtacatgaccacctgaaggatctctggaatgatggacgcatcatgggctttgtgagtcggagccaggagcgccggctgctgaagaagaccatgtctggcacctttctactgcgcttcagtgaatcgtcagaagggggcattacctgctcctgggtggagcaccaggatgatgacaaggtgctcatctactctgtgcaaccgtacacgaaggaggtgctgcagtcactcccgctgactgaaatcatccgccattaccagttgctcactgaggagaatatacctgaaaacccactgcgcttcctctatccccgaatcccccgggatgaagcttttgggtgctactaccaggagaaagttaatctccaggaacggaggaaatacctgaaacacaggctcattgtggtctctaatagacaggtggatgaactgcaacaaccgctggagcttaagccagagccagagctggagtcattagagctggaactagggctggtgccagagccagagctcagcctggacttagagccactgctgaaggcagggctggatctggggccagagctagagtctgtgctggagtccactctggagcctgtgatagagcccacactatgcatggtatcacaaacagtgccagagccagaccaaggacctgtatcacagccagtgccagagccagatttgccctgtgatctgagacatttgaacactgagccaatggaaatcttcagaaactgtgtaaagattgaagaaatcatgccgaatggtgacccactgttggctggccagaacaccgtggatgaggtttacgtctcccgccccagccacttctacactgatggacccttgatgccttctgacttctaggaaccacatttcctctgttcttttcatatctcttgcccttcctactcctcatagcatgatattgttctccaaggatgggaatcaggcatgtgtcccttccaagctgtgttaactgttcaaactcaggcctgtgtgactccattggggtgagaggtgaaagcataacatgggtacagaggggacaacaatgaatcagaacagatgctgagccataggtctaaataggatcctggaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggcccttggtggggagcacagacacaggataggactccatttctttcttccattccttcatgtct

SEQ ID NO: 181595 - DNA, 603 bp, Homo sapiens
  Payload ID: 15766
  Gene Symbol: STAT2
  Gene Name: signal transducer and activator of transcription 2, 113kDa
  ENST ID: ENST00000555646
  CDS Start-End: 58-255
aagtcgcgaccagagccattggagggcgcggggactgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaaggta

SEQ ID NO: 181596 - DNA, 5047 bp, Homo sapiens
  Payload ID: 15767
  Gene Symbol: STAT3
  Gene Name: signal transducer and activator of transcription 3 (acute-phase response factor)
  Uniprot ID: P40763
  ENST ID: ENST00000264657
  CDS Start-End: 314-2626
gaattatgcatgacggcgtgcctcggccaggctggggctgggcgaggattggctgaaggggctgtaattcagcggtttccggagctgcggcggcgcagactgggagggggagccgggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacagttgggacccctgattttagcaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtc

SEQ ID NO: 181597 - DNA, 2615 bp, Homo sapiens
  Payload ID: 15767
  Gene Symbol: STAT3
  Gene Name: signal transducer and activator of transcription 3 (acute-phase response factor)
  ENST ID: ENST00000389272
  CDS Start-End: 320-2338
gggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacagggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggag

SEQ ID NO: 181598 - DNA, 2633 bp, Homo sapiens
  Payload ID: 15767
  Gene Symbol: STAT3
  Gene Name: signal transducer and activator of transcription 3 (acute-phase response factor)
  Uniprot ID: P40763
  ENST ID: ENST00000404395
  CDS Start-End: 138-2447
ggatcctggacaggcaccccggcttggcgctgtctctccccctcggctcggagaggcccttcggcctgagggagcctcgccgcccgtccccggcacacgcgcagccccggcctctcggcctctgccggagaaacaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaa

SEQ ID NO: 181599 - DNA, 3319 bp, Homo sapiens
  Payload ID: 15767
  Gene Symbol: STAT3
  Gene Name: signal transducer and activator of transcription 3 (acute-phase response factor)
  Uniprot ID: P40763
  ENST ID: ENST00000585517
  CDS Start-End: 166-2334
gcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacagcaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaa

SEQ ID NO: 181600 - DNA, 571 bp, Homo sapiens
  Payload ID: 15767
  Gene Symbol: STAT3
  Gene Name: signal transducer and activator of transcription 3 (acute-phase response factor)
  ENST ID: ENST00000588065
  CDS Start-End: 320-571
gggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacaggcacagccaccacttcacttacattgtgggattataatttcatgagtagtggaatttccttaaccttctcttgtgtgggagctgaaggacaaaatgagatattctctgaagagtggttacatcatgcaaaactatgatgtgtaatgaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaat

SEQ ID NO: 181601 - DNA, 2772 bp, Homo sapiens
  Payload ID: 15767
  Gene Symbol: STAT3
  Gene Name: signal transducer and activator of transcription 3 (acute-phase response factor)
  Uniprot ID: P40763
  ENST ID: ENST00000588969
  CDS Start-End: 206-2518
gcggcggcgcagactgggagggggagccgggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatg

SEQ ID NO: 181602 - DNA, 2769 bp, Homo sapiens
  Payload ID: 15768
  Gene Symbol: STAT4
  Gene Name: signal transducer and activator of transcription 4
  Uniprot ID: Q14765
  ENST ID: ENST00000358470
  CDS Start-End: 259-2505
aaggctactcaaggagagtaggaggaggctaggtcaggaagggcaagcactggtggcctacccaggacttggcccaaccctctgggtcaggtcaccctcgtcggagtgagcggaccccgctggaattggagcccagtaaggtctatgagtttggtgttttgatcctggctacccatcccttccatcccaggggtggttcaccaggctgagtggagccttatactagggagagaggaagctgaagaactgggctccagcatgtctcagtggaatcaagtccaacagttagaaatcaagtttttggagcaggtggatcaattctatgatgacaactttcccatggaaattcggcatctgttggcccaatggattgaaaatcaagactgggaggcagcttctaacaatgaaaccatggcaacgattcttcttcaaaacttgttaatacaactggatgaacagttaggtcgtgtttccaaagagaaaaacctactcttgatacacaatctaaaaagaattaggaaggtccttcagggaaaatttcatggaaatccaatgcatgtagctgtggttatttcaaactgtttaagggaagagaggagaatattggctgcagccaacatgcctgtccaggggcctctagagaaatccttacaaagttcttcagtttcagaaagacagaggaatgtggagcacaaagtggctgccattaaaaacagtgtgcagatgacagaacaagataccaaatacttagaagatctgcaagacgaatttgactacaggtataaaacaattcagacaatggatcagagtgacaagaatagtgccatggtgaatcaggaagttttgacactgcaggaaatgcttaacagcctcgatttcaagagaaaggaggctctcagtaaaatgacccaaatcatccatgagacagacctgttaatgaacaccatgctcatagaagagctgcaagactggaagcggcggcagcaaatcgcctgcatcgggggtccactccacaatgggctcgaccagcttcagaactgctttacactattggcagaaagtcttttccaactgagaaggcaattggagaaactagaggagcaatctaccaaaatgacatatgaaggtgatcccattccaatgcaaagaactcacatgctagaaagagtcaccttcttgatctacaaccttttcaagaactcatttgtggttgagcgacagccatgtatgccaacccaccctcagaggccgttggtacttaaaaccctaattcagttcactgtaaaactaaggctactaataaaattgccagaactaaactatcaggtaaaggttaaggcatcaattgacaagaatgtttcaactctaagcaaccgaagatttgtactttgtggaactaatgtcaaagccatgtctattgaagaatcttccaatgggagtctctcagtagaatttcgacatttgcaaccaaaggaaatgaagtccagtgctggaggtaaaggaaatgagggctgtcacatggtgactgaagaacttcattccataacgtttgaaacacagatctgcctctatggcctgaccatagatttggagaccagctcattgcctgtggtgatgatttccaatgtcagtcagttacctaatgcttgggcatccatcatttggtacaacgtgtcaaccaacgattcccagaacttggttttctttaataatcctccacctgccacattgagtcaactactggaggtgatgagctggcagttttcatcgtacgttggtcgtggtcttaactcagatcaactccatatgctggcagagaagcttacagtccaatctagctacagtgatggtcacctcacctgggccaagttctgcaaggaacatttacctggtaaatcatttaccttttggacatggcttgaagcaatattggatctaattaagaaacacattcttcccctttggattgatgggtatgtcatgggctttgttagcaaagagaaggaacggctgttgctaaaggataaaatgcctggcacctttttattaagattcagtgaaagccatctcggaggaataactttcacctgggtggaccattctgaaagtggggaagtgagattccactctgtagaaccctacaataaaggccggttgtctgctctgccattcgctgacatcctgcgagactacaaagttattatggctgaaaacattcctgaaaaccctctgaagtacctatatcctgacattcccaaagacaaagccttcggtaaacactacagctctcagccttgcgaagtttcaagaccaacagaaaggggtgacaaaggttatgttccttctgtttttatccccatctcaacaatccgaagtgattcaacagagccacattctccatcagaccttcttcccatgtctccaagtgtgtatgcggtgttgagagaaaacctgagtcccacaacaattgaaactgcaatgaagtctccttattctgctgaatgacaggataaactctgacgcaccaagaaaggaagcaaatgaaaaagtttaaagactgttctttgcccaataaccacattttatttcttcagctttgtaaataccaggttctaggaaatgtttgacatctgaagctctcttcacactcccgtggcactcctcaattgggagtgttgtgactgaaatgcttgaaaccaaagcttcagataaacttgcaagataagacaactttaagaaaccagtgttaataacaatattaacagaaga

SEQ ID NO: 181603 - DNA, 2822 bp, Homo sapiens
  Payload ID: 15768
  Gene Symbol: STAT4
  Gene Name: signal transducer and activator of transcription 4
  Uniprot ID: Q14765
  ENST ID: ENST00000392320
  CDS Start-End: 316-2562
tttttcctggcactgctgagccacctgcagttgcgagagccgctgggagggataagagggaagaggacgcccggtgaaggggctccagcctggcagtttctgcgtgttagcatttctagaatagagtgggtgggaactgacccaagtaaagtcccagagactcgaacactgacgcacaggaaagcctcaagtgggaggagaaatgcaaatcccctactgatgatggcgtcagcggctttctcctagggactgtgaggggcgcttctgactttggacttgagcactgcctgggacctgtgctgagagagcgctagcatgtctcagtggaatcaagtccaacagttagaaatcaagtttttggagcaggtggatcaattctatgatgacaactttcccatggaaattcggcatctgttggcccaatggattgaaaatcaagactgggaggcagcttctaacaatgaaaccatggcaacgattcttcttcaaaacttgttaatacaactggatgaacagttaggtcgtgtttccaaagagaaaaacctactcttgatacacaatctaaaaagaattaggaaggtccttcagggaaaatttcatggaaatccaatgcatgtagctgtggttatttcaaactgtttaagggaagagaggagaatattggctgcagccaacatgcctgtccaggggcctctagagaaatccttacaaagttcttcagtttcagaaagacagaggaatgtggagcacaaagtggctgccattaaaaacagtgtgcagatgacagaacaagataccaaatacttagaagatctgcaagacgaatttgactacaggtataaaacaattcagacaatggatcagagtgacaagaatagtgccatggtgaatcaggaagttttgacactgcaggaaatgcttaacagcctcgatttcaagagaaaggaggctctcagtaaaatgacccaaatcatccatgagacagacctgttaatgaacaccatgctcatagaagagctgcaagactggaagcggcggcagcaaatcgcctgcatcgggggtccactccacaatgggctcgaccagcttcagaactgctttacactattggcagaaagtcttttccaactgagaaggcaattggagaaactagaggagcaatctaccaaaatgacatatgaaggtgatcccattccaatgcaaagaactcacatgctagaaagagtcaccttcttgatctacaaccttttcaagaactcatttgtggttgagcgacagccatgtatgccaacccaccctcagaggccgttggtacttaaaaccctaattcagttcactgtaaaactaaggctactaataaaattgccagaactaaactatcaggtaaaggttaaggcatcaattgacaagaatgtttcaactctaagcaaccgaagatttgtactttgtggaactaatgtcaaagccatgtctattgaagaatcttccaatgggagtctctcagtagaatttcgacatttgcaaccaaaggaaatgaagtccagtgctggaggtaaaggaaatgagggctgtcacatggtgactgaagaacttcattccataacgtttgaaacacagatctgcctctatggcctgaccatagatttggagaccagctcattgcctgtggtgatgatttccaatgtcagtcagttacctaatgcttgggcatccatcatttggtacaacgtgtcaaccaacgattcccagaacttggttttctttaataatcctccacctgccacattgagtcaactactggaggtgatgagctggcagttttcatcgtacgttggtcgtggtcttaactcagatcaactccatatgctggcagagaagcttacagtccaatctagctacagtgatggtcacctcacctgggccaagttctgcaaggaacatttacctggtaaatcatttaccttttggacatggcttgaagcaatattggatctaattaagaaacacattcttcccctttggattgatgggtatgtcatgggctttgttagcaaagagaaggaacggctgttgctaaaggataaaatgcctggcacctttttattaagattcagtgaaagccatctcggaggaataactttcacctgggtggaccattctgaaagtggggaagtgagattccactctgtagaaccctacaataaaggccggttgtctgctctgccattcgctgacatcctgcgagactacaaagttattatggctgaaaacattcctgaaaaccctctgaagtacctatatcctgacattcccaaagacaaagccttcggtaaacactacagctctcagccttgcgaagtttcaagaccaacagaaaggggtgacaaaggttatgttccttctgtttttatccccatctcaacaatccgaagtgattcaacagagccacattctccatcagaccttcttcccatgtctccaagtgtgtatgcggtgttgagagaaaacctgagtcccacaacaattgaaactgcaatgaagtctccttattctgctgaatgacaggataaactctgacgcaccaagaaaggaagcaaatgaaaaagtttaaagactgttctttgcccaataaccacattttatttcttcagctttgtaaataccaggttctaggaaatgtttgacatctgaagctctcttcacactcccgtggcactcctcaattgggagtgttgtgactgaaatgcttgaaaccaaagcttcagataaacttgcaagataagacaactttaagaaaccagtgttaataacaatattaacag

SEQ ID NO: 181604 - DNA, 709 bp, Homo sapiens
  Payload ID: 15768
  Gene Symbol: STAT4
  Gene Name: signal transducer and activator of transcription 4
  ENST ID: ENST00000409995
  CDS Start-End: 27-380
gggacctgtgctgagagagcgctagcatgtctcagtggaatcaagtccaacagttagaaatcaagtttttggagcaggtggatcaattctatgatgacaactttcccatggaaattcggcatctgttggcccaatggattgaaaatcaagactgggaggcagcttctaacaatgaaaccatggcaacgattcttcttcaaaacttgttaatacaactggatgaacagttaggtcgtgtttccaaagagaaaaacctactcttgatacacaatctaaaaagaattaggaaggtccttcagtccccagggttggctacagcacagctgcccttggatcgacatggagaaacctgcattcaaaggtccaaatcttgtccctaggacttagcttcttcacctgggacattcagatgatactaattgaggaaaccaagatacaggaatttagtacccatctattccttctaatacaaaacatcggagaattctggcttttgcaaactgttgttgacattttatacccagatgttaccattacctttgaagcctcttgtgcctcctccctgacaccactctgctctctttccgcctggagcaaccactgacccaaaatttgcatttgtcattttttttctttttgttgccattttaccacatacatttgcatccctaaacaataaagtgtctaggtttgaaagctgctaaatcca

SEQ ID NO: 181605 - DNA, 548 bp, Homo sapiens
  Payload ID: 15768
  Gene Symbol: STAT4
  Gene Name: signal transducer and activator of transcription 4
  ENST ID: ENST00000413064
  CDS Start-End: 258-548
aggtcaggaagggcaagcactggtggcctacccaggacttggcccaaccctctgggtcaggtcaccctcgtcggagtgagcggaccccgctggaattggagcccagtaaggtctatgagtttggtgttttgatcctggctacccatcccttccatcccaggggtggttcaccaggctgagtggagccttatactagggagagaggaagctgaagaactgggctccaggtggatcaattctatgatgacaactttcccatggaaattcggcatctgttggcccaatggattgaaaatcaagactgggaggcagcttctaacaatgaaaccatggcaacgattcttcttcaaaacttgttaatacaactggatgaacagttaggtcgtgtttccaaagagaaaaacctactcttgatacacaatctaaaaagaattaggaaggtccttcagggaaaatttcatggaaatccaatgcatgtagctgtggttatttcaaactgtttaagggaagagaggagaatattggctgcagccaacatgcctgtccag

SEQ ID NO: 181606 - DNA, 569 bp, Homo sapiens
  Payload ID: 15768
  Gene Symbol: STAT4
  Gene Name: signal transducer and activator of transcription 4
  ENST ID: ENST00000450994
  CDS Start-End: 333-569
aggggcaaggctactcaaggagagtaggaggaggctaggtcaggaagggcaagcactggtggcctacccaggacttggcccaaccctctgggtcaggtcaccctcgtcggagtgagcggaccccgctggaattggagcccagtaaggtctatgagtttggtgttttgatcctggctacccatcccttccatcccaggggtggttcaccaggctgagtggagccttatactagggagagaggaagctgaagaactgggctccagggactgtgaggggcgcttctgactttggacttgagcactgcctgggacctgtgctgagagagcgctagcatgtctcagtggaatcaagtccaacagttagaaatcaagtttttggagcaggtggatcaattctatgatgacaactttcccatggaaattcggcatctgttggcccaatggattgaaaatcaagactgggaggcagcttctaacaatgaaaccatggcaacgattcttcttcaaaacttgttaatacaactggatgaacagttaggtcgtgtttccaaagagaaaaacctactcttg

SEQ ID NO: 181607 - DNA, 474 bp, Homo sapiens
  Payload ID: 15768
  Gene Symbol: STAT4
  Gene Name: signal transducer and activator of transcription 4
  ENST ID: ENST00000432798
  CDS Start-End: 399-474
ggggcaaggctactcaaggagagtaggaggaggctaggtcaggaagggcaagcactggtggcctacccaggacttggcccaaccctctgggtcaggtcaccctcgtcggagtgagcggaccccgctggaattggagcccagtaaggtctatgagtttggtgttttgatcctggctacccatcccttccatcccaggggtggttcaccaggctgagtggagccttatactagggagagaggaagctgaagaactgggctccaggaaagcctcaagtgggaggagaaatgcaaatcccctactgatgatggcgtcagcggctttctcctagggactgtgaggggcgcttctgactttggacttgagcactgcctgggacctgtgctgagagagcgctagcatgtctcagtggaatcaagtccaacagttagaaatcaagtttttggagcaggtggatcaattctatgatgacaact

SEQ ID NO: 181608 - DNA, 4301 bp, Homo sapiens
  Payload ID: 15769
  Gene Symbol: STAT5A
  Gene Name: signal transducer and activator of transcription 5A
  Uniprot ID: P42229
  ENST ID: ENST00000345506
  CDS Start-End: 643-3027
agacaggatattcactgctgtggcaaggcctgtagagagtttcgaagttaggaggactcaagacggtccctccctggacttttctgaaggggctcaaaagatgacacgcgccagagctggaaggcgtcgccaattggtccacttttccctcctccctttttgcggatgagaaaactgaggcccaggtttgggatttccagagcccgggatttcccggcaacgcccgacaaccacattcccccggctattctgacccgccccggttccgggacgctccctgggagccgccgccgagggcctgctgggactcccgggggaccccgccgtcggggcagcccccacgcccggcgccgcccgccgggaacggccgccgctgttgcgcacttgcaggggagccggcgactgagggcgaggcagggagggagcaagcggggctgggagggctgctggcgcgggctcgcgcgctgtgtatggtctatcgcaggcagctgacctttgaggaggaaatcgctgctctccgctccttcctgtagtaacagccgccgctgccgccgccgccaggaaccccggccgggagcgagagccgcggggcgcagagccggcccggctgccggacggtgcggccccaccaggtgaacggccatggcgggctggatccaggcccagcagctgcagggagacgcgctgcgccagatgcaggtgctgtacggccagcacttccccatcgaggtccggcactacttggcccagtggattgagagccagccatgggatgccattgacttggacaatccccaggacagagcccaagccacccagctcctggagggcctggtgcaggagctgcagaagaaggcggagcaccaggtgggggaagatgggtttttactgaagatcaagctggggcactacgccacgcagctccagaaaacatatgaccgctgccccctggagctggtccgctgcatccggcacattctgtacaatgaacagaggctggtccgagaagccaacaattgcagctctccggctgggatcctggttgacgccatgtcccagaagcaccttcagatcaaccagacatttgaggagctgcgactggtcacgcaggacacagagaatgagctgaagaaactgcagcagactcaggagtacttcatcatccagtaccaggagagcctgaggatccaagctcagtttgcccagctggcccagctgagcccccaggagcgtctgagccgggagacggccctccagcagaagcaggtgtctctggaggcctggttgcagcgtgaggcacagacactgcagcagtaccgcgtggagctggccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacattcatcattgagaagcagcctcctcaggtcctgaagacccagaccaagtttgcagccaccgtacgcctgctggtgggcgggaagctgaacgtgcacatgaatcccccccaggtgaaggccaccatcatcagtgagcagcaggccaagtctctgcttaaaaatgagaacacccgcaacgagtgcagtggtgagatcctgaacaactgctgcgtgatggagtaccaccaagccacgggcaccctcagtgcccacttcaggaacatgtcactgaagaggatcaagcgtgctgaccggcggggtgcagagtccgtgacagaggagaagttcacagtcctgtttgagtctcagttcagtgttggcagcaatgagcttgtgttccaggtgaagactctgtccctacctgtggttgtcatcgtccacggcagccaggaccacaatgccacggctactgtgctgtgggacaatgcctttgctgagccgggcagggtgccatttgccgtgcctgacaaagtgctgtggccgcagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtccgtgtcctggtcccagttcaacagggagaacttgccgggctggaactacaccttctggcagtggtttgacggggtgatggaggtgttgaagaagcaccacaagccccactggaatgatggggccatcctaggttttgtgaataagcaacaggcccacgacctgctcatcaacaagcccgacgggaccttcttgttgcgctttagtgactcagaaatcgggggcatcaccatcgcctggaagtttgactccccggaacgcaacctgtggaacctgaaaccattcaccacgcgggatttctccatcaggtccctggctgaccggctgggggacctgagctatctcatctatgtgtttcctgaccgccccaaggatgaggtcttctccaagtactacactcctgtgctggctaaagctgttgatggatatgtgaaaccacagatcaagcaagtggtccctgagtttgtgaatgcatctgcagatgctgggggcagcagcgccacgtacatggaccaggccccctccccagctgtgtgcccccaggctccctataacatgtacccacagaaccctgaccatgtactcgatcaggatggagaattcgacctggatgagaccatggatgtggccaggcacgtggaggaactcttacgccgaccaatggacagtcttgactcccgcctctcgccccctgccggtcttttcacctctgccagaggctccctctcatgaatgtttgaatcccacgcttctctttggaaacaatatgcaatgtgaagcggtcgtgttgtgagtttagtaaggctgtgtacactgacacctttgcaggcatgcatgtgcttgtgtgtgtgtgtgtgtgtgtgtccttgtgcatgagctacgcctgcctcccctgtgcagtcctgggatgtggctgcagcagcggtggcctcttttcagatcatggcatccaagagtgcgccgagtctgtctctgtcatggtagagaccgagcctctgtcactgcaggcactcaatgcagccagacctattcctcctgggcccctcatctgctcagcagctatttgaatgagatgattcagaaggggaggggagacaggtaacgtctgtaagctgaagtttcactccggagtgagaagctttgccctcctaagagagagagacagagagacagagagagagaaagagagagtgtgtgggtctatgtaaatgcatctgtcctcatgtgttgatgtaaccgattcatctctcagaagggaggctggggttcattttcgagtagtattttatactttagtgaacgtggactccagactctctgtgaaccctatgagagcgcgtctgggcccggccatgtccttagcacaggggggccgccggtttgagtgagggtttctgagctgctctgaattagtccttgcttggctgcttggccttgggcttcattcaagtctatgatgctgttgcccacgtttcccgggatatatattctctcccctccgttgggccccagccttctttgcttgcctctctgtttgtaaccttgtcgacaaagaggtagaaaagattgggtctaggatatggtgggtggacaggggccccgggacttggagggttggtcctcttgcctcctggaaaaaacaaaaacaaaaaactgcagtgaaagacaagctgcaaatcagccatgtgctgcgtgcctgtggaatctggagtgaggggtaaaagctgatctggtttgactccgctggaggtggggcctggagcaggccttgcgctgttgcgtaactggctgtgttctggtgaggccttgctcccaaccccacacgctcctccctctgaggctgtaggactcgcagtcaggggcagctgaccatggaagattgagagcccaaggtttaaacttctctgaagggaggtggggatgagaagaggggtttttttgtactttgtacaaagaccacacatttgtgtaaacagtgttttggaataaaatatttttttcataaa

SEQ ID NO: 181609 - DNA, 515 bp, Homo sapiens
  Payload ID: 15769
  Gene Symbol: STAT5A
  Gene Name: signal transducer and activator of transcription 5A
  ENST ID: ENST00000444283
  CDS Start-End: 141-515
aacagccgccgctgccgccgccgccaggaaccccggccgggagcgagagccgcggggcgcagagccggcccggctgccggacggtgcggccccaccagaggagagcgcttcagcgctcggctcgccctaggtgaacggccatggcgggctggatccaggcccagcagctgcagggagacgcgctgcgccagatgcaggtgctgtacggccagcacttccccatcgaggtccggcactacttggcccagtggattgagagccagccatgggatgccattgacttggacaatccccaggacagagcccaagccacccagctcctggagggcctggtgcaggagctgcagaagaaggcggagcaccaggtgggggaagatgggtttttactgaagatcaagctggggcactacgccacgcagctccagaaaacatatgaccgctgccccctggagctggtccgctgcatccggcacattctgtacaatgaacagaggctggtccgagaagccaacaat

SEQ ID NO: 181610 - DNA, 3086 bp, Homo sapiens
  Payload ID: 15769
  Gene Symbol: STAT5A
  Gene Name: signal transducer and activator of transcription 5A
  Uniprot ID: P42229
  ENST ID: ENST00000546010
  CDS Start-End: 534-2828
gccagagctggaaggcgtcgccaattggtccacttttccctcctccctttttgcggatgagaaaactgaggcccaggtttgggatttccagagcccgggatttcccggcaacgcccgacaaccacattcccccggctattctgacccgccccggttccgggacgctccctgggagccgccgccgagggcctgctgggactcccgggggaccccgccgtcggggcagcccccacgcccggcgccgcccgccgggaacggccgccgctgttgcgcacttgcaggggagccggcgactgagggcgaggcagggagggagcaagcggggctgggagggctgctggcgcgggctcgcgcgctgtgtatggtctatcgcaggcagctgacctttgaggaggaaatcgctgctctccgctccttcctgtagtaacagccgccgctgccgccgccgccaggaaccccggccgggagcgagagccgcggggcgcagagccggcccggctgccggacggtgcggccccaccaggtgaacggccatggcgggctggatccaggcccagcagctgcagggagacgcgctgcgccagatgcaggtgctgtacggccagcacttccccatcgaggtccggcactacttggcccagtggattgagagccagccatgggatgccattgacttggacaatccccaggacagagcccaagccacccagctcctggagggcctggtgcaggagctgcagaagaaggcggagcaccaggtgggggaagatgggtttttactgaagatcaagctggggcactacgccacgcagctccagtgcagctctccggctgggatcctggttgacgccatgtcccagaagcaccttcagatcaaccagacatttgaggagctgcgactggtcacgcaggacacagagaatgagctgaagaaactgcagcagactcaggagtacttcatcatccagtaccaggagagcctgaggatccaagctcagtttgcccagctggcccagctgagcccccaggagcgtctgagccgggagacggccctccagcagaagcaggtgtctctggaggcctggttgcagcgtgaggcacagacactgcagcagtaccgcgtggagctggccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacattcatcattgagaagcagcctcctcaggtcctgaagacccagaccaagtttgcagccaccgtacgcctgctggtgggcgggaagctgaacgtgcacatgaatcccccccaggtgaaggccaccatcatcagtgagcagcaggccaagtctctgcttaaaaatgagaacacccgcaacgagtgcagtggtgagatcctgaacaactgctgcgtgatggagtaccaccaagccacgggcaccctcagtgcccacttcaggaacatgtcactgaagaggatcaagcgtgctgaccggcggggtgcagagtccgtgacagaggagaagttcacagtcctgtttgagtctcagttcagtgttggcagcaatgagcttgtgttccaggtgaagactctgtccctacctgtggttgtcatcgtccacggcagccaggaccacaatgccacggctactgtgctgtgggacaatgcctttgctgagccgggcagggtgccatttgccgtgcctgacaaagtgctgtggccgcagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtccgtgtcctggtcccagttcaacagggagaacttgccgggctggaactacaccttctggcagtggtttgacggggtgatggaggtgttgaagaagcaccacaagccccactggaatgatggggccatcctaggttttgtgaataagcaacaggcccacgacctgctcatcaacaagcccgacgggaccttcttgttgcgctttagtgactcagaaatcgggggcatcaccatcgcctggaagtttgactccccggaacgcaacctgtggaacctgaaaccattcaccacgcgggatttctccatcaggtccctggctgaccggctgggggacctgagctatctcatctatgtgtttcctgaccgccccaaggatgaggtcttctccaagtactacactcctgtgctggctaaagctgttgatggatatgtgaaaccacagatcaagcaagtggtccctgagtttgtgaatgcatctgcagatgctgggggcagcagcgccacgtacatggaccaggccccctccccagctgtgtgcccccaggctccctataacatgtacccacagaaccctgaccatgtactcgatcaggatggagaattcgacctggatgagaccatggatgtggccaggcacgtggaggaactcttacgccgaccaatggacagtcttgactcccgcctctcgccccctgccggtcttttcacctctgccagaggctccctctcatgaatgtttgaatcccacgcttctctttggaaacaatatgcaatgtgaagcggtcgtgttgtgagtttagtaaggctgtgtacactgacacctttgcaggcatgcatgtgcttgtgtgtgtgtgtgtgtgtgtgtccttgtgcatgagctacgcctgcctcccctgtgcagtcctgggatgtggctgcagcagcggtggcctcttttcagatcatggcatccaagagtgcgccgagtctgtctctgtcatggtagagaccg

SEQ ID NO: 181611 - DNA, 835 bp, Homo sapiens
  Payload ID: 15769
  Gene Symbol: STAT5A
  Gene Name: signal transducer and activator of transcription 5A
  ENST ID: ENST00000590726
  CDS Start-End: 411-835
ggaaatcgctgctctccgctccttcctgtagtaacagccgccgctgccgccgccgccaggaaccccggccgggagcgagagccgcggggcgcagagccggcccggctgccggacggtgcggccccaccagggatgccattgacttggacaatccccaggacagagcccaagccacccagctcctggagggcctggtgcaggagctgcagaagaaggcggagcaccaggtgggggaagatgggtttttactgaagatcaagctggggcactacgccacgcagctccagaaaacatatgaccgctgccccctggagctggtccgctgcatccggcacattctgtacaatgaacagaggctggtccgagaagccaacaattgcagctctccggctgggatcctggttgacgccatgtcccagaagcaccttcagatcaaccagacatttgaggagctgcgactggtcacgcaggacacagagaatgagctgaagaaactgcagcagactcaggagtacttcatcatccagtaccaggagagcctgaggatccaagctcagtttgcccagctggcccagctgagcccccaggagcgtctgagccgggagacggccctccagcagaagcaggtgtctctggaggcctggttgcagcgtgaggcacagacactgcagcagtaccgcgtggagctggccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctg

SEQ ID NO: 181612 - DNA, 3629 bp, Homo sapiens
  Payload ID: 15769
  Gene Symbol: STAT5A
  Gene Name: signal transducer and activator of transcription 5A
  ENST ID: ENST00000588868
  CDS Start-End: 67-2358
gcgagagccgcggggcgcagagccggcccggctgccggacggtgcggccccaccaggtgaacggccatggcgggctggatccaggcccagcagctgcagggagacgcgctgcgccagatgcaggtgctgtacggccagcacttccccatcgaggtccggcactacttggcccagtggattgagagccagccatgggatgccattgacttggacaatccccaggacagagcccaagccacccagctcctggagggcctggtgcaggagctgcagaagaaggcggagcaccaggtgggggaagatgggtttttactgaagatcaagctggggcactacgccacgcagctccagaaaacatatgaccgctgccccctggagctggtccgctgcatccggcacattctgtacaatgaacagaggctggtccgagaagccaacaattgcagctctccggctgggatcctggttgacgccatgtcccagaagcaccttcagatcaaccagacatttgaggagctgcgactggtcacgcaggacacagagaatgagctgaagaaactgcagcagactcaggagtacttcatcatccagtaccaggagagcctgaggatccaagctcagtttgcccagctggcccagctgagcccccaggagcgtctgagccgggagacggccctccagcagaagcaggtgtctctggaggcctggttgcagcgtgaggcacagacactgcagcagtaccgcgtggagctggccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacattcatcattgagaagcagcctcctcaggtcctgaagacccagaccaagtttgcagccaccgtacgcctgctggtgggcgggaagctgaacgtgcacatgaatcccccccaggtgaaggccaccatcatcagtgagcagcaggccaagtctctgcttaaaaatgagaacacccgcaacgagtgcagtggtgagatcctgaacaactgctgcgtgatggagtaccaccaagccacgggcaccctcagtgcccacttcaggaacatgtcactgaagaggatcaagcgtgctgaccggcggggtgcagagtccgtgacagaggagaagttcacagtcctgtttgagtctcagttcagtgttggcagcaatgagcttgtgttccaggtgaagggcagggtgccatttgccgtgcctgacaaagtgctgtggccgcagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtccgtgtcctggtcccagttcaacagggagaacttgccgggctggaactacaccttctggcagtggtttgacggggtgatggaggtgttgaagaagcaccacaagccccactggaatgatggggccatcctaggttttgtgaataagcaacaggcccacgacctgctcatcaacaagcccgacgggaccttcttgttgcgctttagtgactcagaaatcgggggcatcaccatcgcctggaagtttgactccccggaacgcaacctgtggaacctgaaaccattcaccacgcgggatttctccatcaggtccctggctgaccggctgggggacctgagctatctcatctatgtgtttcctgaccgccccaaggatgaggtcttctccaagtactacactcctgtgctggctaaagctgttgatggatatgtgaaaccacagatcaagcaagtggtccctgagtttgtgaatgcatctgcagatgctgggggcagcagcgccacgtacatggaccaggccccctccccagctgtgtgcccccaggctccctataacatgtacccacagaaccctgaccatgtactcgatcaggatggagaattcgacctggatgagaccatggatgtggccaggcacgtggaggaactcttacgccgaccaatggacagtcttgactcccgcctctcgccccctgccggtcttttcacctctgccagaggctccctctcatgaatgtttgaatcccacgcttctctttggaaacaatatgcaatgtgaagcggtcgtgttgtgagtttagtaaggctgtgtacactgacacctttgcaggcatgcatgtgcttgtgtgtgtgtgtgtgtgtgtgtccttgtgcatgagctacgcctgcctcccctgtgcagtcctgggatgtggctgcagcagcggtggcctcttttcagatcatggcatccaagagtgcgccgagtctgtctctgtcatggtagagaccgagcctctgtcactgcaggcactcaatgcagccagacctattcctcctgggcccctcatctgctcagcagctatttgaatgagatgattcagaaggggaggggagacaggtaacgtctgtaagctgaagtttcactccggagtgagaagctttgccctcctaagagagagagacagagagacagagagagagaaagagagagtgtgtgggtctatgtaaatgcatctgtcctcatgtgttgatgtaaccgattcatctctcagaagggaggctggggttcattttcgagtagtattttatactttagtgaacgtggactccagactctctgtgaaccctatgagagcgcgtctgggcccggccatgtccttagcacaggggggccgccggtttgagtgagggtttctgagctgctctgaattagtccttgcttggctgcttggccttgggcttcattcaagtctatgatgctgttgcccacgtttcccgggatatatattctctcccctccgttgggccccagccttctttgcttgcctctctgtttgtaaccttgtcgacaaagaggtagaaaagattgggtctaggatatggtgggtggacaggggccccgggacttggagggttggtcctcttgcctcctggaaaaaacaaaaacaaaaaactgcagtgaaagacaagctgcaaatcagccatgtgctgcgtgcctgtggaatctggagtgaggggtaaaagctgatctggtttgactccgctggaggtggggcctggagcaggccttgcgctgttgcgtaactggctgtgttctggtgaggccttgctcccaaccccacacgctcctccctctgaggctgtaggactcgcagtcaggggcagctgaccatggaagattgagagcccaaggtttaaacttctctgaagggaggtggggatgagaagaggggtttttttgtactttgtacaaagaccacacatttgtgtaaacagtgttttggaataaaatatttttttcat

SEQ ID NO: 181613 - DNA, 1022 bp, Homo sapiens
  Payload ID: 15769
  Gene Symbol: STAT5A
  Gene Name: signal transducer and activator of transcription 5A
  ENST ID: ENST00000587646
  CDS Start-End: 135-824
gtatcttgtgtgtgtgtgaatatttccaactccctcaatctaccttttcccctctcttgtctccctctcagggcagggtgccatttgccgtgcctgacaaagtgctgtggccgcagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtccgtgtcctggtcccagttcaacagggagaacttgccgggctggaactacaccttctggcagtggtttgacggggtgatggaggtgttgaagaagcaccacaagccccactggaatgatggggccatcctaggttttgtgaataagcaacaggcccacgacctgctcatcaacaagcccgacgggaccttcttgttgcgctttagtgactcagaaatcgggggcatcaccatcgcctggaagtttgactccccggaacgcaacctgtggaacctgaaaccattcaccacgcgggatttctccatcaggtccctggctgaccggctgggggacctgagctatctcatctatgtgtttcctgaccgccccaaggatgaggtcttctccaagtactacactcctgtgctggctaaagctgttgatggatatgtgaaaccacagatcaagcaagtggtccctgagtttgtgaatgcatctgcagatgctgggggcagcagcgccacgtacatggaccaggccccctccccagctgtgtgcccccaggctccctataacatgtacccacagaagtaggtggtgttctcatggggtccgcaggggaagaactggggacttggccccaggctggactcctggagggctggcgggcaaaggatccagagctctggttaggcccaagtccaggaggagtgagatcagccaggaaaacagagcattttgaagctagacatagcagggtcaagtcctcactctagtactaactgtgtgatc

SEQ ID NO: 181614 - DNA, 3318 bp, Homo sapiens
  Payload ID: 15769
  Gene Symbol: STAT5A
  Gene Name: signal transducer and activator of transcription 5A
  Uniprot ID: P42229
  ENST ID: ENST00000590949
  CDS Start-End: 743-3127
agatggccggagtaaaagaaggagggaggtgctgcggtggtgggggtgatcttggcttcactagaatccccagttcttcccctctctacagttttgtctctgaggtcacaaaacctgtggcccccaagacacacatgcgcacacacgcgcgtgcacacacacaccccacacatttattttttaatctaggggctcaaaagatgacacgcgccagagctggaaggcgtcgccaattggtccacttttccctcctccctttttgcggatgagaaaactgaggcccaggtttgggatttccagagcccgggatttcccggcaacgcccgacaaccacattcccccggctattctgacccgccccggttccgggacgctccctgggagccgccgccgagggcctgctgggactcccgggggaccccgccgtcggggcagcccccacgcccggcgccgcccgccgggaacggccgccgctgttgcgcacttgcaggggagccggcgactgagggcgaggcagggagggagcaagcggggctgggagggctgctggcgcgggctcgcgcgctgtgtatggtctatcgcaggcagctgacctttgaggaggaaatcgctgctctccgctccttcctgtagtaacagccgccgctgccgccgccgccaggaaccccggccgggagcgagagccgcggggcgcagagccggcccggctgccggacggtgcggccccaccaggtgaacggccatggcgggctggatccaggcccagcagctgcagggagacgcgctgcgccagatgcaggtgctgtacggccagcacttccccatcgaggtccggcactacttggcccagtggattgagagccagccatgggatgccattgacttggacaatccccaggacagagcccaagccacccagctcctggagggcctggtgcaggagctgcagaagaaggcggagcaccaggtgggggaagatgggtttttactgaagatcaagctggggcactacgccacgcagctccagaaaacatatgaccgctgccccctggagctggtccgctgcatccggcacattctgtacaatgaacagaggctggtccgagaagccaacaattgcagctctccggctgggatcctggttgacgccatgtcccagaagcaccttcagatcaaccagacatttgaggagctgcgactggtcacgcaggacacagagaatgagctgaagaaactgcagcagactcaggagtacttcatcatccagtaccaggagagcctgaggatccaagctcagtttgcccagctggcccagctgagcccccaggagcgtctgagccgggagacggccctccagcagaagcaggtgtctctggaggcctggttgcagcgtgaggcacagacactgcagcagtaccgcgtggagctggccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacattcatcattgagaagcagcctcctcaggtcctgaagacccagaccaagtttgcagccaccgtacgcctgctggtgggcgggaagctgaacgtgcacatgaatcccccccaggtgaaggccaccatcatcagtgagcagcaggccaagtctctgcttaaaaatgagaacacccgcaacgagtgcagtggtgagatcctgaacaactgctgcgtgatggagtaccaccaagccacgggcaccctcagtgcccacttcaggaacatgtcactgaagaggatcaagcgtgctgaccggcggggtgcagagtccgtgacagaggagaagttcacagtcctgtttgagtctcagttcagtgttggcagcaatgagcttgtgttccaggtgaagactctgtccctacctgtggttgtcatcgtccacggcagccaggaccacaatgccacggctactgtgctgtgggacaatgcctttgctgagccgggcagggtgccatttgccgtgcctgacaaagtgctgtggccgcagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtccgtgtcctggtcccagttcaacagggagaacttgccgggctggaactacaccttctggcagtggtttgacggggtgatggaggtgttgaagaagcaccacaagccccactggaatgatggggccatcctaggttttgtgaataagcaacaggcccacgacctgctcatcaacaagcccgacgggaccttcttgttgcgctttagtgactcagaaatcgggggcatcaccatcgcctggaagtttgactccccggaacgcaacctgtggaacctgaaaccattcaccacgcgggatttctccatcaggtccctggctgaccggctgggggacctgagctatctcatctatgtgtttcctgaccgccccaaggatgaggtcttctccaagtactacactcctgtgctggctaaagctgttgatggatatgtgaaaccacagatcaagcaagtggtccctgagtttgtgaatgcatctgcagatgctgggggcagcagcgccacgtacatggaccaggccccctccccagctgtgtgcccccaggctccctataacatgtacccacagaaccctgaccatgtactcgatcaggatggagaattcgacctggatgagaccatggatgtggccaggcacgtggaggaactcttacgccgaccaatggacagtcttgactcccgcctctcgccccctgccggtcttttcacctctgccagaggctccctctcatgaatgtttgaatcccacgcttctctttggaaacaatatgcaatgtgaagcggtcgtgttgtgagtttagtaaggctgtgtacactgacacctttgcaggcatgcatgtgcttgtgtgtgtgtgtgtgtgtgtgtccttgtgcatgagctacgcctgcctcccctgtgcagtcctgggatgtggctgcagcagc

SEQ ID NO: 181615 - DNA, 5103 bp, Homo sapiens
  Payload ID: 15770
  Gene Symbol: STAT5B
  Gene Name: signal transducer and activator of transcription 5B
  Uniprot ID: P51692
  ENST ID: ENST00000293328
  CDS Start-End: 170-2533
ggcgggaggagagtcggcggccggagccgtcaccccgggcggggacccagcgcaggcaactccgcgcggcggcccggccgagggagggagcgagcgggcgggcgggcaagccagacagctgggccggagcagccgcgggcgcccgaggggccgagcgagattgtaaaccatggctgtgtggatacaagctcagcagctccaaggagaagcccttcatcagatgcaagcgttatatggccagcattttcccattgaggtgcggcattatttatcccagtggattgaaagccaagcatgggactcagtagatcttgataatccacaggagaacattaaggccacccagctcctggagggcctggtgcaggagctgcagaagaaggcagagcaccaggtgggggaagatgggtttttactgaagatcaagctggggcactatgccacacagctccagaacacgtatgaccgctgccccatggagctggtccgctgcatccgccatatattgtacaatgaacagaggttggtccgagaagccaacaatggtagctctccagctggaagccttgctgatgccatgtcccagaaacacctccagatcaaccagacgtttgaggagctgcgactggtcacgcaggacacagagaatgagttaaaaaagctgcagcagactcaggagtacttcatcatccagtaccaggagagcctgaggatccaagctcagtttggcccgctggcccagctgagcccccaggagcgtctgagccgggagacggccctccagcagaagcaggtgtctctggaggcctggttgcagcgtgaggcacagacactgcagcagtaccgcgtggagctggccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacgttcatcattgagaagcagcctcctcaggtcctgaagacccagaccaagtttgcagccactgtgcgcctgctggtgggcgggaagctgaacgtgcacatgaaccccccccaggtgaaggccaccatcatcagtgagcagcaggccaagtctctgctcaagaacgagaacacccgcaatgattacagtggcgagatcttgaacaactgctgcgtcatggagtaccaccaagccacaggcacccttagtgcccacttcaggaatatgtccctgaaacgaattaagaggtcagaccgtcgtggggcagagtcggtgacagaagaaaaatttacaatcctgtttgaatcccagttcagtgttggtggaaatgagctggtttttcaagtcaagaccctgtccctgccagtggtggtgatcgttcatggcagccaggacaacaatgcgacggccactgttctctgggacaatgcttttgcagagcctggcagggtgccatttgccgtgcctgacaaagtgctgtggccacagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtctgtgtcctggtcccagttcaacagggagaatttaccaggacggaattacactttctggcaatggtttgacggtgtgatggaagtgttaaaaaaacatctcaagcctcattggaatgatggggccattttggggtttgtaaacaagcaacaggcccatgacctactcattaacaagccagatgggaccttcctcctgagattcagtgactcagaaattggcggcatcaccattgcttggaagtttgattctcaggaaagaatgttttggaatctgatgccttttaccaccagagacttctccattcggtccctagccgaccgcttgggagacttgaattaccttatctacgtgtttcctgatcggccaaaagatgaagtatactccaaatactacacaccagttccctgcgagtctgctactgctaaagctgttgatggatacgtgaagccacagatcaagcaagtggtccctgagtttgtgaacgcatctgcagatgccgggggcggcagcgccacgtacatggaccaggccccctccccagctgtgtgtccccaggctcactataacatgtacccacagaaccctgactcagtccttgacaccgatggggacttcgatctggaggacacaatggacgtagcgcggcgtgtggaggagctcctgggccggccaatggacagtcagtggatcccgcacgcacaatcgtgaccccgcgacctctccatcttcagcttcttcatcttcaccagaggaatcactcttgtggatgttttaattccatgaatcgcttctcttttgaaacaatactcataatgtgaagtgttaatactagttgtgaccttagtgtttctgtgcatggtggcaccagcgaagggagtgcgagtatgtgtttgtgtgtgtgtgtgtgtgtgtgtgtgtgtgcgtgtttgcacgttatggtgtttctccctctcactgtctgagagtttagttgtagcagaggggccacagacagaagctgtggtggtttttactttgtgcaaaaaggcagtgagtttcgtgaagcctggaagttggccatgtgtcttaagagtggctggactttgacatgtggctgtttgaataagagaaggacaaagggaggagaaagcacatgtgctccagtgagtcttcgtcactctgtctgccaagcaattgatatataaccgtgattgtctctgcttttcttctgaaatgtagataactgctttttgacaaagagagccttccctctcccccacccctgtgttcttgggtaggaatgggaaaaggggcaacctacaaagattgttggggcaagggaagtcacaagctttcggatgggcggtggcttttcacaaaacatttagctcatcttattctctctttgtcctctctcccctcctgcccgcccgcaccctggaattgccactcagttcctctgggtgtgcacatatgtttggagaaatagaggagagaaaagagggccacgtaactgagagcttacagtgccaatgccgtttgtgttctggccagagtggagtgcgcagccctgactcccaggcgctgagattgttgcctggttacccaggaagctgctgttccggctgcccagcctttctctgagccagcggatgcacagtccgtggccttcttcaggcttattgatgatgctttttgcaaatgttgaatcatggttctgtttctaagttggatcttttttgttttctccttgccaccctaatttgacatcaaaattctctcttgtgcattgggccctgggtcattcaaacccaggtcacctcattccccttctctgttcacacctaatgtcttgaagagtaggtagcagcagtgtgggctgaacctaggccagcttgcttagcgggtcaccctgctgtgaagtcctggcaggtgttggtaatgtgtggaaatgcagtcagcaagtttgctggggagtttgataaaagtataaaacaaaacaaaaaaagcctcggtataattttgttccacgacttcttctgtagctttacaccagaaggaaggaatgggctacagcaggtagtggaggaagaggggggtgagcaggtgtattaaaatagcttacgggtaaggcctaaaaggtcacccctcggccccctctccaaaagaagggcatgggcacccccaggagaggatggccccaaaaaccttatttttatacatgagagtaaataaacatattttttttacaaaaataacttctgaatttatcagtgttttgccgttaaaaatattcctctatagtaaattatttattggaagatgacttttttaaagctgccgtttgccttggcttggtttcatacactgatttatttttctatgccaggcagtagagtctctctgcctctgaggagcaggctacccgcatcccactcagcccctccctacccctcaagatttgatgaaaattccaaccatgaggatgggtgcatcggggaagggtgagaaggagagcctgcctgctcagggatccaggctcgtagagtcactccctgcccgtctcccagagatgcttcaccagcacctgcctctgagacctcgctctctgttccagcaaccctggttggggggtcagacttgatacactttcaggttgggagtggacccaccccagggcctgctgaggacagagcagccaggccgtcctggctcactttgcagttggcactgggttggggaggaagagagctgatgagtgtggcttccctgagctggggtttccctgcttgtccagttgtgagctgtcctcggtgttaccgaggctgtgcctagagagtggagatttttgatgaaaggtgtgctcgctctctgcgttctatcttctctctcctccttgttcctgcaaaccacaagataaaggtagtggtgtgtctcgaccccatcagcctctcacccactcccagacacacacaagtcctcaaaagtttcagctccgtgtgtgagatgtgcaggttttttctagggggtagggggagactaaaatcgaatataacttaaaatgaaagtatactttttataatttttctttttaaaacttggtgaaattatttcagatacatattttagtgtcaaggcagattagttatttagccaccaaaaaaaagtattgtgtacaatttggggcctcaaatttgactctgcctcaaaaaaaagaaatatatcctatgcagagttacagtcacaaagttgtgtattttatgttacaataaagccttcctctgaagggatggtattga

SEQ ID NO: 181616 - DNA, 559 bp, Homo sapiens
  Payload ID: 15770
  Gene Symbol: STAT5B
  Gene Name: signal transducer and activator of transcription 5B
  ENST ID: ENST00000415845
  CDS Start-End: 91-559
aaacaaagcagcatgtgcttgcggtgcggcgtcggctagggagccgagccgggaagacaccccaccgccgcagaaaggggattgtaaaccatggctgtgtggatacaagctcagcagctccaaggagaagcccttcatcagatgcaagcgttatatggccagcattttcccattgaggtgcggcattatttatcccagtggattgaaagccaagcatgggactcagtagatcttgataatccacaggagaacattaaggccacccagctcctggagggcctggtgcaggagctgcagaagaaggcagagcaccaggtgggggaagatgggtttttactgaagatcaagctggggcactatgccacacagctccagaacacgtatgaccgctgccccatggagctggtccgctgcatccgccatatattgtacaatgaacagaggttggtccgagaagccaacaatggtagctctccagctggaagccttgctgatgccatgtcccagaaacacctccagatcaaccagacgtttgaggagctgcgactggtcacgcagg

SEQ ID NO: 181617 - DNA, 4034 bp, Homo sapiens
  Payload ID: 15771
  Gene Symbol: STAT6
  Gene Name: signal transducer and activator of transcription 6, interleukin-4 induced
  Uniprot ID: P42226
  ENST ID: ENST00000300134
  CDS Start-End: 327-2870
tttctcttctctgtgtcgtcagagctccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacaccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatgtatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaa

SEQ ID NO: 181618 - DNA, 3037 bp, Homo sapiens
  Payload ID: 15771
  Gene Symbol: STAT6
  Gene Name: signal transducer and activator of transcription 6, interleukin-4 induced
  Uniprot ID: P42226
  ENST ID: ENST00000454075
  CDS Start-End: 287-2830
aaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggtgaggggttgcctccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgccc

SEQ ID NO: 181619 - DNA, 3119 bp, Homo sapiens
  Payload ID: 15771
  Gene Symbol: STAT6
  Gene Name: signal transducer and activator of transcription 6, interleukin-4 induced
  Uniprot ID: P42226
  ENST ID: ENST00000543873
  CDS Start-End: 252-2795
cctgtcctggtcaagccaatcgacccagccttgttatgggttggggtggggagaaatgtgtcctcctgatggctggggaagaagaggggttggatatttctagccagggccatgccaggaggctggtcactctgcaaggggatgcagaggaaagcggtgcccactcactccagaggacctttctctcttgggctagagaaaggcctattggaggaacctgagcaggaggggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacaccccaacatgcctgcacctgcagcgcgcacacgcacgcacacacacatacagagctctctgagggtgat

SEQ ID NO: 181620 - DNA, 2886 bp, Homo sapiens
  Payload ID: 15771
  Gene Symbol: STAT6
  Gene Name: signal transducer and activator of transcription 6, interleukin-4 induced
  Uniprot ID: P42226
  ENST ID: ENST00000537215
  CDS Start-End: 446-2659
gcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgagggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgact

SEQ ID NO: 181621 - DNA, 2879 bp, Homo sapiens
  Payload ID: 15771
  Gene Symbol: STAT6
  Gene Name: signal transducer and activator of transcription 6, interleukin-4 induced
  Uniprot ID: P42226
  ENST ID: ENST00000538913
  CDS Start-End: 294-2507
acactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacaccccaacatgcctgcacctgcagcgcgcacacgcacgcacacacacatacagagctctctgagggtgatggggctgagcaggaggggggctgggtaagagcacaggttagggcatgg

SEQ ID NO: 181622 - DNA, 465 bp, Homo sapiens
  Payload ID: 15771
  Gene Symbol: STAT6
  Gene Name: signal transducer and activator of transcription 6, interleukin-4 induced
  ENST ID: ENST00000555318
  CDS Start-End: 1-465
attgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgtgtacccaccacactctcactccatccccccgtatcaaggcctctccccagaagaatcagtcaacgtgttgtcagccttccaggagcctcacctgcagatgccccccagcctgg

SEQ ID NO: 181623 - DNA, 516 bp, Homo sapiens
  Payload ID: 15771
  Gene Symbol: STAT6
  Gene Name: signal transducer and activator of transcription 6, interleukin-4 induced
  ENST ID: ENST00000555104
  CDS Start-End: 235-351
aatcgacccagccttgttatgggttggggtggggagaaatgtgtcctcctgatggctggggaagaagaggggttggatatttctagccagggccatgccaggaggctggtcactctgcaaggggatgcagaggaaagcggtgcccactcactccagaggacctttctctcttgggctagagaaaggcctattggaggaacctgagcaggaggggcaacctccaagtcccagatcatgtctctgtggggtctggtctccaagatgcccccagaaaaagtgcagcggctctatgtcgactttccccaacacctgcggcatcttctgggtgactggctggagagccagccctgagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgag

SEQ ID NO: 181624 - DNA, 565 bp, Homo sapiens
  Payload ID: 15771
  Gene Symbol: STAT6
  Gene Name: signal transducer and activator of transcription 6, interleukin-4 induced
  ENST ID: ENST00000554663
  CDS Start-End: 252-565
cctgtcctggtcaagccaatcgacccagccttgttatgggttggggtggggagaaatgtgtcctcctgatggctggggaagaagaggggttggatatttctagccagggccatgccaggaggctggtcactctgcaaggggatgcagaggaaagcggtgcccactcactccagaggacctttctctcttgggctagagaaaggcctattggaggaacctgagcaggaggggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaagg

SEQ ID NO: 181625 - DNA, 670 bp, Homo sapiens
  Payload ID: 15771
  Gene Symbol: STAT6
  Gene Name: signal transducer and activator of transcription 6, interleukin-4 induced
  ENST ID: ENST00000553275
  CDS Start-End: 477-670
agagctccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgagagaaaggcctattggaggaacctgagcaggaggggtaaggattctgccttgaggagaaaagagctggggtaagtgggcactggaggaaagaggggcatgaaggtcttggagcagaaacgtccagagaagggacctctccattttccatccctctgagaggcctgggagaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttca

SEQ ID NO: 181626 - DNA, 644 bp, Homo sapiens
  Payload ID: 15771
  Gene Symbol: STAT6
  Gene Name: signal transducer and activator of transcription 6, interleukin-4 induced
  ENST ID: ENST00000557635
  CDS Start-End: 422-644
cttccccttcaaggggctgaagacaaaaggtgcccctgtcctggtcaagccaatcgacccagccttgttatgggttggggtggggagaaatgtgtcctcctgatggctggggaagaagaggggttggatatttctagccagggccatgccaggaggctggtcactctgcaaggggatgcagaggaaagcggtgcccactcactccagaggacctttctctcttgggctagagaaaggcctattggaggaacctgagcaggaggggtaaggattctgccttgaggagaaaagagctggggtaagtgggcactggaggaaagaggggcatgaaggtcttggagcagaaacgtccagagaagggacctctccattttccatccctctgagaggcctgggagaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggagggga

SEQ ID NO: 181627 - DNA, 623 bp, Homo sapiens
  Payload ID: 15771
  Gene Symbol: STAT6
  Gene Name: signal transducer and activator of transcription 6, interleukin-4 induced
  ENST ID: ENST00000555375
  CDS Start-End: 160-623
aaaaaaaaaaaaaaaaaaaaaaaaaggaaagaaagaaagaaaagaaacccctgtcctcaccctcttcaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacat

SEQ ID NO: 181628 - DNA, 603 bp, Homo sapiens
  Payload ID: 15771
  Gene Symbol: STAT6
  Gene Name: signal transducer and activator of transcription 6, interleukin-4 induced
  ENST ID: ENST00000553499
  CDS Start-End: 141-603
ggttctctatcgctcatacccagcactaccaagtcaggggccttcctgcagtaccattcagctgcacccagatgccccaagagcaatgagcccacacgcagagctggaggacctgaaaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaaggggg

SEQ ID NO: 181629 - DNA, 644 bp, Homo sapiens
  Payload ID: 15771
  Gene Symbol: STAT6
  Gene Name: signal transducer and activator of transcription 6, interleukin-4 induced
  ENST ID: ENST00000554825
  CDS Start-End: 336-644
aaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgagagaaaggcctattggaggaacctgagcaggaggggtaaggattctgccttgaggagaaaagagctggggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatactt

SEQ ID NO: 181630 - DNA, 868 bp, Homo sapiens
  Payload ID: 15771
  Gene Symbol: STAT6
  Gene Name: signal transducer and activator of transcription 6, interleukin-4 induced
  ENST ID: ENST00000553533
  CDS Start-End: 1-868
gttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaagatgaggaatctgatgctcagagggttatgtagtttgttcaagttcccaaagcaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatc

SEQ ID NO: 181631 - DNA, 2924 bp, Homo sapiens
  Payload ID: 15771
  Gene Symbol: STAT6
  Gene Name: signal transducer and activator of transcription 6, interleukin-4 induced
  Uniprot ID: P42226
  ENST ID: ENST00000556155
  CDS Start-End: 150-2693
gtatgcaggagtgggggctggggagagggtgcccccaggggtccaagggggacgcggaatctcactcaccgtcgatagccgccgcgaccagagctgagagcaggggcagcagcaggagcaacggcggggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaa

SEQ ID NO: 181632 - DNA, 2777 bp, Homo sapiens
  Payload ID: 15771
  Gene Symbol: STAT6
  Gene Name: signal transducer and activator of transcription 6, interleukin-4 induced
  ENST ID: ENST00000554764
  CDS Start-End: 247-363
actgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcct

SEQ ID NO: 181633 - DNA, 553 bp, Homo sapiens
  Payload ID: 15771
  Gene Symbol: STAT6
  Gene Name: signal transducer and activator of transcription 6, interleukin-4 induced
  ENST ID: ENST00000553397
  CDS Start-End: 120-553
acagacctatggggcctggaagtgcccgctgagaaagggagaagacagcagaggggttgccgagagaaaggcctattggaggaacctgagcaggaggggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatcca

SEQ ID NO: 181634 - DNA, 548 bp, Homo sapiens
  Payload ID: 15771
  Gene Symbol: STAT6
  Gene Name: signal transducer and activator of transcription 6, interleukin-4 induced
  ENST ID: ENST00000556259
  CDS Start-End: 125-548
gtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcgagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaag

SEQ ID NO: 181635 - DNA, 661 bp, Homo sapiens
  Payload ID: 15771
  Gene Symbol: STAT6
  Gene Name: signal transducer and activator of transcription 6, interleukin-4 induced
  ENST ID: ENST00000555849
  CDS Start-End: 184-661
acattcacgcattgggcaactcagagaagctgttttaactttcgatcctgtggtcccacaatcagaggactcgggcagataggggttgagataagcgagtttaggccaccaagcgggcggacgaggatcccagaccttgcgcttcccttctgagtttgggaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaag

SEQ ID NO: 181636 - DNA, 1511 bp, Homo sapiens
  Payload ID: 15772
  Gene Symbol: STAP1
  Gene Name: signal transducing adaptor family member 1
  Uniprot ID: Q9ULZ2
  ENST ID: ENST00000265404
  CDS Start-End: 83-970
aacagttgccttttcctctcacagaaggaagatttcattttgtttgagacgagaaaccaaaccacacaccaaagagaggggtatgatggctaagaagcccccaaaaccagcccctcgcaggatcttccaggaaaggttaaagattactgctctacctttgtactttgaaggttttttattaatcaagcggtcaggataccgggagtatgagcattactggacagagttgagaggaactactcttttcttttataccgacaaaaagagtataatatatgttgacaaattagacatagtagacctcacatgccttactgagcagaattcaactgaaaagaactgtgcgaaattcacccttgttttgccgaaagaggaagtacaactgaagacagagaacacagaaagtggggaagaatggagaggcttcattcttacagtaacagagctgtcagttccccaaaacgtgtcactcctacctgggcaagtaattaaactgcatgaagtcctagagagagaaaagaaaaggaggattgagacagagcagagtacgtccgtggaaaaagagaaggaaccaactgaagattatgtggatgtactgaaccctatgccagcatgtttttatacagtgtcccggaaagaggcaactgagatgctccagaagaacccttctttgggaaatatgatcctgaggcctggtagtgacagtagaaactactccatcactattcggcaggagatagacattccaagaatcaagcactacaaagtgatgagcgtaggacaaaactacactattgaactggaaaaacctgtaacactcccaaaccttttcagtgtcattgattattttgtgaaggagactcgaggaaatttaagaccatttatatgttcaactgatgaaaacactggtcaagaacccagtatggaagggagaagtgaaaagttgaagaaaaatccacacattgcatgaaatacaatgtgaaagctcctttgtatatcttggtaatttatattttcaaaacgaagttcttacttttaaagagaattacctatattctcctgatactgattaccaagtcattcacctgaacaccagaattagaattaaacattgtaccatacaatttcattatcttatcagaatgaaaccaattcacagggaaactagagactacggctgtggtggtaacctgcagatatacacattcccatgcactgacataagttgaaaacacatagtactttctagatggaatttttttctttaggcctcaatgaaatacatttcccctatataattccaacagcagtttctctagttctaaattttaccaattcccaaaaaacctaagttttgctgaaatctgatttgaccaatttatcaaatatgtcattttaattacctagctggaagttagagacatgaaatgtactagaggagcccttttccaatggaaatattatataccacattttttgttaatggaaataaatgtcttcattcccatgtt

SEQ ID NO: 181637 - DNA, 1146 bp, Homo sapiens
  Payload ID: 15772
  Gene Symbol: STAP1
  Gene Name: signal transducing adaptor family member 1
  Uniprot ID: Q9ULZ2
  ENST ID: ENST00000396225
  CDS Start-End: 83-970
aacagttgccttttcctctcacagaaggaagatttcattttgtttgagacgagaaaccaaaccacacaccaaagagaggggtatgatggctaagaagcccccaaaaccagcccctcgcaggatcttccaggaaaggttaaagattactgctctacctttgtactttgaaggttttttattaatcaagcggtcaggataccgggagtatgagcattactggacagagttgagaggaactactcttttcttttataccgacaaaaagagtataatatatgttgacaaattagacatagtagacctcacatgccttactgagcagaattcaactgaaaagaactgtgcgaaattcacccttgttttgccgaaagaggaagtacaactgaagacagagaacacagaaagtggggaagaatggagaggcttcattcttacagtaacagagctgtcagttccccaaaacgtgtcactcctacctgggcaagtaattaaactgcatgaagtcctagagagagaaaagaaaaggaggattgagacagagcagagtacgtccgtggaaaaagagaaggaaccaactgaagattatgtggatgtactgaaccctatgccagcatgtttttatacagtgtcccggaaagaggcaactgagatgctccagaagaacccttctttgggaaatatgatcctgaggcctggtagtgacagtagaaactactccatcactattcggcaggagatagacattccaagaatcaagcactacaaagtgatgagcgtaggacaaaactacactattgaactggaaaaacctgtaacactcccaaaccttttcagtgtcattgattattttgtgaaggagactcgaggaaatttaagaccatttatatgttcaactgatgaaaacactggtcaagaacccagtatggaagggagaagtgaaaagttgaagaaaaatccacacattgcatgaaatacaatgtgaaagctcctttgtatatcttggggaaagactatgtgagacagagggagaaaacagccattgacaactcaaggagagaggcctcggggggaaaaaaagatcaacctggccaaaaccttgaaaatccggcttcttgacttgtgagaaaataaatttgtgttccttaa

SEQ ID NO: 181638 - DNA, 1508 bp, Homo sapiens
  Payload ID: 15773
  Gene Symbol: STAP2
  Gene Name: signal transducing adaptor family member 2
  Uniprot ID: Q9UGK3
  ENST ID: ENST00000600324
  CDS Start-End: 69-1418
ctcagcttcccggcccagctggggcacccactggaaggagaggccaggcggaagaccctggctccgtcatggcctctgccctgaggccaccccgtgtccccaagcctaagggtgtcctgccttcacactactatgagagctttctagagaagaaggggccctgtgaccgggattacaagaagttctgggcaggcctgcagggtctcaccatttatttctacaatagcaatcgggacttccagcacgtggagaagctcaacttgggagcatttgagaaactcacagatgagattccctggggaagctcacgtgaccctggcacccacttcagcctgattctccgggatcaggagatcaagttcaaggtagagaccttggagtgtcgggaaatgtggaaaggcttcatcttaacggtggtggagctccgtgtcccgaccgacttgaccctgcttcctgggcacctatacatgatgtctgaagtcttggccaaagaggaggcgcgccgtgcactggagacaccctcgtgcttcctgaaggtgagccggctggaggcacaactgctcctggagcgctaccccgagtgcgggaacctgctgctgcggcccagcggggacggcgccgacggcgtgtcggtcaccacgcggcagatgcacaacgggacgcacgtggtccggcattacaaggtgaagcgggagggccccaagtacgtgatcgatgtggaacagccgttctcttgcacctccctggacgccgtggtcaactatttcgtgtcgcataccaaaaaggcgctggtgccattcctgttagacgaggactacgagaaggtgctaggctacgtggaagccgataaggagaatggcgagaatgtgtgggtggcgccctccgctccgggcccaggtcctgcaccctgcacaggtggccccaagccgctgtcacctgcgtctagccaggacaagctgcccccactgcccccactaccgaaccaggaagagaactacgtgacccccattggagatggcccagctgttgactatgagaaccaagatgtggcttcctctagttggccagtcatcctgaagccaaagaagttgccaaagcctcctgccaagcttccaaagccacccgttggacccaagccagtagagaaggggtttcaccatgttgcccaggctggtctcgaactcctgacctcaagtgatccacccacctcagcctcccaaagtgctgggattaccggcgtgagccaccacacctggcctcatctgtcttctcttccagagcccaaagtctttaatggtggcttgggcaggaagctgccagtcagttcagcccagcctctcttccccacagccgggctggcagacatgacggcagagctacagaagaagctggagaagaggcgggcactggagcactgattcggacacaccagggaccagcgggctagtcccagggcatggcccagcggccagattctttttcccaggattaaaactctgaccccagga

SEQ ID NO: 181639 - DNA, 409 bp, Homo sapiens
  Payload ID: 15773
  Gene Symbol: STAP2
  Gene Name: signal transducing adaptor family member 2
  ENST ID: ENST00000601956
  CDS Start-End: 1-319
tccgggcccaggtcctgcaccctgcacaggtggccccaagccgctgtcacctgcgtctagccaggacaagctgcccccactgcccccactaccgaaccaggaagagaactacgtgacccccattggagatggcccagctgttgactatgagaaccaagatgtggcttcctctagttggccagtcatcctgaagccaaagaagttgccaaagcctcctgccaagcttccaaagccacccgttggacccaagccagggctggcagacatgacggcagagctacagaagaagctggagaagaggcgggcactggagcactgattcggacacaccagggaccagcgggctagtcccagggcatggcccagcggccagattctttttcccaggattaaaactctgaccccagga

SEQ ID NO: 181640 - DNA, 2043 bp, Homo sapiens
  Payload ID: 15773
  Gene Symbol: STAP2
  Gene Name: signal transducing adaptor family member 2
  ENST ID: ENST00000599736
  CDS Start-End: 558-875
agccgagtccggccctccatacccttgggcggagcaggaggcagggccgggctcgttgcgcgcctgatcagtgcagccccggcctttgtcccctaccctgtttctgcaactacatccccgaccctgtcctgggaccttcgtcccggagcccaggctctgggatttccctcagtccctggcagggttgaaagtccgggatggggacttcctaaagctccgggacgccgtgggatgggctcaagtgcgggtggctttgcccagaccgcagtcgggaagtgggaactggacagtaggggtgcgggggaggctctccagggtgctcgggaatgttctcaggaagaagacttgacatagagcaagagctggttccacaccggagaggcggggatttccctaggatcactggacctgctgggatcagcctctgcccagccctggcaggggagggagttgacgggctgacacaggaaactcccctgaaacctgtttctcagcttcccggcccagctggggcacccactggaaggagaggccaggcggaagaccctggctccgtcatggcctctgccctgaggccaccccgtgtccccaagcctaagggtgtcctgccttcacactactatgagagctttctagagaagaaggggccctgtgaccggcccaggaaaaactccgtgaacctcagctgctggggcgaaggccaggacaggattacaagaagttctgggcaggcctgcagggtctcaccatttatttctacaatagcaatcgggacttccagcacgtggagaagctcaacttgggagcatttgagaaactcacagatgagattccctggggaagctcacgtgaccctggcacccacttcagcctgattctccgggatcaggagatcaagttcaaggtagagaccttggagtgtcgggaaatgtggaaaggcttcatcttaacggtggtggagctccgtgtcccgaccgacttgaccctgcttcctgggcacctatacatgatgtctgaagtcttggccaaagaggaggcgcgccgtgcactggagacaccctcgtgcttcctgaaggtgagccggctggaggcacaactgctcctggagcgctaccccgagtgcgggaacctgctgctgcggcccagcggggacggcgccgacggcgtgtcggtcaccacgcggcagatgcacaacgggacgcacgtggtccggcattacaaggtgaagcgggagggccccaagtacgtgatcgatgtggaacagccgttctcttgcacctccctggacgccgtggtcaactatttcgtgtcgcataccaaaaaggcgctggtgccattcctgttagacgaggactacgagaaggtgctaggctacgtggaagccgataaggagaatggcgagaatgtgtgggtggcgccctccgctccgggcccaggtcctgcaccctgcacaggtggccccaagccgctgtcacctgcgtctagccaggacaagctgcccccactgcccccactaccgaaccaggaagagaactacgtgacccccattggagatggcccagctgttgactatgagaaccaagatgtggcttcctctagttggccagtcatcctgaagccaaagaagttgccaaagcctcctgccaagcttccaaagccacccgttggacccaagccagagaaggggtttcaccatgttgcccaggctggtctcgaactcctgacctcaagtgatccacccacctcagcctcccaaagtgctgggattaccggcgtgagccaccacacctggcctcatctgtcttctcttccagagcccaaagtctttaatggtggcttgggcaggaagctgccagtcagttcagcccagcctctcttccccacagccgggctggcagacatgacggcagagctacagaagaagctggagaagaggcgggcactggagcactgattcggacacaccagggaccagcgggctagtcccagggcatggcccagcggccagattctttttcccaggattaaaactctgaccccagg

SEQ ID NO: 181641 - DNA, 1426 bp, Homo sapiens
  Payload ID: 15773
  Gene Symbol: STAP2
  Gene Name: signal transducing adaptor family member 2
  Uniprot ID: Q9UGK3
  ENST ID: ENST00000594605
  CDS Start-End: 125-1336
cctggcaggggagggagttgacgggctgacacaggaaactcccctgaaacctgtttctcagcttcccggcccagctggggcacccactggaaggagaggccaggcggaagaccctggctccgtcatggcctctgccctgaggccaccccgtgtccccaagcctaagggtgtcctgccttcacactactatgagagctttctagagaagaaggggccctgtgaccgggattacaagaagttctgggcaggcctgcagggtctcaccatttatttctacaatagcaatcgggacttccagcacgtggagaagctcaacttgggagcatttgagaaactcacagatgagattccctggggaagctcacgtgaccctggcacccacttcagcctgattctccgggatcaggagatcaagttcaaggtagagaccttggagtgtcgggaaatgtggaaaggcttcatcttaacggtggtggagctccgtgtcccgaccgacttgaccctgcttcctgggcacctatacatgatgtctgaagtcttggccaaagaggaggcgcgccgtgcactggagacaccctcgtgcttcctgaaggtgagccggctggaggcacaactgctcctggagcgctaccccgagtgcgggaacctgctgctgcggcccagcggggacggcgccgacggcgtgtcggtcaccacgcggcagatgcacaacgggacgcacgtggtccggcattacaaggtgaagcgggagggccccaagtacgtgatcgatgtggaacagccgttctcttgcacctccctggacgccgtggtcaactatttcgtgtcgcataccaaaaaggcgctggtgccattcctgttagacgaggactacgagaaggtgctaggctacgtggaagccgataaggagaatggcgagaatgtgtgggtggcgccctccgctccgggcccaggtcctgcaccctgcacaggtggccccaagccgctgtcacctgcgtctagccaggacaagctgcccccactgcccccactaccgaaccaggaagagaactacgtgacccccattggagatggcccagctgttgactatgagaaccaagatgtggcttcctctagttggccagtcatcctgaagccaaagaagttgccaaagcctcctgccaagcttccaaagccacccgttggacccaagccagagcccaaagtctttaatggtggcttgggcaggaagctgccagtcagttcagcccagcctctcttccccacagccgggctggcagacatgacggcagagctacagaagaagctggagaagaggcgggcactggagcactgattcggacacaccagggaccagcgggctagtcccagggcatggcccagcggccagattctttttcccaggattaaaactctgaccccagga

SEQ ID NO: 181642 - DNA, 568 bp, Homo sapiens
  Payload ID: 15773
  Gene Symbol: STAP2
  Gene Name: signal transducing adaptor family member 2
  ENST ID: ENST00000598443
  CDS Start-End: 1-478
gctcctggagcgctaccccgagtgcgggaacctgctgctgcggcccagcggggacggcgccgacggcgtgtcggtcaccacgcggcagatgcacaacgggacgcacgtggtccggcattacaaggtgaagcgggagggccccaagtacgtgatcgatgtggaacagccgttctcttgcacctccctggacgccgtggtcaactatttcgtgtcgcataccaaaaaggcgctggtgccattcctgttagacgaggactacgagaaggtgctaggctacgtggaagccgataaggagaatggcgagaatgtgtgggtggcgccctccgctccgggcccagagcccaaagtctttaatggtggcttgggcaggaagctgccagtcagttcagcccagcctctcttccccacagccgggctggcagacatgacggcagagctacagaagaagctggagaagaggcgggcactggagcactgattcggacacaccagggaccagcgggctagtcccagggcatggcccagcggccagattctttttcccaggattaaaactctgaccccagga

SEQ ID NO: 181643 - DNA, 837 bp, Homo sapiens
  Payload ID: 15773
  Gene Symbol: STAP2
  Gene Name: signal transducing adaptor family member 2
  ENST ID: ENST00000601482
  CDS Start-End: 57-837
gcccagctggggcacccactggaaggagaggccaggcggaagaccctggctccgtcatggcctctgccctgaggccaccccgtgtccccaagcctaagggtgtcctgccttcacactactatgagagctttctagagaagaaggggccctgtgaccgggattacaagaagttctgggcaggcctgcagggtctcaccatttatttctacaatagcaatcgggacttccagcacgtggagaagctcaacttgggagcatttgagaaactcacagatgagattccctggggaagctcacgtgaccctggcacccacttcagcctgattctccgggatcaggagatcaagttcaaggtagagaccttggagtgtcgggaaatgtggaaaggcttcatcttaacggtggtggagctccgtgtcccgaccgacttgaccctgcttcctgggcacctatacatgatgtctgaagtcttggccaaagaggaggcgcgccgtgcactggagacaccctcgacgcacgtggtccggcattacaaggtgaagcgggagggccccaagtacgtgatcgatgtggaacagccgttctcttgcacctccctggacgccgtggtcaactatttcgtgtcgcataccaaaaaggcgctggtgccattcctgttagacgaggactacgagaaggtgctaggctacgtggaagccgataaggagaatggcgagaatgtgtgggtggcgccctccgctccgggcccaggtcctgcaccctgcacaggtggccccaagccgctgtcacctgcgtctagccaggacaagctgcccccactgcccccactaccgaacc

SEQ ID NO: 181644 - DNA, 729 bp, Homo sapiens
  Payload ID: 15774
  Gene Symbol: STAM
  Gene Name: signal transducing adaptor molecule (SH3 domain and ITAM motif) 1
  ENST ID: ENST00000377500
  CDS Start-End: 209-729
ggagctgtcgcggaccctgtagagtcggtctctgttgctctttttgcctgaggagtcttccatcctacgtcgagctctgactcccgtgctgtcgagagggagtccccggggacacctcggcacgcagcggagatgcctctttttgccaccaatcccttcgatcaggatgttgggtcatcctaaagtatgtgaaaaattaaaggctcttatggttgaatggacagatgaatttaagaatgatccacagcttagtctaatatcagcaatgattaagaaccttaaggaacaaggagttacgttcccagctattggctctcaggctgcagaacaagcaaaagcaagcccagctcttgtagccaaggatcctggtactgtggctaacaaaaaagaagaagaagatttagcaaaagccattgagttgtctctcaaggaacaaaggcagcagtcaaccaccctttccactttgtatccaagcacatccagtctcttaactaaccaccaacatgaaggccgaaaagttcgtgctatatatgactttgaagctgctgaagacaatgaacttacttttaaagctggagaaattattacagttcttgatgacagtgatcctaactggtggaaaggtgaaacccatcaaggcatagggttatttccttctaattttgtgactgcagatctcactgctgaaccagaaatgattaaaacagagaagaagacggtacaatttag

SEQ ID NO: 181645 - DNA, 2972 bp, Homo sapiens
  Payload ID: 15774
  Gene Symbol: STAM
  Gene Name: signal transducing adaptor molecule (SH3 domain and ITAM motif) 1
  Uniprot ID: Q92783
  ENST ID: ENST00000377524
  CDS Start-End: 216-1838
agctccgcgcgggggcttcctcggctccttgctgttgccgccgccgcagctgctgccgcggttggtggggttgggtgagaggaggagctgtcgcggaccctgtagagtcggtctctgttgctctttttgcctgaggagtcttccatcctacgtcgagctctgactcccgtgctgtcgagagggagtccccggggacacctcggcacgcagcggagatgcctctttttgccaccaatcccttcgatcaggatgttgagaaagcaaccagcgagatgaatactgctgaggactggggcctcattttggatatctgtgataaagttggtcagtctcgcactggacctaaggattgtcttcggtctattatgagaagagtgaaccacaaagatcctcacgttgctatgcaggctttgactcttctaggagcatgtgtatcaaactgtggcaaaatttttcatttagaagtatgttcaagagattttgctagtgaagtaagcaacgtattaaataagggtcatcctaaagtatgtgaaaaattaaaggctcttatggttgaatggacagatgaatttaagaatgatccacagcttagtctaatatcagcaatgattaagaaccttaaggaacaaggagttacgttcccagctattggctctcaggctgcagaacaagcaaaagcaagcccagctcttgtagccaaggatcctggtactgtggctaacaaaaaagaagaagaagatttagcaaaagccattgagttgtctctcaaggaacaaaggcagcagtcaaccaccctttccactttgtatccaagcacatccagtctcttaactaaccaccaacatgaaggccgaaaagttcgtgctatatatgactttgaagctgctgaagacaatgaacttacttttaaagctggagaaattattacagttcttgatgacagtgatcctaactggtggaaaggtgaaacccatcaaggcatagggttatttccttctaattttgtgactgcagatctcactgctgaaccagaaatgattaaaacagagaagaagacggtacaatttagtgatgatgttcaggtagagacaatagaaccagagccggaaccagcctttattgatgaagataaaatggaccagttgctacagatgctgcaaagtacagaccccagtgatgatcagccagacctaccagagctgcttcatcttgaagcaatgtgtcaccagatgggacctctcattgatgaaaagctggaagatattgatagaaaacattcagaactctcagaacttaatgtgaaagtgatggaggccctttccttatataccaagttaatgaacgaagatccgatgtattccatgtatgcaaagttacagaatcagccatattatatgcagtcatctggtgtttctggttctcaggtgtatgcagggcctcctccaagtggtgcctacctggttgcagggaacgcgcagatgagccacctccagagctacagtcttcccccggagcagctgtcttctctcagccaggcagtggtcccaccatccgcaaacccagcccttcctagtcagcagactcaggccgcttacccaaatacaatggtcagttccgttcaaggaaacacatatcccagccaggcgccagtatatagtcctcctcctgccgctactgctgctgctgcaactgccgatgtcactctgtaccagaatgcaggacctaatatgccccaggtgccaaactataacttaacatcatcaactctgcctcagcccggaggcagccaacagccacctcagccacagcaaccatattctcagaaggctctgctataggacccggtgttcctcttggtggcagatacctgctaaatgccactgacaatgttatgagattcattactatcttaagatgtgtttatcctcagcttataggaatctctccaggtcaacaggttcaaatattcaagaaggtagaactctcctcaatttacactgactttttagaggttcttccccccccgcccctgcagaggaatgaaactacttacaacatttaattcctttcataatatgaaagaattgatacaaggctatttgtctcgtaaacctggtctgcagaaagtcaaacttacaaaaactgttgtgacaaatgttatgtacatatattgatatgtaactgcattagtggccattttgaatcacagtggtgatcgtgtgaatatatttaacactgtgttaaattaatttacgttgctattttattttaatcataaacaactaccatgtttcttaatgttttgtgtaaatttaaggtaattatactatccttttaaacttcaagaaaacaaagttgttagcgtatttacatgaaggcgcattatgttgtcgtgtgtttcagtttcacattaaactgaaccttttactaattgtgagctaaagagatatatatatatatgtgtgtgtatatatatatatctacatgtctttctgtagcctctgcatactactggctgtcatcacaccagcgtacagtagctaaatttttggtgcaattatagcaaatgataatgttcccttttgaacttttacattttggcatgacatttcagagtattgtgggaccatgagacaaaattaagtacgatcacattctttatttctcattttaaagaaatgatgttggtttaccttttcctagttgaagatagtaattaggtttctaagctgtatactgtgtttattggtggcagtgacaccaaagatagaggcaatggatagaaatttttaaactggaaagaaaacctgaattacactacattttcgaagtctcttgtaattatttgggatatcaacaaaatttgattcgtctgtctaatcccttgctagtattttaaatatgtctttaacacattgtatcctttaattcttcattaaaatggaaataagtagatgtttcaaagtaatcta

SEQ ID NO: 181646 - DNA, 740 bp, Homo sapiens
  Payload ID: 15774
  Gene Symbol: STAM
  Gene Name: signal transducing adaptor molecule (SH3 domain and ITAM motif) 1
  ENST ID: ENST00000445846
  CDS Start-End: 133-261
ggagctgtcgcggaccctgtagagtcggtctctgttgctctttttgcctgaggagtcttccatcctacgtcgagctctgactcccgtgctgtcgagagggagtccccggggacacctcggcacgcagcggagatgcctctttttgccaccaatcccttcgatcaggatgttgagaaagcaaccagcgagatgaatactgctgaggactggggcctcattttggatatctgtgataaagttggtcagtctcgcactggataaggaaaagagaggatgtgtcttacaaaaagttttaaaataccaaaatggggttttaagaagctttttgagagagatgaggatttgcccaccctttaaacagacctaaggattgtcttcggtctattatgagaagagtgaaccacaaagatcctcacgttgctatgcaggctttgactcttctaggagcatgtgtatcaaactgtggcaaaatttttcatttagaagtatgttcaagagattttgctagtgaagtaagcaacgtattaaataagggtcatcctaaagtatgtgaaaaattaaaggctcttatggttgaatggacagatgaatttaagaatgatccacagcttagtctaatatcagcaatgattaagaaccttaaggaacaaggagttacgttcccagctattggctctcaggctgcagaacaagcaaaagcaagcccagctcttgtagccaaggatcctggtactgtggct

SEQ ID NO: 181647 - DNA, 5701 bp, Homo sapiens
  Payload ID: 15775
  Gene Symbol: STAM2
  Gene Name: signal transducing adaptor molecule (SH3 domain and ITAM motif) 2
  Uniprot ID: O75886
  ENST ID: ENST00000263904
  CDS Start-End: 351-1928
gaaggtccccggcttcgtggctagccggggtcctagcgctggaaaggtggccgtagcggccgcctgacccctacaaaagtctgggacaggggcagcgacaaaggccttgggaggacgcccatggtcggagggatctcgccccgggagaaaagttgggacaggagcgcgggatcgaagggtggactccgagccggcctgtcaggcaagagccgggcaggtgcggtggcggaagtgcagggacggaggccgaagcggagcggtctagggagccgcggccgcgggtcacccggcgggtagcagttgctgagtgtcagctagacagcagcgactagggctcgggcgccggcgagatgcctttgttcaccgccaaccccttcgagcaagacgtggaaaaagccacgaatgagtacaacactacagaagattggagtcttattatggacatatgtgacaaagttggaagtactcctaatggagcgaaagattgcctaaaagccataatgaaaagggtaaatcataaggttccacatgttgctctgcaagcactaactcttcttggggcttgtgtggcaaactgtggaaagatatttcatttagaagtatgttcccgtgattttgcaacagaagtacgtgctgtgattaaaaataaggcacatcctaaagtatgtgaaaaactgaaatctttaatggtggagtggtcagaagaatttcagaaggaccctcagtttagtctgatatctgcaactattaaatctatgaaagaagaaggaattacttttcctccagcaggttctcagactgtctcagctgctgccaagaatggtacgtcatcgaacaaaaacaaagaggatgaagacatagctaaagctattgaattatcgctgcaagaacagaaacagcaacacacagaaacaaaatccttatatccatcttcagaaattcagttaaataataaggttgcacggaaagtgagagctttatatgattttgaagctgttgaggacaatgaactcacctttaaacatggtgaaataattattgttttggatgacagtgatgccaattggtggaaaggagaaaatcacagaggaataggacttttcccatccaattttgtaacaactaatttaaacatagagactgaggcagcggctgtggacaaattgaatgtaattgatgatgatgtggaggaaattaagaaatcagagcctgagcctgtttatatagatgaggataagatggatagagccctgcaggtacttcagagtatagatccaacagattcaaaaccagactcccaagaccttttggatttagaagatatctgccaacagatgggtccaatgatagatgaaaaacttgaagaaattgataggaagcattcagaattgtctgaattgaatgttaaagtcctggaagctctggaactatataacaaattggtgaatgaagcaccagtgtactcagtctattcaaagctccaccctccagcacattacccacctgcatcatctggggttccaatgcagacatatccagttcaatcacatggtggaaactatatgggtcagagcattcaccaagtaactgttgcccaaagctatagcctaggacccgatcaaattggtccactgagatctctgcctccaaatgtgaattcctcagtgacagcacagcctgctcaaacttcatatttaagcactggacaagacactgtttccaatcctacttatatgaaccagaactctaacctacagtcagctactggtacaactgcttacacacagcaaatggggatgtctgtggatatgtcatcttatcagaacactacttccaatttgcctcaactggcaggctttccggtgacagttccagctcatccagttgcacagcagcacacaaattaccatcagcagcctctcctttagaaacaaatcaagcattttcttgaaagccttcataagtgtattattcagtccttgtgataccaacctgaaaatattaaaacttttttccctctcaactcaaaaggaccatgaataaataaagcacaaaaacctctcttattctacaaggccataaaaggttttttttttttttttttttcagtccagtttgtttgaagtcaatcttttcatcagaggcagcttaaagatgctttcagttagttttgtcttactttcagatttctctacataaatctagatactcattaagtagccttatgacaaacagtatgagatacttatgacaaactcgctctgtcacccaggctggagtgcagtagcatgatcgacagagtgagtttgtcaaaagtatctcatacttataaacagtatgagataggaggattaaaatattattttaaagaaaccactgtttccccctaaaatgtcataagagcactgaagaacttgaaatatttttttcagagtttctcacacactttaaaagtctaacttttttgtgtgtaagcatttagcttgccagcatatttctttttggctccttaaattgcggttgtgtttgcagtattgtcacttttgctctcactgttatgttgaataataattagcatataattgtctacagaagcaagagcaatctggaaggaacaaaaatgttttctgtgattaacagtgaagaccttgtaaatgcagatgtgtgataaagcatttagtcagtcccccaaacagtcatgccaactgtgaaggaatgtcccacaaaacatttccattccctgaggaaaaacattttctttcctacatgtatctctggtatttagaattgtcactaataaccttttcaagtgattttggctattctctaatgaagatatggtccatttgtttttcttcctgcaatgtggtgtgcagagatgctgcatatcctttttatgggattgcgtgtgaatttgaaccatgagacattcctaataatttgttgtgagatataccaagcatggatgataagtgtgtttttagtggtgtgttgtttttttaaagaggtgattcaagtaccgttgctaagctgtcaacataccaagctgttgaaaaaattgaccatttctttcagaagtaattctcagcctgtggaataatagcaggtgaagacttcatagaaggcgacagattgatagggaggctattgaagcagtttttctgaagcctgcattttgagttagtttatagtgctaatagattctatataactgtgagagtttggtagtaaaccagtagggattgttttctctcctaaaaatttgcacactacttcattgtctaccaactttttacatattggaaaatagaaattgcaaatacatacatgtatggaaacatattcagattgggaaaaacaatggacattagtttttaaaaagttacgtggaagcaagatttctatatttgtttttttaaaggaagcagtcattctttctactaaatccatttcaagctagttctctgaaaattttgccatttatctacagaaatttgattataaatatgttcctttttcaaagaaactttattctagaacaaaatagtctatatggtacttgatctacatttaagtggaaaaattagcagtatttgaaagctcagtttatgtcattgtcttaacttcagatacaaataactgaacagaaagttttaacctttaatatctcatgttctgttttttattcagtattttcctttatgttaattcaattatatacttctgaatggcaccttactttttggaaacaaatcttctgttatttacaaaataataatttttaaaaaacatttaaaaaaaatccaaagctgctctcgataatagtcaacatttgcatatatatggaatttcttactttttttctcccaaactctatttaataaacttattttaatgtttgtgtatttcatgtataattgtgatctcaattataaaagtttaattcagcatgtctttgagccaatataattactgcacacccactaaattgggatcagccattataaataatgtagttttagaataataaaacatgacacatatatatatatataaatatatagtatatattggcacatcggtgaaagtttatatgtgcagaagtttttttctttctcaagttaaaaattattttttgccatatgtaattttgtgttgcaggctgtcgagagataaaaatgattttaaatctgtgtactgatgattctttcggtgttaagaaacacagggttgtgtacttccctttttatgggcttatggattctatttatattaagacctgtttataattgttttctgccaaagggaattgtctaacttcagatttctacattgggttcatacttactgttttatatcagaaataaaaaaatagcttctgctttttcatatgaaatcttggtacatcagaaagaattcctgaaaatttataatagaatgaattttattaatgcagaaaaataccccagggtgttaaaatatatgaagtgtgggatatattcttatagtttgtaaaatgtagtcaaccaatactgtcttctaatttggtaatttatttataaaattacttaaacattaggtaattatatttgttaggatttgaaattatttgtagttaaattgtcatgctgtttgaaataattgatacttgtctacgtaatacattttactgtatgttttgaagatggttataatttcactttcaaaatttaaaaaatcaattttaaatgttttaaaaacatatagcttagggattttttttaaaaaggttttcttagtaaaaacataaatttaaaagcccctgagttctaggagagggcttattgaattgctataagaaagctggagttactttgataagtaataaattataaatagcactgatctataatgctttatttctatcggaaggtactttttcttctttcatcatcagttttagccagttagtaaatgggaatactcagttttagggatttgatttttgtttggtttaattttctttcaaaaattaaaagtatatttctaaaagttttccccagaggccagatacagtggctcatgcctataatcccagcactttgggagcctgagataggagtattgcttgaggctaggagtttgagaccaacctggcaacatggcaagaccctatctctacaaaaattttaaaacttagccaggtgtggtagtgcacctgtagtcccagctagtcagtaggctgaggtgggagtattgcttgaggctgcagtgaggtgtgatcacgccactgcactccggcctgacagaatgagatcctgtctcaaaaagaaaattccccagaagaagaattctaattttatcaagctgaattaaagtttgagagtcttttttttaaaatcttactgtgtcaaaagaggcattatgttgcttgtgtgatatagtgaatagtgtccctccaaatttcatgtacacctggaatgtcacaatgtgacttaacagtagccacccctcacccccgcccttatctgtggtggatacatttgcaagatccccagtggatgcctgaaaccgcagatagtactgaaccttatatatactgtttgttttcctatgcatacatatccctatgataaagtttatgaatttggcacttaacagcagaactaataagatgaaagagttgtaacaatatactctaataaaagttatttaaaatgta

SEQ ID NO: 181648 - DNA, 3628 bp, Homo sapiens
  Payload ID: 15776
  Gene Symbol: SIPA1
  Gene Name: signal-induced proliferation-associated 1
  Uniprot ID: Q96FS4
  ENST ID: ENST00000394224
  CDS Start-End: 297-3425
ggcagggtgactggggtcccatgacagctgctgtgaccccagcaccttcctcaggatgtgggggcctggcagagggctgggcccacagttggggctacttcctgtgctgaaggaagtcctcttgccattcctgctgccctgccgctgcctccctgggaacccatgtgtccttgtggcccctctgagcagccccctcctccttcagggcaggaactgctgccacaacctcaggctgggcaccaaacacccgtgcccgccaatgcggcccagcccccggagagtcaggcccacagagcatgcccatgtgggccggcggtgtggggagccctcggcggggcatggcccctgcgtccacagatgacctctttgcccgcaagctgcgccagccagcaaggcccccgctgacaccgcacaccttcgagccgaggccagtccggggcccactcctgcgcagcggcagcgatgcaggcgaggccaggccccccacgccagccagcccccgtgcccgtgcccacagccacgaagaggccagccgacctgcagccacttccacccggctcttcactgacccgctggcactgctggggctgccagcagaggaaccagagcctgccttcccaccagtgcttgagcctcgatggtttgcccactatgacgtgcaaagcctgctctttgattgggctccgaggtctcaggggatggggagccactcagaggccagctctgggaccctggcttcagccgaggaccaggctgccagctcggacctgctgcatggggcacctggctttgtgtgtgagctcgggggtgagggtgagctaggcctgggtggaccagcatccccacctgtgccccctgcactgcccaacgcggccgtgtccatcctggaggagccacagaaccgaacctcggcctacagcctggagcacgcagacctgggtgctggctactaccgcaaatacttctatggcaaagaacatcagaacttcttcgggatggacgagtcgctgggcccggtggcagtgagcctgcggcgggaggagaaggagggcagcggagggggcaccctgcacagctaccgcgtcatcgtgcggaccacgcagctccggacactccgtggcaccatctcggaggacgcgctgccgccggggcccccacggggtctgtccccaaggaaacttctggagcacgtggcgccgcagctgagccccagctgcctgcgcctgggctcagcttcacccaaggtaccacggacgctgctcacactggatgagcaagtgctgagcttccaacgcaaggtgggcatcctgtactgccgggcgggccagggctcggaggaggagatgtacaacaaccaggaggcgggaccggccttcatgcagtttctcaccttgctgggcgatgtggtgcggctcaaaggctttgagagttaccgggcccagctagacaccaaaacggattccacaggcacgcactccctctacaccacataccaggaccacgagatcatgttccacgtgtccacgatgctgccttacacccctaataaccagcagcagctcctccggaagcgccacattggcaacgacattgtgaccatcgtgttccaggagcctggcagcaagcccttctgccccaccaccatccgctcgcacttccagcacgtgttcctagtggtgcgggcacacacaccctgcacgccacacaccacctacagggtggccgtgagccgcacccaggacacccctgccttcgggccagctctgcctgctggcggaggccccttcgcagccaacgccgacttccgggccttcctgctggccaaagcgctgaatggtgagcaggcggccggccacgcgcgccagttccacgccatggccacgcgcacccgccagcagtacctgcaagacctggccaccaacgaggtgaccactacgtcgctggactcggcttcacgcttcggcctgccctccctgggtgggaggcgccgggcggcccctcggggcccaggcgccgagctgcaggcagcgggctcactggtgtggggagtgcgcgcggcgcccggggcgcgggtcgccgccggggctcaggcgagcggccccgaaggcatcgaggtgccctgcctgctgggcatctcggccgaggctctggtgctggtggcgccgcgcgacggccgcgtagtgttcaattgcgcctgtcgcgacgtgctggcctggaccttctccgagcagcagctggacctgtaccacggccgcggggaggcgatcacgctgcgcttcgacgggtcccccggccaagccgtgggcgaggtggtggcgcgcctgcagctggtgagccgtggctgcgagacccgcgagctggcgctgccccgcgacggtcaaggccgcctgggcttcgaggtggacgccgagggattcgtcacgcacgtggagcgcttcacattcgccgagacggcggggctgcggcccggggcgcgcctcctgcgcgtgtgcggccagactctgcccagcctccggcccgaggccgctgcccagctcctgcgctcggcgcccaaggtctgcgtcaccgtcctgccccccgacgagagcggccggccccgcaggagtttttcggagctgtacacgctgtcgctgcaggagcctagccggcggggggccccagatcctgtgcaggatgaggtccagggggtgaccctgctgcccaccacaaagcagctgctgcacctgtgcctgcaagatggtggcagtcctccagggcctggggatctggccgaggagaggactgagttcctgcacagccagaactcgctgtcaccacgcagctctctgtcggatgaggccccagtcctgcccaacaccaccccggacctcctcctggccaccacagccaagccatcagtacccagtgctgacagtgagacacccctgacccaggacaggccaggcagtcccagtggctctgaggacaagggcaacccggcgccggagctgagggcctcctttctgccacgtaccttgtctctgcggaactccatcagcaggatcatgtcggaggcgggcagtgggaccctggaggacgagtggcaggccatctcggagattgcctctacttgcaacaccattctggagtcgctgtcccgagagggacagcccatcccagagagtggagaccctaagggaactccaaaatctgatgctgagccagagcctgggaacctctcagagaaggtctctcacttggagtccatgctcaggaagctgcaggaggacctgcagaaggagaaggcggacagggcggccctggaggaggaggtgcggagcctgagacacaacaaccggcggctgcaggcggagtctgagagtgcagccacacgcctcctcctggcctccaagcagctgggctcacccaccgccgacctggcctgagccgtctggaaccacctgggcccctgagggcactgtggtcacactgggccctcctcaggaactctccctgcgcagaggcgtgtcttagcactgcccccctccctagccccttatttggtggcggaagtggcctccaccccttccctgtttgtaaatattctgtggagaaaagaggacttcagggagtaaaaaagccactgatg

SEQ ID NO: 181649 - DNA, 3456 bp, Homo sapiens
  Payload ID: 15776
  Gene Symbol: SIPA1
  Gene Name: signal-induced proliferation-associated 1
  Uniprot ID: Q96FS4
  ENST ID: ENST00000394227
  CDS Start-End: 123-3251
cgggcggcggcggcgtgaggctgcccttcagggcaggaactgctgccacaacctcaggctgggcaccaaacacccgtgcccgccaatgcggcccagcccccggagagtcaggcccacagagcatgcccatgtgggccggcggtgtggggagccctcggcggggcatggcccctgcgtccacagatgacctctttgcccgcaagctgcgccagccagcaaggcccccgctgacaccgcacaccttcgagccgaggccagtccggggcccactcctgcgcagcggcagcgatgcaggcgaggccaggccccccacgccagccagcccccgtgcccgtgcccacagccacgaagaggccagccgacctgcagccacttccacccggctcttcactgacccgctggcactgctggggctgccagcagaggaaccagagcctgccttcccaccagtgcttgagcctcgatggtttgcccactatgacgtgcaaagcctgctctttgattgggctccgaggtctcaggggatggggagccactcagaggccagctctgggaccctggcttcagccgaggaccaggctgccagctcggacctgctgcatggggcacctggctttgtgtgtgagctcgggggtgagggtgagctaggcctgggtggaccagcatccccacctgtgccccctgcactgcccaacgcggccgtgtccatcctggaggagccacagaaccgaacctcggcctacagcctggagcacgcagacctgggtgctggctactaccgcaaatacttctatggcaaagaacatcagaacttcttcgggatggacgagtcgctgggcccggtggcagtgagcctgcggcgggaggagaaggagggcagcggagggggcaccctgcacagctaccgcgtcatcgtgcggaccacgcagctccggacactccgtggcaccatctcggaggacgcgctgccgccggggcccccacggggtctgtccccaaggaaacttctggagcacgtggcgccgcagctgagccccagctgcctgcgcctgggctcagcttcacccaaggtaccacggacgctgctcacactggatgagcaagtgctgagcttccaacgcaaggtgggcatcctgtactgccgggcgggccagggctcggaggaggagatgtacaacaaccaggaggcgggaccggccttcatgcagtttctcaccttgctgggcgatgtggtgcggctcaaaggctttgagagttaccgggcccagctagacaccaaaacggattccacaggcacgcactccctctacaccacataccaggaccacgagatcatgttccacgtgtccacgatgctgccttacacccctaataaccagcagcagctcctccggaagcgccacattggcaacgacattgtgaccatcgtgttccaggagcctggcagcaagcccttctgccccaccaccatccgctcgcacttccagcacgtgttcctagtggtgcgggcacacacaccctgcacgccacacaccacctacagggtggccgtgagccgcacccaggacacccctgccttcgggccagctctgcctgctggcggaggccccttcgcagccaacgccgacttccgggccttcctgctggccaaagcgctgaatggtgagcaggcggccggccacgcgcgccagttccacgccatggccacgcgcacccgccagcagtacctgcaagacctggccaccaacgaggtgaccactacgtcgctggactcggcttcacgcttcggcctgccctccctgggtgggaggcgccgggcggcccctcggggcccaggcgccgagctgcaggcagcgggctcactggtgtggggagtgcgcgcggcgcccggggcgcgggtcgccgccggggctcaggcgagcggccccgaaggcatcgaggtgccctgcctgctgggcatctcggccgaggctctggtgctggtggcgccgcgcgacggccgcgtagtgttcaattgcgcctgtcgcgacgtgctggcctggaccttctccgagcagcagctggacctgtaccacggccgcggggaggcgatcacgctgcgcttcgacgggtcccccggccaagccgtgggcgaggtggtggcgcgcctgcagctggtgagccgtggctgcgagacccgcgagctggcgctgccccgcgacggtcaaggccgcctgggcttcgaggtggacgccgagggattcgtcacgcacgtggagcgcttcacattcgccgagacggcggggctgcggcccggggcgcgcctcctgcgcgtgtgcggccagactctgcccagcctccggcccgaggccgctgcccagctcctgcgctcggcgcccaaggtctgcgtcaccgtcctgccccccgacgagagcggccggccccgcaggagtttttcggagctgtacacgctgtcgctgcaggagcctagccggcggggggccccagatcctgtgcaggatgaggtccagggggtgaccctgctgcccaccacaaagcagctgctgcacctgtgcctgcaagatggtggcagtcctccagggcctggggatctggccgaggagaggactgagttcctgcacagccagaactcgctgtcaccacgcagctctctgtcggatgaggccccagtcctgcccaacaccaccccggacctcctcctggccaccacagccaagccatcagtacccagtgctgacagtgagacacccctgacccaggacaggccaggcagtcccagtggctctgaggacaagggcaacccggcgccggagctgagggcctcctttctgccacgtaccttgtctctgcggaactccatcagcaggatcatgtcggaggcgggcagtgggaccctggaggacgagtggcaggccatctcggagattgcctctacttgcaacaccattctggagtcgctgtcccgagagggacagcccatcccagagagtggagaccctaagggaactccaaaatctgatgctgagccagagcctgggaacctctcagagaaggtctctcacttggagtccatgctcaggaagctgcaggaggacctgcagaaggagaaggcggacagggcggccctggaggaggaggtgcggagcctgagacacaacaaccggcggctgcaggcggagtctgagagtgcagccacacgcctcctcctggcctccaagcagctgggctcacccaccgccgacctggcctgagccgtctggaaccacctgggcccctgagggcactgtggtcacactgggccctcctcaggaactctccctgcgcagaggcgtgtcttagcactgcccccctccctagccccttatttggtggcggaagtggcctccaccccttccctgtttgtaaatattctgtggagaaaagaggacttcagggagtaaaaaagccactgatgtc

SEQ ID NO: 181650 - DNA, 3235 bp, Homo sapiens
  Payload ID: 15776
  Gene Symbol: SIPA1
  Gene Name: signal-induced proliferation-associated 1
  ENST ID: ENST00000527525
  CDS Start-End: 248-3070
aggtgcagccctgcttagggcctggagatgggcagacccaggctcacatcctagctctgacacggaattgcttcaggcaagagcatctcctctggacctcatctgaccatctgtcacatggggttcagacctccctgtctgcatcagtgagaccagggcaggaactgctgccacaacctcaggctgggcaccaaacacccgtgcccgccaatgcggcccagcccccggagagtcaggcccacagagcatgcccatgtgggccggcggtgtggggagccctcggcggggcatggcccctgcgtccacagatgacctctttgcccgcaagctgcgccagccagcaaggcccccgctgacaccgcacaccttcgagccgaggccagtccggggcccactcctgcgcagcggcagcgatgcaggcgaggccaggccccccacgccagccagcccccgtgcccgtgcccacagccacgaagaggccagccgacctgcagccacttccacccggctcttcactgacccgctggcactgctggggctgccagcagaggaaccagagcctgccttcccaccagtgcttgagcctcgatggtttgcccactatgacgtgcaaagcctgctctttgattgggctccgaggtctcaggggatggggagccactcagaggccagctctgggaccctggcttcagccgaggaccaggctgccagctcggacctgctgcatggggcacctggctttgtgtgtgagctcgggggtgagggtgagctaggcctgggtggaccagcatccccacctgtgccccctgcactgcccaacgcggccgtgtccatcctggaggagccacagaaccgaacctcggcctacagcctggagcacgcagacctgggtgctggctactaccgcaaatacttctatggcaaagaacatcagaacttcttcgggatggacgagtcgctgggcccggtggcagtgagcctgcggcgggaggagaaggagggcagcggagggggcaccctgcacagctaccgcgtcatcgtgcggaccacgcagctccggacactccgtggcaccatctcggaggacgcgctgccgccggggcccccacggggtctgtccccaaggaaacttctggagcacgtggcgccgcagctgagccccagctgcctgcgcctgggctcagcttcacccaaggtaccacggacgctgctcacactggatgagcaagtgctgagcttccaacgcaaggtgggcatcctgtactgccgggcgggccagggctcggaggaggagatgtacaacaaccaggaggcgggaccggccttcatgcagtttctcaccttgctgggcgatgtggtgcggctcaaaggctttgagagttaccgggcccagctagacaccaaaacggattccacaggcacgcactccctctacaccacataccaggaccacgagatcatgttccacgtgtccacgatgctgccttacacccctaataaccagcagcagctcctccggaagcgccacattggcaacgacattgtgaccatcgtgttccaggagcctggcagcaagcccttctgccccaccaccatccgctcgcacttccagcacgtgttcctagtggtgcgggcacacacaccctgcacgccacacaccacctacagggtggccgtgagccgcacccaggacacccctgccttcgggccagctctgcctgctggcggaggccccttcgcagccaacgccgacttccgggccttcctgctggccaaagcgctgaatggtgagcaggcggccggccacgcgcgccagttccacgccatggccacgcgcacccgccagcagtacctgcaagacctggccaccaacgagcagctggacctgtaccacggccgcggggaggcgatcacgctgcgcttcgacgggtcccccggccaagccgtgggcgaggtggtggcgcgcctgcagctggtgagccgtggctgcgagacccgcgagctggcgctgccccgcgacggtcaaggccgcctgggcttcgaggtggacgccgagggattcgtcacgcacgtggagcgcttcacattcgccgagacggcggggctgcggcccggggcgcgcctcctgcgcgtgtgcggccagactctgcccagcctccggcccgaggccgctgcccagctcctgcgctcggcgcccaaggtctgcgtcaccgtcctgccccccgacgagagcggccggccccgcaggagtttttcggagctgtacacgctgtcgctgcaggagcctagccggcggggggccccagatcctgtgcaggatgaggtccagggggtgaccctgctgcccaccacaaagcagctgctgcacctgtgcctgcaagatggtggcagtcctccagggcctggggatctggccgaggagaggactgagttcctgcacagccagaactcgctgtcaccacgcagctctctgtcggatgaggccccagtcctgcccaacaccaccccggacctcctcctggccaccacagccaagccatcagtacccagtgctgacagtgagacacccctgacccaggacaggccaggcagtcccagtggctctgaggacaagggcaacccggcgccggagctgagggcctcctttctgccacgtaccttgtctctgcggaactccatcagcaggatcatgtcggaggcgggcagtgggaccctggaggacgagtggcaggccatctcggagattgcctctacttgcaacaccattctggagtcgctgtcccgagagggacagcccatcccagagagtggagaccctaagggaactccaaaatctgatgctgagccagagcctgggaacctctcagagaaggtctctcacttggagtccatgctcaggaagctgcaggaggacctgcagaaggagaaggcggacagggcggccctggaggaggaggtgcggagcctgagacacaacaaccggcggctgcaggcggagtctgagagtgcagccacacgcctcctcctggcctccaagcagctgggctcacccaccgccgacctggcctgagccgtctggaaccacctgggcccctgagggcactgtggtcacactgggccctcctcaggaactctccctgcgcagaggcgtgtcttagcactgcccccctccctagccccttatttggtggcggaagtggcctccaccccttccctgtttgtaaatattctgtgg

SEQ ID NO: 181651 - DNA, 379 bp, Homo sapiens
  Payload ID: 15776
  Gene Symbol: SIPA1
  Gene Name: signal-induced proliferation-associated 1
  ENST ID: ENST00000526137
  CDS Start-End: 361-379
gggcggcggcggctgggcgggagccccagaggtactggcgggagcaggggacgggaggcactactgtcgggcccgacaggggagaggtggcctagccgtgggcccgggtgatgtgtatgggagtggggtcctcgccacgttcgccgccagcaccctcccaacttccctccgggctccagctcagtcccgagtcaatatgtccagccccctgtctctgaccagccgttcctactctctctgtgtgacggcttagcctggccagccagccgggcaggaactgctgccacaacctcaggctgggcaccaaacacccgtgcccgccaatgcggcccagcccccggagagtcaggcccacagagcatgcccatgtgggccggcg

SEQ ID NO: 181652 - DNA, 3521 bp, Homo sapiens
  Payload ID: 15776
  Gene Symbol: SIPA1
  Gene Name: signal-induced proliferation-associated 1
  Uniprot ID: Q96FS4
  ENST ID: ENST00000534313
  CDS Start-End: 178-3306
aggcggagccggcgccgggagcggtagcgggagagcggcagcgggaccccagcgcgggcggcggcggctgggcgggagccccagagggcaggaactgctgccacaacctcaggctgggcaccaaacacccgtgcccgccaatgcggcccagcccccggagagtcaggcccacagagcatgcccatgtgggccggcggtgtggggagccctcggcggggcatggcccctgcgtccacagatgacctctttgcccgcaagctgcgccagccagcaaggcccccgctgacaccgcacaccttcgagccgaggccagtccggggcccactcctgcgcagcggcagcgatgcaggcgaggccaggccccccacgccagccagcccccgtgcccgtgcccacagccacgaagaggccagccgacctgcagccacttccacccggctcttcactgacccgctggcactgctggggctgccagcagaggaaccagagcctgccttcccaccagtgcttgagcctcgatggtttgcccactatgacgtgcaaagcctgctctttgattgggctccgaggtctcaggggatggggagccactcagaggccagctctgggaccctggcttcagccgaggaccaggctgccagctcggacctgctgcatggggcacctggctttgtgtgtgagctcgggggtgagggtgagctaggcctgggtggaccagcatccccacctgtgccccctgcactgcccaacgcggccgtgtccatcctggaggagccacagaaccgaacctcggcctacagcctggagcacgcagacctgggtgctggctactaccgcaaatacttctatggcaaagaacatcagaacttcttcgggatggacgagtcgctgggcccggtggcagtgagcctgcggcgggaggagaaggagggcagcggagggggcaccctgcacagctaccgcgtcatcgtgcggaccacgcagctccggacactccgtggcaccatctcggaggacgcgctgccgccggggcccccacggggtctgtccccaaggaaacttctggagcacgtggcgccgcagctgagccccagctgcctgcgcctgggctcagcttcacccaaggtaccacggacgctgctcacactggatgagcaagtgctgagcttccaacgcaaggtgggcatcctgtactgccgggcgggccagggctcggaggaggagatgtacaacaaccaggaggcgggaccggccttcatgcagtttctcaccttgctgggcgatgtggtgcggctcaaaggctttgagagttaccgggcccagctagacaccaaaacggattccacaggcacgcactccctctacaccacataccaggaccacgagatcatgttccacgtgtccacgatgctgccttacacccctaataaccagcagcagctcctccggaagcgccacattggcaacgacattgtgaccatcgtgttccaggagcctggcagcaagcccttctgccccaccaccatccgctcgcacttccagcacgtgttcctagtggtgcgggcacacacaccctgcacgccacacaccacctacagggtggccgtgagccgcacccaggacacccctgccttcgggccagctctgcctgctggcggaggccccttcgcagccaacgccgacttccgggccttcctgctggccaaagcgctgaatggtgagcaggcggccggccacgcgcgccagttccacgccatggccacgcgcacccgccagcagtacctgcaagacctggccaccaacgaggtgaccactacgtcgctggactcggcttcacgcttcggcctgccctccctgggtgggaggcgccgggcggcccctcggggcccaggcgccgagctgcaggcagcgggctcactggtgtggggagtgcgcgcggcgcccggggcgcgggtcgccgccggggctcaggcgagcggccccgaaggcatcgaggtgccctgcctgctgggcatctcggccgaggctctggtgctggtggcgccgcgcgacggccgcgtagtgttcaattgcgcctgtcgcgacgtgctggcctggaccttctccgagcagcagctggacctgtaccacggccgcggggaggcgatcacgctgcgcttcgacgggtcccccggccaagccgtgggcgaggtggtggcgcgcctgcagctggtgagccgtggctgcgagacccgcgagctggcgctgccccgcgacggtcaaggccgcctgggcttcgaggtggacgccgagggattcgtcacgcacgtggagcgcttcacattcgccgagacggcggggctgcggcccggggcgcgcctcctgcgcgtgtgcggccagactctgcccagcctccggcccgaggccgctgcccagctcctgcgctcggcgcccaaggtctgcgtcaccgtcctgccccccgacgagagcggccggccccgcaggagtttttcggagctgtacacgctgtcgctgcaggagcctagccggcggggggccccagatcctgtgcaggatgaggtccagggggtgaccctgctgcccaccacaaagcagctgctgcacctgtgcctgcaagatggtggcagtcctccagggcctggggatctggccgaggagaggactgagttcctgcacagccagaactcgctgtcaccacgcagctctctgtcggatgaggccccagtcctgcccaacaccaccccggacctcctcctggccaccacagccaagccatcagtacccagtgctgacagtgagacacccctgacccaggacaggccaggcagtcccagtggctctgaggacaagggcaacccggcgccggagctgagggcctcctttctgccacgtaccttgtctctgcggaactccatcagcaggatcatgtcggaggcgggcagtgggaccctggaggacgagtggcaggccatctcggagattgcctctacttgcaacaccattctggagtcgctgtcccgagagggacagcccatcccagagagtggagaccctaagggaactccaaaatctgatgctgagccagagcctgggaacctctcagagaaggtctctcacttggagtccatgctcaggaagctgcaggaggacctgcagaaggagaaggcggacagggcggccctggaggaggaggtgcggagcctgagacacaacaaccggcggctgcaggcggagtctgagagtgcagccacacgcctcctcctggcctccaagcagctgggctcacccaccgccgacctggcctgagccgtctggaaccacctgggcccctgagggcactgtggtcacactgggccctcctcaggaactctccctgcgcagaggcgtgtcttagcactgcccccctccctagccccttatttggtggcggaagtggcctccaccccttccctgtttgtaaatattctgtggagaaaagaggacttcagggagtaaaaaagccactgatgtctgtgtctgaa

SEQ ID NO: 181653 - DNA, 562 bp, Homo sapiens
  Payload ID: 15776
  Gene Symbol: SIPA1
  Gene Name: signal-induced proliferation-associated 1
  ENST ID: ENST00000533361
  CDS Start-End: 255-562
agcgggaccccagcgcgggcggcggcggctgggcgggagccccagagtctcactctgtcccgcaggctggagttcagtggcgcgatctcggctcactgcaacctctgcctcccaggtttaagcgattctcctgcctcagcctcctgagtggctgggactacagggcaggaactgctgccacaacctcaggctgggcaccaaacacccgtgcccgccaatgcggcccagcccccggagagtcaggcccacagagcatgcccatgtgggccggcggtgtggggagccctcggcggggcatggcccctgcgtccacagatgacctctttgcccgcaagctgcgccagccagcaaggcccccgctgacaccgcacaccttcgagccgaggccagtccggggcccactcctgcgcagcggcagcgatgcaggcgaggccaggccccccacgccagccagcccccgtgcccgtgcccacagccacgaagaggccagccgacctgcagccacttccacccggctcttcactgacccgctggcactgctggggctgccagcagaggaacc

SEQ ID NO: 181654 - DNA, 3150 bp, Homo sapiens
  Payload ID: 15776
  Gene Symbol: SIPA1
  Gene Name: signal-induced proliferation-associated 1
  ENST ID: ENST00000628801
  CDS Start-End: 123-2945
cgggcggcggcggcgtgaggctgcccttcagggcaggaactgctgccacaacctcaggctgggcaccaaacacccgtgcccgccaatgcggcccagcccccggagagtcaggcccacagagcatgcccatgtgggccggcggtgtggggagccctcggcggggcatggcccctgcgtccacagatgacctctttgcccgcaagctgcgccagccagcaaggcccccgctgacaccgcacaccttcgagccgaggccagtccggggcccactcctgcgcagcggcagcgatgcaggcgaggccaggccccccacgccagccagcccccgtgcccgtgcccacagccacgaagaggccagccgacctgcagccacttccacccggctcttcactgacccgctggcactgctggggctgccagcagaggaaccagagcctgccttcccaccagtgcttgagcctcgatggtttgcccactatgacgtgcaaagcctgctctttgattgggctccgaggtctcaggggatggggagccactcagaggccagctctgggaccctggcttcagccgaggaccaggctgccagctcggacctgctgcatggggcacctggctttgtgtgtgagctcgggggtgagggtgagctaggcctgggtggaccagcatccccacctgtgccccctgcactgcccaacgcggccgtgtccatcctggaggagccacagaaccgaacctcggcctacagcctggagcacgcagacctgggtgctggctactaccgcaaatacttctatggcaaagaacatcagaacttcttcgggatggacgagtcgctgggcccggtggcagtgagcctgcggcgggaggagaaggagggcagcggagggggcaccctgcacagctaccgcgtcatcgtgcggaccacgcagctccggacactccgtggcaccatctcggaggacgcgctgccgccggggcccccacggggtctgtccccaaggaaacttctggagcacgtggcgccgcagctgagccccagctgcctgcgcctgggctcagcttcacccaaggtaccacggacgctgctcacactggatgagcaagtgctgagcttccaacgcaaggtgggcatcctgtactgccgggcgggccagggctcggaggaggagatgtacaacaaccaggaggcgggaccggccttcatgcagtttctcaccttgctgggcgatgtggtgcggctcaaaggctttgagagttaccgggcccagctagacaccaaaacggattccacaggcacgcactccctctacaccacataccaggaccacgagatcatgttccacgtgtccacgatgctgccttacacccctaataaccagcagcagctcctccggaagcgccacattggcaacgacattgtgaccatcgtgttccaggagcctggcagcaagcccttctgccccaccaccatccgctcgcacttccagcacgtgttcctagtggtgcgggcacacacaccctgcacgccacacaccacctacagggtggccgtgagccgcacccaggacacccctgccttcgggccagctctgcctgctggcggaggccccttcgcagccaacgccgacttccgggccttcctgctggccaaagcgctgaatggtgagcaggcggccggccacgcgcgccagttccacgccatggccacgcgcacccgccagcagtacctgcaagacctggccaccaacgagcagctggacctgtaccacggccgcggggaggcgatcacgctgcgcttcgacgggtcccccggccaagccgtgggcgaggtggtggcgcgcctgcagctggtgagccgtggctgcgagacccgcgagctggcgctgccccgcgacggtcaaggccgcctgggcttcgaggtggacgccgagggattcgtcacgcacgtggagcgcttcacattcgccgagacggcggggctgcggcccggggcgcgcctcctgcgcgtgtgcggccagactctgcccagcctccggcccgaggccgctgcccagctcctgcgctcggcgcccaaggtctgcgtcaccgtcctgccccccgacgagagcggccggccccgcaggagtttttcggagctgtacacgctgtcgctgcaggagcctagccggcggggggccccagatcctgtgcaggatgaggtccagggggtgaccctgctgcccaccacaaagcagctgctgcacctgtgcctgcaagatggtggcagtcctccagggcctggggatctggccgaggagaggactgagttcctgcacagccagaactcgctgtcaccacgcagctctctgtcggatgaggccccagtcctgcccaacaccaccccggacctcctcctggccaccacagccaagccatcagtacccagtgctgacagtgagacacccctgacccaggacaggccaggcagtcccagtggctctgaggacaagggcaacccggcgccggagctgagggcctcctttctgccacgtaccttgtctctgcggaactccatcagcaggatcatgtcggaggcgggcagtgggaccctggaggacgagtggcaggccatctcggagattgcctctacttgcaacaccattctggagtcgctgtcccgagagggacagcccatcccagagagtggagaccctaagggaactccaaaatctgatgctgagccagagcctgggaacctctcagagaaggtctctcacttggagtccatgctcaggaagctgcaggaggacctgcagaaggagaaggcggacagggcggccctggaggaggaggtgcggagcctgagacacaacaaccggcggctgcaggcggagtctgagagtgcagccacacgcctcctcctggcctccaagcagctgggctcacccaccgccgacctggcctgagccgtctggaaccacctgggcccctgagggcactgtggtcacactgggccctcctcaggaactctccctgcgcagaggcgtgtcttagcactgcccccctccctagccccttatttggtggcggaagtggcctccaccccttccctgtttgtaaatattctgtggagaaaagaggacttcagggagtaaaaaagccactgatgtc

SEQ ID NO: 181655 - DNA, 6539 bp, Homo sapiens
  Payload ID: 15777
  Gene Symbol: SIPA1L1
  Gene Name: signal-induced proliferation-associated 1 like 1
  Uniprot ID: O43166
  ENST ID: ENST00000358550
  CDS Start-End: 951-6299
gagtcttctaaagtgatgctgtgtgctgcaagagaaatgaaagcgcctgccttggaggcaggaagccgactagggagatgcttaattatcgtggaagtaggtgcttgttaccattgagtggagagtgcagcaagtgcaggtcgtcctccggtgtcagagccgtgatttgtagacaatgccgccctgtcagctcagtgctggttcagcagcatctttccaaacatgtatttggcaagaatttaaaggccacctcttgtgtaatttgtggagtcttggaaaaggagcctctgcctttcttttcagaatgtacgcaaccatgcagaattttgtactcagaatctgtgtctcctgccttctgcctgacgtgctcatgaggaagtttgtttccatgcccgtcacctggaaggatgctaacagttctctgtaatctgttggggatatggagagggccacccagagctgtgttttgtttctgccgtcttcataaattagcactgatggggtggagtaggttgtactgcatgaggaaatgcaggcattttgttcattagtgagatacttctagcttttaagagtacaagaaactaaggagagcttgggaagaggtggtggtgaatgctggattcattctgcaatatcctcgtctcgagaaagcatgggattatggcaaccacagaatctcagtagtacaagttccattcagttttttctgaaagaaagccctctgttaaagtgaagcaaagaaactgttgtggattataacgtttagaagttccaatttttcagtgctttacaaataaagcatcatttaaccttttaaatgaaaaagattaagatctcatgcaactgttgtattttctggaagccattctccaaaagggaagtgcacatttaaaacacagatatgatggtccttgctgcagggatttaagtctacttgcttttacatcatgaccagcttgaaacggtcacagacagaaaggcctcttgccactgacagggcctctgttgttggcacagacggcacccccaaagtccacactgatgatttctacatgcggcgcttccggtcccaaaatggcagcttaggatcatcagttatggctcctgtaggacccccccgaagtgaaggttctcaccatataacctcaacccccggagtcccaaaaatgggggtaagggcaaggattgcagattggcccccaagaaaggaaaacataaaagaatctagccgttcaagccaggaaatagaaacctcaagttgccttgatagcctgtcctccaaaagcagtcctgtgagtcagggaagttctgttagcctcaattccaatgactcagccatgctgaaaagcatacagaacacgctgaaaaacaagacaagaccgtcggagaacatggactccagatttctcatgcctgaagcctaccccagctcccccagaaaagctcttcgcagaatacgccagcgaagcaacagtgatatcaccataagtgaacttgatgtggatagctttgatgaatgtatctcacctacatacaagactggaccatcactgcacagggaatatggtagcacatcttcaattgataaacagggaacatctggagaaagcttttttgatttgttaaagggctacaaagatgacaaatctgatcgaggtccaactccaaccaagctcagtgactttctcattactggtggtggcaagggttctggtttctctttggatgtaatagacgggcctatctcacagagagagaacctcaggctttttaaggaaagggaaaaaccactcaagcgacgttcaaaatctgaaactggagactcatctatttttcgtaaattgcgcaatgccaaaggtgaagaacttgggaagtcatcagatcttgaagataaccgatcagaagactctgtcaggccctggacatgtccaaagtgctttgcccactatgatgtccagagtatattatttgatttgaatgaggcaattatgaacaggcacaatgttattaagaggagaaacaccaccactggagcttccgcagctgccgtggcatccttggtctctggacctctgtctcattcagccagttttagctccccaatgggcagcacagaggacctgaattccaaaggaagcctcagcatggaccagggagatgataaaagcaatgagcttgtaatgagctgtccatattttcggaatgagataggtggagaaggggagaggaaaatcagcctttcaaaatcaaattctggctcctttagtggatgtgaaagtgcctcctttgagtctacccttagttcccattgcacaaatgcaggagtggcagtacttgaagtgcccaaggagaacttggtgttgcacctagatagagtgaaaagatacatcgtggaacacgtagatctgggtgcatactattatagaaaatttttctaccagaaggaacactggaactattttggggctgatgagaatcttggtccagtggctgtgagcattcgaagggaaaaaccagatgaaatgaaagaaaatggatctccgtacaactaccgaataatttttagaactagtgagctcatgacactgagaggttcggtcctggaggacgccattccgtcgacagccaagcactcgacagccagaggcctgcctctcaaagaagtgctggagcacgtggttcctgagctcaatgtccagtgcctgcggttggccttcaacacacccaaggtcacagagcagctcatgaaactggatgaacaagggctgaactaccagcagaaagtaggcatcatgtactgcaaagctggacagagcactgaagaagagatgtacaacaatgagtcagctggcccagcctttgaagaatttcttcaactattgggagagcgagttcggctcaaaggatttgagaagtatcgagcacagcttgataccaaaactgactccactggaacccattctctgtacacaacatacaaagattatgaaattatgttccatgtttctaccatgctgccatacacacccaacaacaaacaacagctcctgaggaagcggcacattggaaatgatatcgtaacaattgttttccaagagcctggagcacagccattcagcccaaaaaacatccgatcccacttccagcacgttttcgtcatcgtcagggtgcacaatccgtgctctgacagtgtctgttatagtgtggctgttaccaggtccagagatgtgccttcctttgggcctcccattcctaaaggggtcactttccctaagtcaaatgtgttcagggacttccttttggcgaaagtgattaatgcagaaaatgctgctcataaatcggagaagtttcgggccatggcaactcggacccgccaggaatacctgaaagatctggcagaaaagaatgtcaccaacacccctatcgacccttctggcaagtttccgttcatctctctggcttccaagaagaaggaaaagtctaagccatatccaggagccgagctcagcagcatgggggccattgtatgggcagtccgggctgaagactacaacaaggccatggaactagactgccttttagggatctccaatgagttcattgtgctcattgaacaggaaacaaagagcgtggtcttcaattgttcctgtagagatgtgatagggtggacttcaactgacaccagcctcaaaatcttctatgaacgaggagaatgtgtttcagtgggtagttttattaacattgaggagatcaaagagattgtcaaaaggttgcagtttgtttcaaaaggctgtgaatcggtggagatgactctgcgaagaaatgggctaggacagcttggcttccatgtcaactatgagggcattgtggcggatgtggagccctacggttatgcctggcaggcagggctgaggcagggcagtcgcctggtggagatctgcaaggtggcggtagccactctgagccatgagcagatgatcgacctcctgagaacatctgtcacggtgaaggttgtcatcattcccccgcatgatgactgcaccccgcggaggagttgctctgaaacctaccgcatgccagtgatggagtacaaaatgaatgaaggtgtttcatacgaattcaagtttcccttccgaaataataacaagtggcagaggaacgccagcaaggggcctcattcacctcaagtcccgtcccaggtgcagagtcccatgacctcgcggctgaatgctggaaaaggagatgggaagatgcctcctccagaaagagccgccaacatccctcgaagcatctccagtgacgggcgcccactagagaggcggctgtctcctggttcggacatctatgtgacggtctcatccatggctttagcaagatcccagtgtcggaactctcctagcaacttgtcttcatccagtgatactggttctgtggggggcacttacaggcagaagtccatgcccgaagggtttggagtgagccgtagatccccagcctccattgacaggcagaacacccagtcagatattggtggcagcggaaaatccacgcctagctggcaaagaagtgaggatagcattgctgaccagatggagccaacatgccatctcccagcagtatcaaaggtactgccagctttccgagagagccccagtgggagattaatgcggcaggatccagtggttcatttgtctccaaacaaacaagggcattctgatagccactactcgagccactccagtagcaatactctctccagcaatgcgtcaagtgcccatagtgatgagaagtggtacgatggggaccgcacagaatccgaactcaacagctataactatctgcaaggcacctctgctgacagtggcattgacaccacctcttatggccccagccacggcagcacagcctcgctgggggctgccacatcgtcacctcgctcagggccaggcaaggagaaagtggcacccctatggcacagctccagtgaagtaatctccatggcagatcggactttggagacagagagccacggcctggaccggaaaacagagtcttccctgagcttagacatacacagcaagagccaagccggctcgacccctctgacaagggagaacagcaccttcagtataaacgatgctgcttcccacacaagtaccatgagctcccgacactctgccagcccagtggttttcaccagtgcccggagttcacctaaagaagagcttcatccagctgccccctcacagctcgcaccatccttctcctcctcttcctcctcctcctctggtcctaggagtttttaccctcgccagggcgctactagcaagtacctgattggatggaaaaaacccgaaggaaccataaactccgtgggatttatggacacgagaaagcgtcatcagagcgatggcaatgaaatagcccacaccaggctgcgtgcctcaaccagagacctccgggcatctcctaagccaacctccaagtccaccattgaagaagatctaaagaaactaattgatcttgaaagcccaactcctgaatcacagaagagttttaagttccacgcactctcctctcctcagtctcctttccccagcacccccacctcacggcgggccttgcacagaacactgtcggacgagagcatttacaatagccagagggagcactttttcacctccagggcgtcacttctggaccaagccctgcccaacgacgtcctcttcagtagcacgtacccttctctccccaagtcgctcccgttgaggaggccttcttacaccttaggaatgaaatcgctgcatggagagttctcagcctcggacagctccctcactgacatccaggagacccgcaggcagcctatgcccgaccctggcctgatgcccctgcctgacactgctgcagacttggattggtccaacctggtagatgctgccaaagcctatgaggtccagagagcctcattttttgctgctagtgatgaaaaccatcgccccttgagtgctgcatccaacagtgatcagctggaggaccaggctctggcccagatgaagccttacagcagtaaagactcctctcccactctggcttctaaagtggaccagctggaaggtatgctgaagatgcttcgggaagatttgaagaaggaaaaagaagacaaagctcaccttcaggcggaggtgcagcacctgcgagaggacaacctgaggctacaggaggagtcccagaacgcctcggacaagctgaagaagttcacagaatgggtcttcaacaccatagacatgagctagggaaggctgaggaggacaggagaagggcccagacactccctccagtgagtgtcctgcagcccttattccctccatagaaagcatcctcagagcaccttccctggcttcctactctgccccctttcggggagtgcacaacacaatagttgcagatcaacaatcatcacctgccttttgtagaaaagaaaaacaaaaaaagtaaataaaaattttaaacagtaaaataaaagtttaactgct

SEQ ID NO: 181656 - DNA, 5944 bp, Homo sapiens
  Payload ID: 15777
  Gene Symbol: SIPA1L1
  Gene Name: signal-induced proliferation-associated 1 like 1
  Uniprot ID: O43166
  ENST ID: ENST00000381232
  CDS Start-End: 349-5700
ggtgtggacgttgtctaaatttcggtagccatggcacaagaatataagaaagcatgggattatggcaaccacagaatctcagtagtacaagttccattcagttttttctgaaagaaagccctctgttaaagtgaagcaaagaaactgttgtggattataacgtttagaagttccaatttttcagtgctttacaaataaagcatcatttaaccttttaaatgaaaaagattaagatctcatgcaactgttgtattttctggaagccattctccaaaagggaagtgcacatttaaaacacagatatgatggtccttgctgcagggatttaagtctacttgcttttacatcatgaccagcttgaaacggtcacagacagaaaggcctcttgccactgacagggcctctgttgttggcacagacggcacccccaaagtccacactgatgatttctacatgcggcgcttccggtcccaaaatggcagcttaggatcatcagttatggctcctgtaggacccccccgaagtgaaggttctcaccatataacctcaacccccggagtcccaaaaatgggggtaagggcaaggattgcagattggcccccaagaaaggaaaacataaaagaatctagccgttcaagccaggaaatagaaacctcaagttgccttgatagcctgtcctccaaaagcagtcctgtgagtcagggaagttctgttagcctcaattccaatgactcagccatgctgaaaagcatacagaacacgctgaaaaacaagacaagaccgtcggagaacatggactccagatttctcatgcctgaagcctaccccagctcccccagaaaagctcttcgcagaatacgccagcgaagcaacagtgatatcaccataagtgaacttgatgtggatagctttgatgaatgtatctcacctacatacaagactggaccatcactgcacagggaatatggtagcacatcttcaattgataaacagggaacatctggagaaagcttttttgatttgttaaagggctacaaagatgacaaatctgatcgaggtccaactccaaccaagctcagtgactttctcattactggtggtggcaagggttctggtttctctttggatgtaatagacgggcctatctcacagagagagaacctcaggctttttaaggaaagggaaaaaccactcaagcgacgttcaaaatctgaaactggagactcatctatttttcgtaaattgcgcaatgccaaaggtgaagaacttgggaagtcatcagatcttgaagataaccgatcagaagactctgtcaggccctggacatgtccaaagtgctttgcccactatgatgtccagagtatattatttgatttgaatgaggcaattatgaacaggcacaatgttattaagaggagaaacaccaccactggagcttccgcagctgccgtggcatccttggtctctggacctctgtctcattcagccagttttagctccccaatgggcagcacagaggacctgaattccaaaggaagcctcagcatggaccagggagatgataaaagcaatgagcttgtaatgagctgtccatattttcggaatgagataggtggagaaggggagaggaaaatcagcctttcaaaatcaaattctggctcctttagtggatgtgaaagtgcctcctttgagtctacccttagttcccattgcacaaatgcaggagtggcagtacttgaagtgcccaaggagaacttggtgttgcacctagatagagtgaaaagatacatcgtggaacacgtagatctgggtgcatactattatagaaaatttttctaccagaaggaacactggaactattttggggctgatgagaatcttggtccagtggctgtgagcattcgaagggaaaaaccagatgaaatgaaagaaaatggatctccgtacaactaccgaataatttttagaactagtgagctcatgacactgagaggttcggtcctggaggacgccattccgtcgacagccaagcactcgacagccagaggcctgcctctcaaagaagtgctggagcacgtggttcctgagctcaatgtccagtgcctgcggttggccttcaacacacccaaggtcacagagcagctcatgaaactggatgaacaagggctgaactaccagcagaaagtaggcatcatgtactgcaaagctggacagagcactgaagaagagatgtacaacaatgagtcagctggcccagcctttgaagaatttcttcaactattgggagagcgagttcggctcaaaggatttgagaagtatcgagcacagcttgataccaaaactgactccactggaacccattctctgtacacaacatacaaagattatgaaattatgttccatgtttctaccatgctgccatacacacccaacaacaaacaacagctcctgaggaagcggcacattggaaatgatatcgtaacaattgttttccaagagcctggagcacagccattcagcccaaaaaacatccgatcccacttccagcacgttttcgtcatcgtcagggtgcacaatccgtgctctgacagtgtctgttatagtgtggctgttaccaggtccagagatgtgccttcctttgggcctcccattcctaaaggggtcactttccctaagtcaaatgtgttcagggacttccttttggcgaaagtgattaatgcagaaaatgctgctcataaatcggagaagtttcgggccatggcaactcggacccgccaggaatacctgaaagatctggcagaaaagaatgtcaccaacacccctatcgacccttctggcaagtttccgttcatctctctggcttccaagaagaaggaaaagtctaagccatatccaggagccgagctcagcagcatgggggccattgtatgggcagtccgggctgaagactacaacaaggccatggaactagactgccttttagggatctccaatgagttcattgtgctcattgaacaggaaacaaagagcgtggtcttcaattgttcctgtagagatgtgatagggtggacttcaactgacaccagcctcaaaatcttctatgaacgaggagaatgtgtttcagtgggtagttttattaacattgaggagatcaaagagattgtcaaaaggttgcagtttgtttcaaaaggctgtgaatcggtggagatgactctgcgaagaaatgggctaggacagcttggcttccatgtcaactatgagggcattgtggcggatgtggagccctacggttatgcctggcaggcagggctgaggcagggcagtcgcctggtggagatctgcaaggtggcggtagccactctgagccatgagcagatgatcgacctcctgagaacatctgtcacggtgaaggttgtcatcattcccccgcatgatgactgcaccccgcggaggagttgctctgaaacctaccgcatgccagtgatggagtacaaaatgaatgaaggtgtttcatacgaattcaagtttcccttccgaaataataacaagtggcagaggaacgccagcaaggggcctcattcacctcaagtcccgtcccaggtgcagagtcccatgacctcgcggctgaatgctggaaaaggagatgggaagatgcctcctccagaaagagccgccaacatccctcgaagcatctccagtgacgggcgcccactagagaggcggctgtctcctggttcggacatctatgtgacggtctcatccatggctttagcaagatcccagtgtcggaactctcctagcaacttgtcttcatccagtgatactggttctgtggggggcacttacaggcagaagtccatgcccgaagggtttggagtgagccgtagatccccagcctccattgacaggcagaacacccagtcagatattggtggcagcggaaaatccacgcctagctggcaaagaagtgaggatagcattgctgaccagatggagccaacatgccatctcccagcagtatcaaaggtactgccagctttccgagagagccccagtgggagattaatgcggcaggatccagtggttcatttgtctccaaacaaacaagggcattctgatagccactactcgagccactccagtagcaatactctctccagcaatgcgtcaagtgcccatagtgatgagaagtggtacgatggggaccgcacagaatccgaactcaacagctataactatctgcaaggcacctctgctgacagtggcattgacaccacctcttatggccccagccacggcagcacagcctcgctgggggctgccacatcgtcacctcgctcagggccaggcaaggagaaagtggcacccctatggcacagctccagtgaagtaatctccatggcagatcggactttggagacagagagccacggcctggaccggaaaacagagtcttccctgagcttagacatacacagcaagagccaagccggctcgacccctctgacaagggagaacagcaccttcagtataaacgatgctgcttcccacacaagtaccatgagctcccgacactctgccagcccagtggttttcaccagtgcccggagttcacctaaagaagagcttcatccagctgccccctcacagctcgcaccatccttctcctcctcttcctcctcctcctctggtcctaggagtttttaccctcgccagggcgctactagcaagtacctgattggatggaaaaaacccgaaggaaccataaactccgtgggatttatggacacgagaaagcgtcatcagagcgatggcaatgaaatagcccacaccaggctgcgtgcctcaaccagagacctccgggcatctcctaagccaacctccaagtccaccattgaagaagatctaaagaaactaattgatcttgaaagcccaactcctgaatcacagaagagttttaagttccacgcactctcctctcctcagtctcctttccccagcacccccacctcacggcgggccttgcacagaacactgtcggacgagagcatttacaatagccagagggagcactttttcacctccagggcgtcacttctggaccaagccctgcccaacgacgtcctcttcagtagcacgtacccttctctccccaagtcgctcccgttgaggaggccttcttacaccttaggaatgaaatcgctgcatggagagttctcagcctcggacagctccctcactgacatccaggagacccgcaggcagcctatgcccgaccctggcctgatgcccctgcctgacactgctgcagacttggattggtccaacctggtagatgctgccaaagcctatgaggtccagagagcctcattttttgctgctagtgatgaaaaccatcgccccttgagtgctgcatccaacagtgatcagctggaggaccaggctctggcccagatgaagccttacagcagcagtaaagactcctctcccactctggcttctaaagtggaccagctggaaggtatgctgaagatgcttcgggaagatttgaagaaggaaaaagaagacaaagctcaccttcaggcggaggtgcagcacctgcgagaggacaacctgaggctacaggaggagtcccagaacgcctcggacaagctgaagaagttcacagaatgggtcttcaacaccatagacatgagctagggaaggctgaggaggacaggagaagggcccagacactccctccagtgagtgtcctgcagcccttattccctccatagaaagcatcctcagagcaccttccctggcttcctactctgccccctttcggggagtgcacaacacaatagttgcagatcaacaatcatcacctgccttttgtagaaaagaaaaacaaaaaaagtaaataaaaattttaaacagtaaaataaaagtttaactgctaaaa

SEQ ID NO: 181657 - DNA, 4129 bp, Homo sapiens
  Payload ID: 15777
  Gene Symbol: SIPA1L1
  Gene Name: signal-induced proliferation-associated 1 like 1
  ENST ID: ENST00000537413
  CDS Start-End: 176-3949
attgtaaactttactggacacaactgatggaagctaaaatcagtgaatgactgtttcaggagaaatgggaggagaagcaggatttgcatgatctccagaacactggaactattttggggctgatgagaatcttggtccagtggctgtgagcattcgaagggaaaaaccagatgaaatgaaagaaaatggatctccgtacaactaccgaataatttttagaactagtgagctcatgacactgagaggttcggtcctggaggacgccattccgtcgacagccaagcactcgacagccagaggcctgcctctcaaagaagtgctggagcacgtggttcctgagctcaatgtccagtgcctgcggttggccttcaacacacccaaggtcacagagcagctcatgaaactggatgaacaagggctgaactaccagcagaaagtaggcatcatgtactgcaaagctggacagagcactgaagaagagatgtacaacaatgagtcagctggcccagcctttgaagaatttcttcaactattgggagagcgagttcggctcaaaggatttgagaagtatcgagcacagcttgataccaaaactgactccactggaacccattctctgtacacaacatacaaagattatgaaattatgttccatgtttctaccatgctgccatacacacccaacaacaaacaacagctcctgaggaagcggcacattggaaatgatatcgtaacaattgttttccaagagcctggagcacagccattcagcccaaaaaacatccgatcccacttccagcacgttttcgtcatcgtcagggtgcacaatccgtgctctgacagtgtctgttatagtgtggctgttaccaggtccagagatgtgccttcctttgggcctcccattcctaaaggggtcactttccctaagtcaaatgtgttcagggacttccttttggcgaaagtgattaatgcagaaaatgctgctcataaatcggagaagtttcgggccatggcaactcggacccgccaggaatacctgaaagatctggcagaaaagaatgtcaccaacacccctatcgacccttctggcaagtttccgttcatctctctggcttccaagaagaaggaaaagtctaagccatatccaggagccgagctcagcagcatgggggccattgtatgggcagtccgggctgaagactacaacaaggccatggaactagactgccttttagggatctccaatgagttcattgtgctcattgaacaggaaacaaagagcgtggtcttcaattgttcctgtagagatgtgatagggtggacttcaactgacaccagcctcaaaatcttctatgaacgaggagaatgtgtttcagtgggtagttttattaacattgaggagatcaaagagattgtcaaaaggttgcagtttgtttcaaaaggctgtgaatcggtggagatgactctgcgaagaaatgggctaggacagcttggcttccatgtcaactatgagggcattgtggcggatgtggagccctacggttatgcctggcaggcagggctgaggcagggcagtcgcctggtggagatctgcaaggtggcggtagccactctgagccatgagcagatgatcgacctcctgagaacatctgtcacggtgaaggttgtcatcattcccccgcatgatgactgcaccccgcggaggagttgctctgaaacctaccgcatgccagtgatggagtacaaaatgaatgaaggtgtttcatacgaattcaagtttcccttccgaaataataacaagtggcagaggaacgccagcaaggggcctcattcacctcaagtcccgtcccaggtgcagagtcccatgacctcgcggctgaatgctggaaaaggagatgggaagatgcctcctccagaaagagccgccaacatccctcgaagcatctccagtgacgggcgcccactagagaggcggctgtctcctggttcggacatctatgtgacggtctcatccatggctttagcaagatcccagtgtcggaactctcctagcaacttgtcttcatccagtgatactggttctgtggggggcacttacaggcagaagtccatgcccgaagggtttggagtgagccgtagatccccagcctccattgacaggcagaacacccagtcagatattggtggcagcggaaaatccacgcctagctggcaaagaagtgaggatagcattgctgaccagatggagccaacatgccatctcccagcagtatcaaaggtactgccagctttccgagagagccccagtgggagattaatgcggcaggatccagtggttcatttgtctccaaacaaacaagggcattctgatagccactactcgagccactccagtagcaatactctctccagcaatgcgtcaagtgcccatagtgatgagaagtggtacgatggggaccgcacagaatccgaactcaacagctataactatctgcaaggcacctctgctgacagtggcattgacaccacctcttatggccccagccacggcagcacagcctcgctgggggctgccacatcgtcacctcgctcagggccaggcaaggagaaagtggcacccctatggcacagctccagtgaagtaatctccatggcagatcggactttggagacagagagccacggcctggaccggaaaacagagtcttccctgagcttagacatacacagcaagagccaagccggctcgacccctctgacaagggagaacagcaccttcagtataaacgatgctgcttcccacacaagtaccatgagctcccgacactctgccagcccagtggttttcaccagtgcccggagttcacctaaagaagagcttcatccagctgccccctcacagctcgcaccatccttctcctcctcttcctcctcctcctctggtcctaggagtttttaccctcgccagggcgctactagcaagtacctgattggatggaaaaaacccgaaggaaccataaactccgtgggatttatggacacgagaaagcgtcatcagagcgatggcaatgaaatagcccacaccaggctgcgtgcctcaaccagagacctccgggcatctcctaagccaacctccaagtccaccattgaagaagatctaaagaaactaattgatcttgaaagcccaactcctgaatcacagaagagttttaagttccacgcactctcctctcctcagtctcctttccccagcacccccacctcacggcgggccttgcacagaacactgtcggacgagagcatttacaatagccagagggagcactttttcacctccagggcgtcacttctggaccaagccctgcccaacgacgtcctcttcagtagcacgtacccttctctccccaagtcgctcccgttgaggaggccttcttacaccttaggaatgaaatcgctgcatggagagttctcagcctcggacagctccctcactgacatccaggagacccgcaggcagcctatgcccgaccctggcctgatgcccctgcctgacactgctgcagacttggattggtccaacctggtagatgctgccaaagcctatgaggtccagagagcctcattttttgctgctagtgatgaaaaccatcgccccttgagtgctgcatccaacagtgatcagctggaggaccaggctctggcccagatgaagccttacagcagtaaagactcctctcccactctggcttctaaagtggaccagctggaaggtatgctgaagatgcttcgggaagatttgaagaaggaaaaagaagacaaagctcaccttcaggcggaggtgcagcacctgcgagaggacaacctgaggctacaggaggagtcccagaacgcctcggacaagctgaagaagttcacagaatgggtcttcaacaccatagacatgagctagggaaggctgaggaggacaggagaagggcccagacactccctccagtgagtgtcctgcagcccttattccctccatagaaagcatcctcagagcaccttccctggcttcctactctgccccctttcggggagtgcacaacacaatagttgcagatcaacaatcatcacctgccttttgtag

SEQ ID NO: 181658 - DNA, 7831 bp, Homo sapiens
  Payload ID: 15777
  Gene Symbol: SIPA1L1
  Gene Name: signal-induced proliferation-associated 1 like 1
  Uniprot ID: O43166
  ENST ID: ENST00000555818
  CDS Start-End: 349-5763
ggtgtggacgttgtctaaatttcggtagccatggcacaagaatataagaaagcatgggattatggcaaccacagaatctcagtagtacaagttccattcagttttttctgaaagaaagccctctgttaaagtgaagcaaagaaactgttgtggattataacgtttagaagttccaatttttcagtgctttacaaataaagcatcatttaaccttttaaatgaaaaagattaagatctcatgcaactgttgtattttctggaagccattctccaaaagggaagtgcacatttaaaacacagatatgatggtccttgctgcagggatttaagtctacttgcttttacatcatgaccagcttgaaacggtcacagacagaaaggcctcttgccactgacagggcctctgttgttggcacagacggcacccccaaagtccacactgatgatttctacatgcggcgcttccggtcccaaaatggcagcttaggatcatcagttatggctcctgtaggacccccccgaagtgaaggttctcaccatataacctcaacccccggagtcccaaaaatgggggtaagggcaaggattgcagattggcccccaagaaaggaaaacataaaagaatctagccgttcaagccaggaaatagaaacctcaagttgccttgatagcctgtcctccaaaagcagtcctgtgagtcagggaagttctgttagcctcaattccaatgactcagccatgctgaaaagcatacagaacacgctgaaaaacaagacaagaccgtcggagaacatggactccagatttctcatgcctgaagcctaccccagctcccccagaaaagctcttcgcagaatacgccagcgaagcaacagtgatatcaccataagtgaacttgatgtggatagctttgatgaatgtatctcacctacatacaagactggaccatcactgcacagggaatatggtagcacatcttcaattgataaacagggaacatctggagaaagcttttttgatttgttaaagggctacaaagatgacaaatctgatcgaggtccaactccaaccaagctcagtgactttctcattactggtggtggcaagggttctggtttctctttggatgtaatagacgggcctatctcacagagagagaacctcaggctttttaaggaaagggaaaaaccactcaagcgacgttcaaaatctgaaactggagactcatctatttttcgtaaattgcgcaatgccaaaggtgaagaacttgggaagtcatcagatcttgaagataaccgatcagaagactctgtcaggccctggacatgtccaaagtgctttgcccactatgatgtccagagtatattatttgatttgaatgaggcaattatgaacaggcacaatgttattaagaggagaaacaccaccactggagcttccgcagctgccgtggcatccttggtctctggacctctgtctcattcagccagttttagctccccaatgggcagcacagaggacctgaattccaaaggaagcctcagcatggaccagggagatgataaaagcaatgagcttgtaatgagctgtccatattttcggaatgagataggtggagaaggggagaggaaaatcagcctttcaaaatcaaattctggctcctttagtggatgtgaaagtgcctcctttgagtctacccttagttcccattgcacaaatgcaggagtggcagtacttgaagtgcccaaggagaacttggtgttgcacctagatagagtgaaaagatacatcgtggaacacgtagatctgggtgcatactattatagaaaatttttctaccagaaggaacactggaactattttggggctgatgagaatcttggtccagtggctgtgagcattcgaagggaaaaaccagatgaaatgaaagaaaatggatctccgtacaactaccgaataatttttagaactagtgagctcatgacactgagaggttcggtcctggaggacgccattccgtcgacagccaagcactcgacagccagaggcctgcctctcaaagaagtgctggagcacgtggttcctgagctcaatgtccagtgcctgcggttggccttcaacacacccaaggtcacagagcagctcatgaaactggatgaacaagggctgaactaccagcagaaagtaggcatcatgtactgcaaagctggacagagcactgaagaagagatgtacaacaatgagtcagctggcccagcctttgaagaatttcttcaactattgggagagcgagttcggctcaaaggatttgagaagtatcgagcacagcttgataccaaaactgactccactggaacccattctctgtacacaacatacaaagattatgaaattatgttccatgtttctaccatgctgccatacacacccaacaacaaacaacagctcctgaggaagcggcacattggaaatgatatcgtaacaattgttttccaagagcctggagcacagccattcagcccaaaaaacatccgatcccacttccagcacgttttcgtcatcgtcagggtgcacaatccgtgctctgacagtgtctgttatagtgtggctgttaccaggtccagagatgtgccttcctttgggcctcccattcctaaaggggtcactttccctaagtcaaatgtgttcagggacttccttttggcgaaagtgattaatgcagaaaatgctgctcataaatcggagaagtttcgggccatggcaactcggacccgccaggaatacctgaaagatctggcagaaaagaatgtcaccaacacccctatcgacccttctggcaagtttccgttcatctctctggcttccaagaagaaggaaaagtctaagccatatccaggagccgagctcagcagcatgggggccattgtatgggcagtccgggctgaagactacaacaaggccatggaactagactgccttttagggatctccaatgagttcattgtgctcattgaacaggaaacaaagagcgtggtcttcaattgttcctgtagagatgtgatagggtggacttcaactgacaccagcctcaaaatcttctatgaacgaggagaatgtgtttcagtgggtagttttattaacattgaggagatcaaagagattgtcaaaaggttgcagtttgtttcaaaaggctgtgaatcggtggagatgactctgcgaagaaatgggctaggacagcttggcttccatgtcaactatgagggcattgtggcggatgtggagccctacggttatgcctggcaggcagggctgaggcagggcagtcgcctggtggagatctgcaaggtggcggtagccactctgagccatgagcagatgatcgacctcctgagaacatctgtcacggtgaaggttgtcatcattcccccgcatgatgactgcaccccgcggaggagttgctctgaaacctaccgcatgccagtgatggagtacaaaatgaatgaaggtgtttcatacgaattcaagtttcccttccgaaataataacaagtggcagaggaacgccagcaaggggcctcattcacctcaagtcccgtcccaggtgcagagtcccatgacctcgcggctgaatgctggaaaaggagatgggaagatgcctcctccagaaagagccgccaacatccctcgaagcatctccagtgacgggcgcccactagagaggcggctgtctcctggttcggacatctatgtgacggtctcatccatggctttagcaagatcccagtgtcggaactctcctagcaacttgtcttcatccagtgatactggttctgtggggggcacttacaggcagaagtccatgcccgaagggtttggagtgagccgtagatccccagcctccattgacaggcagaacacccagtcagatattggtggcagcggaaaatccacgcctagctggcaaagaagtgaggatagcattgctgaccagatggcttacagttatagaggacctcaggatttcaattcttttgtcctcgagcagcatgaatatacagagccaacatgccatctcccagcagtatcaaaggtactgccagctttccgagagagccccagtgggagattaatgcggcaggatccagtggttcatttgtctccaaacaaacaagggcattctgatagccactactcgagccactccagtagcaatactctctccagcaatgcgtcaagtgcccatagtgatgagaagtggtacgatggggaccgcacagaatccgaactcaacagctataactatctgcaaggcacctctgctgacagtggcattgacaccacctcttatggccccagccacggcagcacagcctcgctgggggctgccacatcgtcacctcgctcagggccaggcaaggagaaagtggcacccctatggcacagctccagtgaagtaatctccatggcagatcggactttggagacagagagccacggcctggaccggaaaacagagtcttccctgagcttagacatacacagcaagagccaagccggctcgacccctctgacaagggagaacagcaccttcagtataaacgatgctgcttcccacacaagtaccatgagctcccgacactctgccagcccagtggttttcaccagtgcccggagttcacctaaagaagagcttcatccagctgccccctcacagctcgcaccatccttctcctcctcttcctcctcctcctctggtcctaggagtttttaccctcgccagggcgctactagcaagtacctgattggatggaaaaaacccgaaggaaccataaactccgtgggatttatggacacgagaaagcgtcatcagagcgatggcaatgaaatagcccacaccaggctgcgtgcctcaaccagagacctccgggcatctcctaagccaacctccaagtccaccattgaagaagatctaaagaaactaattgatcttgaaagcccaactcctgaatcacagaagagttttaagttccacgcactctcctctcctcagtctcctttccccagcacccccacctcacggcgggccttgcacagaacactgtcggacgagagcatttacaatagccagagggagcactttttcacctccagggcgtcacttctggaccaagccctgcccaacgacgtcctcttcagtagcacgtacccttctctccccaagtcgctcccgttgaggaggccttcttacaccttaggaatgaaatcgctgcatggagagttctcagcctcggacagctccctcactgacatccaggagacccgcaggcagcctatgcccgaccctggcctgatgcccctgcctgacactgctgcagacttggattggtccaacctggtagatgctgccaaagcctatgaggtccagagagcctcattttttgctgctagtgatgaaaaccatcgccccttgagtgctgcatccaacagtgatcagctggaggaccaggctctggcccagatgaagccttacagcagcagtaaagactcctctcccactctggcttctaaagtggaccagctggaaggtatgctgaagatgcttcgggaagatttgaagaaggaaaaagaagacaaagctcaccttcaggcggaggtgcagcacctgcgagaggacaacctgaggctacaggaggagtcccagaacgcctcggacaagctgaagaagttcacagaatgggtcttcaacaccatagacatgagctagggaaggctgaggaggacaggagaagggcccagacactccctccagtgagtgtcctgcagcccttattccctccatagaaagcatcctcagagcaccttccctggcttcctactctgccccctttcggggagtgcacaacacaatagttgcagatcaacaatcatcacctgccttttgtagaaaagaaaaacaaaaaaagtaaataaaaattttaaacagtaaaataaaagtttaactgctaaaatgtgaatgtctttatttttttgcacaatatctttatctgttatgtatttaagaagaaactgggccttggaccagggcgccccctggcccatccgcctctattcccatcagctttcttatcaacttcaggtaacccaagctttcccttgttattctaacaaatatcattattcctagaaaaagaatgtttttataacttgtttggggagtagagagggatatttccttaccttcttccctaaaatgcctggagagggagttgctttgagaaaatgcctacctcccttgaatgactcgtgcatgagctagtgctgtctgtacctgtcctccagagatcagcaggaccggagttaaatatttaacagcaagtctgtaaaccagagcagctctgacagtgcctgcaggccacaccccttctcagtcctgcattgtgaggtcatttcctgcttctccctttccccaggaagatggtcccacttgtgctgcaagactcttttttgtttggcttaattgagccccactaaattggaatcaatctctcttacagcttcctggctccaaacattaattgatttcagaattcccccaaactaaaaccttatctgtctgcattttgaatgcattttggtcaaaagtatacgttttaaagatttttaaagataaaaatgtggcacaactggtttttttagcttgctgaaaatgaccatatctctaaattaatctttctctccagagcaagacttcaccagtatttgtaactaggagaagctaacagtgaatgtttaattgtgaattttaatcattgcttgttaggaataatgactgtgatactagaatgggcttttgaaacctgcatgtcccagtgtgaaatttcagcacggcattttctgcatcctttcatggccatccaaaggattccgctgcagaaattattgatgtgctatttttgctgtcttgtgatgcaggctgctttgggcccctgggtcactcttccaaggctgctgtagagcacagagacatggggctggccagtgttgactgacctgaggagacccctttgtttgttgccttcataactgtcactaaaccgacccctctgccctttcagtggcaactctggtctaagggaacattcagcactctagcggcatctgattggaagttccctcacccaagtaatctcaattccttcctctctccatccctgaaagaaacaggatggattttcctctcttctccctgctacattcactaccagatttttatgctacagtttcattcttgattgtgatttctccatggaattttttttttctggtgacatttctatcatggaaataggaagatttcggagtgctttgtgaagatttcaattgtctgtctctttctctctttgacttgtatgaaggagattgtacattgcctgatatctctttgtaaatgagaaatattgctaacatccaagcattctgaagtcttgcttatccttctgagtttagttctcattttgttttacattttgtttggggacttggggcaagctatttattagagttttgcaacagagttcttgtttgaagcctctaaagactacctgtaaaattcaaagaataaaattcattttaaacgctcttttaaaacactttggtattattgcttgaggtttgcttatttgaaagaccacccaataactcattgaccctccttgcatccgaattttttcatcaagctttgttaacactaatgatgattcttgaaaatttctgtccttctcagaatgttaataaacttttttactctgtccacatgtcgatagagaattact

SEQ ID NO: 181659 - DNA, 744 bp, Homo sapiens
  Payload ID: 15777
  Gene Symbol: SIPA1L1
  Gene Name: signal-induced proliferation-associated 1 like 1
  ENST ID: ENST00000557151
  CDS Start-End: 648-744
gcaccccagaacccgaatctgcacaactactgggcaggcgtctctgcgggaggccaggagacccgcgtcccggtccgggcggttgcgtccaccccgctgagctggtcgccacctggcgacccttcccctccagtcacctgggccctccctatcctgaagacattagctgagagtctggcaccttttaaaggtctgatcatcaattgtctctctgggcggccacctatgagacttcatctgtgtgctttataaatagcagtccagggcaacagtacttgataaaaaggttataccttattggtgtggacgttgtctaaatttcggtagccatggcacaagaatataagaaagcatgggattatggcaaccacagaatctcagtagtacaagttccattcagttttttctgaaagaaagccctctgttaaagtgaagcaaagaaactgttgtggattataacgtttagaagttccaatttttcagtgctttacaaataaagcatcatttaaccttttaaatgaaaaagattaagatctcatgcaactgttgtattttctggaagccattctccaaaagggaagtgcacatttaaaacacagatatgatggtccttgctgcagggatttaagtctacttgcttttacatcatgaccagcttgaaacggtcacagacagaaaggcctcttgccactgacagggcctctgttgttggcacagacggcacccccaaagtccacactgatg

SEQ ID NO: 181660 - DNA, 785 bp, Homo sapiens
  Payload ID: 15777
  Gene Symbol: SIPA1L1
  Gene Name: signal-induced proliferation-associated 1 like 1
  ENST ID: ENST00000555066
  CDS Start-End: 1-785
gaacactggaactattttggggctgatgagaatcttggtccagtggctgtgagcattcgaagggaaaaaccagatgaaatgaaagaaaatggatctccgtacaactaccgaataatttttagaactagtgagctcatgacactgagaggttcggtcctggaggacgccattccgtcgacagccaagcactcgacagccagaggcctgcctctcaaagaagtgctggagcacgtggttcctgagctcaatgtccagtgcctgcggttggccttcaacacacccaaggtcacagagcagctcatgaaactggatgaacaagggtggatctgcctatatttatatgcatcgtattacctgccttcacagctgaactaccagcagaaagtaggcatcatgtactgcaaagctggacagagcactgaagaagagatgtacaacaatgagtcagctggcccagcctttgaagaatttcttcaactattgggagagcgagttcggctcaaaggatttgagaagtatcgagcacagcttgataccaaaactgactccactggaacccattctctgtacacaacatacaaagattatgaaattatgttccatgtttctaccatgctgccatacacacccaacaacaaacaacagctcctgaggaagcggcacattggaaatgatatcgtaacaattgttttccaagagcctggagcacagccattcagcccaaaaaacatccgatcccacttccagcacgttttcgtcatcgtcagggtgcacaatccgtgctc

SEQ ID NO: 181661 - DNA, 6555 bp, Homo sapiens
  Payload ID: 15778
  Gene Symbol: SIPA1L2
  Gene Name: signal-induced proliferation-associated 1 like 2
  Uniprot ID: Q9P2F8
  ENST ID: ENST00000262861
  CDS Start-End: 228-5396
cttttgaaaagaacagaggcgtacaacattattacgacaacagagaagcaagttggctttgaagaaactgtattctgaggatgttgtttgctttgggctaagaaaagaaaaaatacaactacagacaaagcctttatatctgcaagtattatggcgtggtcggtagcaatgtaattagatttacatcagtcttcctggtgagacttggaggctcttcctcggtagacatgagtgacccaaggcagtcacaagaagagaagcacaagctaggcagagcctcttcaaagttcaaggatccccctagaatcatgcagtcagatgattattttgctcggaaatttaaagccattaatggcaacatgggacccactacttctttaaatgcctcgaattccaatgagactggcggtggtggtccggctaatggtaccccagctgtgcccaagatgggtgtgagagcaagggtgtctgaatggcctcctaaaaaggactgttccaaggagctaacatgcaaggcactgtgggaaagccggtctcagaccagttatgaaagcatcacttctgtcctgcagaatgggcagagtgaccagagtgaaggtcagcaagatgaacagctcgatctggacttcgtggaggccaagtacacaatcggagacatctttgtccattccccccaaagaggacttcaccccataagacagaggagcaatagtgatgtcactatcagtgacattgatgccgaagatgtcttagaccaaaatgcagtcaaccccaacaccggggctgccctgcacagggagtatggaagtacttcatccatcgacaggcaaggcttatctggtgaaaacttttttgctatgctcagagggtaccgagtagaaaattatgaccacaaagcaatggtcccttttgggttccctgaatttttccgctgtgaccctgcaatctctccgagccttcatgcagcagcacagatttctaggggagaatttgtccgcatctcaggattagattatgtggacagtgccctcctgatggggagagacagggacaagcctttcaaacggaggttgaaatcagagtcggtggaaacatctctcttccgaaagcttcgaactgttaaaagtgagcacgaaactttcaagttcacgtctgagctggaggagagccgactggagaggggcattcgcccttggaattgtcagcgatgttttgcacattatgatgtccagagcattttgtttaatatcaacgaagccatggctacgagggctaatgtggggaaaaggaaaaacataaccactggggcatctgcagcatcccagactcagatgcctacgggccagacaggcaactgtgagtcccctttagggagcaaggaggacctcaactccaaagagaacctggatgccgatgagggtgatgggaaaagtaacgacctcgtccttagttgtccttactttagaaatgagactggaggggaaggcgacaggcggattgcgctctctcgagccaactcatcctctttcagttctggggaaagctgctctttcgaatcgtcactcagctctcactgcacaaatgcaggtgtctccgtcttggaagtgcccagagaaaaccagcctattcacagggagaaagtgaagcgctacatcatagaacacattgaccttggggcctattattaccgcaaattcttctatgggaaagagcaccaaaactactttggaatagatgaaaaccttggtccagtagcagtcagcatccggagagagaaggtggaagatgccaaggagaaagaaggatcccagttcaactacagggtggctttcaggacaagtgagcttacaacactgagaggagcaattttagaagatgctataccctctactgctaggcatggtaccgcacgaggactacctctcaaagaagttttggaatacgtcattccagagctgagcattcagtgtttgcgacaggcttccaactcacccaaggtctcagagcagctgctcaagcttgatgaacaagggctgagctttcagcacaagatcgggatcctttattgcaaagcaggccagagcacagaggaagagatgtataacaatgagacggcgggaccagcttttgaagaattccttgatcttctgggccagagagtccgactgaaaggatttagtaaatatcgagctcagctagacaataagactgattccacgggcacgcactctctctataccacatacaaagactacgaactcatgttccacgtgtcaaccctgcttccctacatgcccaacaacagacaacagctactgaggaaaaggcacataggaaatgacatcgtcaccatcgtcttccaggagcctggggcacttccttttactccaaaaagcatccggtctcactttcagcatgtctttgtcatagtcaaagtgcataatccatgtaccgaaaatgtgtgttatagtgttggagtttccagatcaaaagatgtgccaccatttggcccaccgattcccaaaggtgtaacttttccaaagtcagccgtgttccgggacttccttttagccaaagtaatcaatgcagaaaatgcagcccataaatcagaaaagtttcgagcaatggccactcgaacgaggcaggagtacttgaaagatctggcggagaactttgtcacaaccgccaccgtggatacctctgtgaagttcagcttcattacgctgggtgcgaagaaaaaggagaaggtaaagccaaggaaggatgcccacttgtttagcattggggccatcatgtggcacgtgatagcccgggacttcggccagtctgctgacattgaatgtcttctcgggatctccaatgagttcatcatgttgattgaaaaggattccaagaatgttgtattcaactgttcctgcagggatgtgattgggtggacatctggattagtgagtatcaaagtgttttacgaaagaggagaatgtgtcctcctgtcctcggtagacaactgtgctgaagacatcagggaaattgttcagcgattagtaatagtgacgagaggctgcgagactgtggaaatgaccctgaggaggaacgggctgggccagcttggcttccatgtgaattttgaaggaattgtcgcagatgtggaaccttttggctttgcctggaaggctggccttcgccaagggagccgcctcgtggagatctgcaaagtagccgtggccactctgacccacgagcagatgatcgacctgctccgtacttctgtgactgtgaaggtggtcatcatccagccccatgatgacggctcgccccgaagagggtgttcagagctctgccggatccctatggtggaatataaactcgacagcgagggcaccccctgcgagtataaaacccccttcaggaggaacaccacgtggcaccgggtgcccactcctgccctgcagcccctctctagagcttcccccatccccggcacgcccgaccggctgccgtgccaacagctgctccagcaggcccaggctgccattcctcgaagcacctccttcgaccggaagctgcccgatggcacgagaagctcacccagcaaccagtcatcctccagcgaccctggacccggcgggagcggaccctggagaccacaagtgggctacgacgggtgccagtcccctctactgctcgaacaccagggctcaggccctttggaatgtgacggagccagggagagggaagacaccatggaagcaagcaggcacccggaaaccaaatggcatggcccaccttccaaagtcctgggttcctataaagaaagagctctgcagaaagatggaagttgcaaagattcccccaataagctttctcacattggggataaaagttgctccagtcactccagcagcaacacgctctccagcaacacctccagcaacagtgacgacaagcactttgggtctggcgacctgatggaccccgaattactggggctgacctacatcaaaggggcctccaccgacagtggcatcgacacggccccctgcatgcctgccaccatcctcggccctgtgcacctggcaggcagcaggtccctgatccacagccgggccgagcagtgggctgatgctgccgacgtctctgggcctgacgacgagccagccaagttatattctgtgcatggctacgcgtccaccatctccgccggcagtgctgcggaaggcagcatgggcgatctcagtgagatatcctctcattccagtggttctcaccattcaggaagcccttcagctcactgttcaaaaagtagtgggtctctggattcatccaaagtctacatcgtgtctcacagcagcggacaacaggttcccgggtccatgtccaagccctaccacagacaaggggcagtgaacaaatatgtcatcggctggaagaaatcggagggcagcccaccgcccgaggagcctgaagtgactgaatgtcccgggatgtatagtgagatggatgtcatgtccacagcaactcagcatcagacagtggtgggagatgctgttgcagagactcaacatgttctgtctaaagaagattttctgaaattgatgcttcctgacagccccttagtggaggaggggcgaagaaagttttcgttctatgggaacctgtctccaaggaggtcgctttaccgcacgctgtctgacgagagcatctgcagcaacaggagggggtcctcctttggcagttcccggagttccgtgcttgaccaggccctgcccaacgacattctgttcagcaccaccccaccctaccacagcacgctgcctccgcgggcccaccccgcacccagcatggggagcctgagaaatgagttctggttctccgatgggtccttatcagataagtccaagtgcgcagatcctggcctgatgcccctcccggacacagccacagggttagattggacccacctcgtggatgctgcacgggcatttgaaggtcttgactcagatgaagaactggggctgctctgtcaccacacgtcctatctagaccagagggtggcatccttctgcaccctgacagatatgcagcatgggcaggacctggaaggggcccaagagctgcccttatgtgtagatccaggcagtggcaaagagttcatggacacaactggggagcgttctccatcaccactgaccgggaaagtcaatcagctggaattaattcttcgacaactccagaccgaccttcggaaggaaaaacaagacaaggccgttctccaagcagaagtgcagcacctgagacaggacaacatgagactgcaggaggagtcccagaccgcgacagctcagctgcggaaattcacagaatggtttttcaccaccatcgacaaaaaatcttagccaatccgcacctcatcaagggaccactgggaaatgccccttgtccctttgaagtcacaaacatgtggtttttctgtgtgctttcaaccaatcgtagatgtttttgctgttccattctgtgtagcaccattcaccacagcaggatagggagcctcgactctttctcggtaaccacggcagagagcagcgccgatgtgaagatgaatgaatgtaactcctggtgtgaagatgaatgtaaaccctggcgacagttgagacctttttcttttagactctgctaaaacagtgctctggcttgggcttacctcaagagggaagatagttgagttttatttcctgtatatcaggtgacctggtagagatgtaaagcaatttaccatagtttgggctttagtattgtaaaataaacatgagaacaaataatcagacatatactttaatgttaaaggtgctctatttttttggatgtacagtagttttatttccacagccacattaccatagcaataagaaaggaggcatagtacatagttggaaaagctttgtggggggattaaaaaaaaaaaaaagcactgttgtgtttaacactagttcagatgcagttaccttagagacttatttatttgcaggaacaaatggtgcctgaatattaacagtgttctgattaaaaacaaaaaaaagatacatatgccttgtaaatggctcaccgagtggtcagtagtcacttcaactcttagttcacttttgtatagttgctctgctggaaagaaatgagagtgaatctgcttactcactagaacttccctgtgtgctgtgagccagcggaaccacttgtacaatgccagatttgtttatctttgtacagaagctttgatgaagtgtcttgtatttaacacccttatttaagcttatttaaccttaaattgttaattttataaaatttggtttggcctgcactacgatgagggatggaggtagctgcaggctcagaagagactgagcttgcacagatcagaccgagaagcagggtgagagattctaacgactggatgctgctagtaacacattgtttgtattgctttaccatttttaactgttagatttgagatgaacatacattttgcttttttaataaatgtttaaaagaagtccacataag

SEQ ID NO: 181662 - DNA, 2937 bp, Homo sapiens
  Payload ID: 15778
  Gene Symbol: SIPA1L2
  Gene Name: signal-induced proliferation-associated 1 like 2
  Uniprot ID: Q9P2F8
  ENST ID: ENST00000308942
  CDS Start-End: 184-2520
acttactgtcataggtcttattaaataggtatctatgtagtcagagcatgtttcatagaaatggagtgttcattaaactgaaacttcatacattgcctctgggcttttggggataggagtatgatacctcccaacttgaaattcccacagataggtgaggtcatagtcatcgggtgatacttaatgagcccatgtttttctttcattggatgtaaactatgctcgatagtgacgagaggctgcgagactgtggaaatgaccctgaggaggaacgggctgggccagcttggcttccatgtgaattttgaaggaattgtcgcagatgtggaaccttttggctttgcctggaaggctggccttcgccaagggagccgcctcgtggagatctgcaaagtagccgtggccactctgacccacgagcagatgatcgacctgctccgtacttctgtgactgtgaaggtggtcatcatccagccccatgatgacggctcgccccgaagagggtgttcagagctctgccggatccctatggtggaatataaactcgacagcgagggcaccccctgcgagtataaaacccccttcaggaggaacaccacgtggcaccgggtgcccactcctgccctgcagcccctctctagagcttcccccatccccggcacgcccgaccggctgccgtgccaacagctgctccagcaggcccaggctgccattcctcgaagcacctccttcgaccggaagctgcccgatggcacgagaagctcacccagcaaccagtcatcctccagcgaccctggacccggcgggagcggaccctggagaccacaagtgggctacgacgggtgccagtcccctctactgctcgaacaccagggctcaggccctttggaatgtgacggagccagggagagggaagacaccatggaagcaagcaggcacccggaaaccaaatggcatggcccaccttccaaagtcctgggttcctataaagaaagagctctgcagaaagatggaagttgcaaagattcccccaataagctttctcacattggggataaaagttgctccagtcactccagcagcaacacgctctccagcaacacctccagcaacagtgacgacaagcactttgggtctggcgacctgatggaccccgaattactggggctgacctacatcaaaggggcctccaccgacagtggcatcgacacggccccctgcatgcctgccaccatcctcggccctgtgcacctggcaggcagcaggtccctgatccacagccgggccgagcagtgggctgatgctgccgacgtctctgggcctgacgacgagccagccaagttatattctgtgcatggctacgcgtccaccatctccgccggcagtgctgcggaaggcagcatgggcgatctcagtgagatatcctctcattccagtggttctcaccattcaggaagcccttcagctcactgttcaaaaagtagtgggtctctggattcatccaaagtctacatcgtgtctcacagcagcggacaacaggttcccgggtccatgtccaagccctaccacagacaaggggcagtgaacaaatatgtcatcggctggaagaaatcggagggcagcccaccgcccgaggagcctgaagtgactgaatgtcccgggatgtatagtgagatggatgtcatgtccacagcaactcagcatcagacagtggtgggagatgctgttgcagagactcaacatgttctgtctaaagaagattttctgaaattgatgcttcctgacagccccttagtggaggaggggcgaagaaagttttcgttctatgggaacctgtctccaaggaggtcgctttaccgcacgctgtctgacgagagcatctgcagcaacaggagggggtcctcctttggcagttcccggagttccgtgcttgaccaggccctgcccaacgacattctgttcagcaccaccccaccctaccacagcacgctgcctccgcgggcccaccccgcacccagcatggggagcctgagaaatgagttctggttctccgatgggtccttatcagataagtccaagtgcgcagatcctggcctgatgcccctcccggacacagccacagggttagattggacccacctcgtggatgctgcacgggcatttgaagaccagagggtggcatccttctgcaccctgacagatatgcagcatgggcaggacctggaaggggcccaagagctgcccttatgtgtagatccaggcagtggcaaagagttcatggacacaactggggagcgttctccatcaccactgaccgggaaagtcaatcagctggaattaattcttcgacaactccagaccgaccttcggaaggaaaaacaagacaaggccgttctccaagcagaagtgcagcacctgagacaggacaacatgagactgcaggaggagtcccagaccgcgacagctcagctgcggaaattcacagaatggtttttcaccaccatcgacaaaaaatcttagccaatccgcacctcatcaagggaccactgggaaatgccccttgtccctttgaagtcacaaacatgtggtttttctgtgtgctttcaaccaatcgtagatgtttttgctgttccattctgtgtagcaccattcaccacagcaggatagggagcctcgactctttctcggtaaccacggcagagagcagcgccgatgtgaagatgaatgaatgtaactcctggtgtgaagatgaatgtaaaccctggcgacagttgagacctttttcttttagactctgctaaaacagtgctctggcttgggcttacctcaagagggaagatagttgagttttatttcctgtatatcaggtgacctggtagagatgtaaagcaatttaccatagtttgggctttagtattgtaaaataaacatgagaac

SEQ ID NO: 181663 - DNA, 6690 bp, Homo sapiens
  Payload ID: 15778
  Gene Symbol: SIPA1L2
  Gene Name: signal-induced proliferation-associated 1 like 2
  Uniprot ID: Q9P2F8
  ENST ID: ENST00000366630
  CDS Start-End: 360-5528
actaggggtgggcattgtgtgtggctcccctgtggtagagaaggacatcggatgaacatgtgatctgtgtatccagctccaacccaaaaggtgaaggaaatactcatgaccagccagatgtcttaaggaatgcttttgaaaagaacagaggcgtacaacattattacgacaacagagaagcaagttggctttgaagaaactgtattctgaggatgttgtttgctttgggctaagaaaagaaaaaatacaactacagacaaagcctttatatctgcaagtattatggcgtggtcggtagcaatgtaattagatttacatcagtcttcctggtgagacttggaggctcttcctcggtagacatgagtgacccaaggcagtcacaagaagagaagcacaagctaggcagagcctcttcaaagttcaaggatccccctagaatcatgcagtcagatgattattttgctcggaaatttaaagccattaatggcaacatgggacccactacttctttaaatgcctcgaattccaatgagactggcggtggtggtccggctaatggtaccccagctgtgcccaagatgggtgtgagagcaagggtgtctgaatggcctcctaaaaaggactgttccaaggagctaacatgcaaggcactgtgggaaagccggtctcagaccagttatgaaagcatcacttctgtcctgcagaatgggcagagtgaccagagtgaaggtcagcaagatgaacagctcgatctggacttcgtggaggccaagtacacaatcggagacatctttgtccattccccccaaagaggacttcaccccataagacagaggagcaatagtgatgtcactatcagtgacattgatgccgaagatgtcttagaccaaaatgcagtcaaccccaacaccggggctgccctgcacagggagtatggaagtacttcatccatcgacaggcaaggcttatctggtgaaaacttttttgctatgctcagagggtaccgagtagaaaattatgaccacaaagcaatggtcccttttgggttccctgaatttttccgctgtgaccctgcaatctctccgagccttcatgcagcagcacagatttctaggggagaatttgtccgcatctcaggattagattatgtggacagtgccctcctgatggggagagacagggacaagcctttcaaacggaggttgaaatcagagtcggtggaaacatctctcttccgaaagcttcgaactgttaaaagtgagcacgaaactttcaagttcacgtctgagctggaggagagccgactggagaggggcattcgcccttggaattgtcagcgatgttttgcacattatgatgtccagagcattttgtttaatatcaacgaagccatggctacgagggctaatgtggggaaaaggaaaaacataaccactggggcatctgcagcatcccagactcagatgcctacgggccagacaggcaactgtgagtcccctttagggagcaaggaggacctcaactccaaagagaacctggatgccgatgagggtgatgggaaaagtaacgacctcgtccttagttgtccttactttagaaatgagactggaggggaaggcgacaggcggattgcgctctctcgagccaactcatcctctttcagttctggggaaagctgctctttcgaatcgtcactcagctctcactgcacaaatgcaggtgtctccgtcttggaagtgcccagagaaaaccagcctattcacagggagaaagtgaagcgctacatcatagaacacattgaccttggggcctattattaccgcaaattcttctatgggaaagagcaccaaaactactttggaatagatgaaaaccttggtccagtagcagtcagcatccggagagagaaggtggaagatgccaaggagaaagaaggatcccagttcaactacagggtggctttcaggacaagtgagcttacaacactgagaggagcaattttagaagatgctataccctctactgctaggcatggtaccgcacgaggactacctctcaaagaagttttggaatacgtcattccagagctgagcattcagtgtttgcgacaggcttccaactcacccaaggtctcagagcagctgctcaagcttgatgaacaagggctgagctttcagcacaagatcgggatcctttattgcaaagcaggccagagcacagaggaagagatgtataacaatgagacggcgggaccagcttttgaagaattccttgatcttctgggccagagagtccgactgaaaggatttagtaaatatcgagctcagctagacaataagactgattccacgggcacgcactctctctataccacatacaaagactacgaactcatgttccacgtgtcaaccctgcttccctacatgcccaacaacagacaacagctactgaggaaaaggcacataggaaatgacatcgtcaccatcgtcttccaggagcctggggcacttccttttactccaaaaagcatccggtctcactttcagcatgtctttgtcatagtcaaagtgcataatccatgtaccgaaaatgtgtgttatagtgttggagtttccagatcaaaagatgtgccaccatttggcccaccgattcccaaaggtgtaacttttccaaagtcagccgtgttccgggacttccttttagccaaagtaatcaatgcagaaaatgcagcccataaatcagaaaagtttcgagcaatggccactcgaacgaggcaggagtacttgaaagatctggcggagaactttgtcacaaccgccaccgtggatacctctgtgaagttcagcttcattacgctgggtgcgaagaaaaaggagaaggtaaagccaaggaaggatgcccacttgtttagcattggggccatcatgtggcacgtgatagcccgggacttcggccagtctgctgacattgaatgtcttctcgggatctccaatgagttcatcatgttgattgaaaaggattccaagaatgttgtattcaactgttcctgcagggatgtgattgggtggacatctggattagtgagtatcaaagtgttttacgaaagaggagaatgtgtcctcctgtcctcggtagacaactgtgctgaagacatcagggaaattgttcagcgattagtaatagtgacgagaggctgcgagactgtggaaatgaccctgaggaggaacgggctgggccagcttggcttccatgtgaattttgaaggaattgtcgcagatgtggaaccttttggctttgcctggaaggctggccttcgccaagggagccgcctcgtggagatctgcaaagtagccgtggccactctgacccacgagcagatgatcgacctgctccgtacttctgtgactgtgaaggtggtcatcatccagccccatgatgacggctcgccccgaagagggtgttcagagctctgccggatccctatggtggaatataaactcgacagcgagggcaccccctgcgagtataaaacccccttcaggaggaacaccacgtggcaccgggtgcccactcctgccctgcagcccctctctagagcttcccccatccccggcacgcccgaccggctgccgtgccaacagctgctccagcaggcccaggctgccattcctcgaagcacctccttcgaccggaagctgcccgatggcacgagaagctcacccagcaaccagtcatcctccagcgaccctggacccggcgggagcggaccctggagaccacaagtgggctacgacgggtgccagtcccctctactgctcgaacaccagggctcaggccctttggaatgtgacggagccagggagagggaagacaccatggaagcaagcaggcacccggaaaccaaatggcatggcccaccttccaaagtcctgggttcctataaagaaagagctctgcagaaagatggaagttgcaaagattcccccaataagctttctcacattggggataaaagttgctccagtcactccagcagcaacacgctctccagcaacacctccagcaacagtgacgacaagcactttgggtctggcgacctgatggaccccgaattactggggctgacctacatcaaaggggcctccaccgacagtggcatcgacacggccccctgcatgcctgccaccatcctcggccctgtgcacctggcaggcagcaggtccctgatccacagccgggccgagcagtgggctgatgctgccgacgtctctgggcctgacgacgagccagccaagttatattctgtgcatggctacgcgtccaccatctccgccggcagtgctgcggaaggcagcatgggcgatctcagtgagatatcctctcattccagtggttctcaccattcaggaagcccttcagctcactgttcaaaaagtagtgggtctctggattcatccaaagtctacatcgtgtctcacagcagcggacaacaggttcccgggtccatgtccaagccctaccacagacaaggggcagtgaacaaatatgtcatcggctggaagaaatcggagggcagcccaccgcccgaggagcctgaagtgactgaatgtcccgggatgtatagtgagatggatgtcatgtccacagcaactcagcatcagacagtggtgggagatgctgttgcagagactcaacatgttctgtctaaagaagattttctgaaattgatgcttcctgacagccccttagtggaggaggggcgaagaaagttttcgttctatgggaacctgtctccaaggaggtcgctttaccgcacgctgtctgacgagagcatctgcagcaacaggagggggtcctcctttggcagttcccggagttccgtgcttgaccaggccctgcccaacgacattctgttcagcaccaccccaccctaccacagcacgctgcctccgcgggcccaccccgcacccagcatggggagcctgagaaatgagttctggttctccgatgggtccttatcagataagtccaagtgcgcagatcctggcctgatgcccctcccggacacagccacagggttagattggacccacctcgtggatgctgcacgggcatttgaaggtcttgactcagatgaagaactggggctgctctgtcaccacacgtcctatctagaccagagggtggcatccttctgcaccctgacagatatgcagcatgggcaggacctggaaggggcccaagagctgcccttatgtgtagatccaggcagtggcaaagagttcatggacacaactggggagcgttctccatcaccactgaccgggaaagtcaatcagctggaattaattcttcgacaactccagaccgaccttcggaaggaaaaacaagacaaggccgttctccaagcagaagtgcagcacctgagacaggacaacatgagactgcaggaggagtcccagaccgcgacagctcagctgcggaaattcacagaatggtttttcaccaccatcgacaaaaaatcttagccaatccgcacctcatcaagggaccactgggaaatgccccttgtccctttgaagtcacaaacatgtggtttttctgtgtgctttcaaccaatcgtagatgtttttgctgttccattctgtgtagcaccattcaccacagcaggatagggagcctcgactctttctcggtaaccacggcagagagcagcgccgatgtgaagatgaatgaatgtaactcctggtgtgaagatgaatgtaaaccctggcgacagttgagacctttttcttttagactctgctaaaacagtgctctggcttgggcttacctcaagagggaagatagttgagttttatttcctgtatatcaggtgacctggtagagatgtaaagcaatttaccatagtttgggctttagtattgtaaaataaacatgagaacaaataatcagacatatactttaatgttaaaggtgctctatttttttggatgtacagtagttttatttccacagccacattaccatagcaataagaaaggaggcatagtacatagttggaaaagctttgtggggggattaaaaaaaaaaaaaagcactgttgtgtttaacactagttcagatgcagttaccttagagacttatttatttgcaggaacaaatggtgcctgaatattaacagtgttctgattaaaaacaaaaaaaagatacatatgccttgtaaatggctcaccgagtggtcagtagtcacttcaactcttagttcacttttgtatagttgctctgctggaaagaaatgagagtgaatctgcttactcactagaacttccctgtgtgctgtgagccagcggaaccacttgtacaatgccagatttgtttatctttgtacagaagctttgatgaagtgtcttgtatttaacacccttatttaagcttatttaaccttaaattgttaattttataaaatttggtttggcctgcactacgatgagggatggaggtagctgcaggctcagaagagactgagcttgcacagatcagaccgagaagcagggtgagagattctaacgactggatgctgctagtaacacattgtttgtattgctttaccatttttaactgttagatttgagatgaacatacattttgcttttttaataaatgtttaaaagaagtccacataagaaa

SEQ ID NO: 181664 - DNA, 7987 bp, Homo sapiens
  Payload ID: 15779
  Gene Symbol: SIPA1L3
  Gene Name: signal-induced proliferation-associated 1 like 3
  Uniprot ID: O60292
  ENST ID: ENST00000222345
  CDS Start-End: 510-5855
cgcgaagcggcttggaagtgggcagcctggaagtcactcgggccaccggagctggcggcgtctccagcgagcggcgcggagctggacgccgcgatcgtggggcccgcgaggcgggcagccggggcgtccagatgcacagtctctgacatcagctctcctgggaccctccaagagcactagtgtctagaaggcactaaggcatggcgaggacaacatccttgctgcctccagctggcgggcgaccacagctactgcctgctctgcgctactgagccactcggtctggagcccccaggacagcacctgcttcctgaggttgtcctggctcagctgtgcacagcgatggtggagaactggactccacaggctcacaaccttcctgtcaggtttcagggcccagcatccttcatcctgggcctggctgccctgaacaatggctgagggctgggggaccccatagagtgacaccacagcgtacggggccagcagcactccagtgcccgtggactatgaccacctatcgggccatccccagcgatggtgtggacctggcagccagctgtggcgccagggtgggcgatgtcctccctgggccacacacaggggactacgctcccttgggattctgggcccagaatggcagcatgtcccagcctcttggcgagagcccggccaccgccaccgccaccgccaccgccaccacccgccccagccccaccactcccgcaatgcccaagatgggcgtgcgcgcaagggtggccgactggccgcccaagcgggaggccctgagagagcacagcaacccaagcccctcccaggacacagatggcacaaaggccaccaagatggcccattccatgaggagcatacagaacggacagccccccaccagcaccccggcttcctcagggtccaaagccttccaccgactctccaggagaaggtccaaagacgtggagttccaggacgggtggccccggtcccccggcagggccttcctcccccttcggcaccgcagcagcagcgagatcaccctcagcgagtgtgacgcggaggacgcgggggagccgcggggggcccggcacacgggggcgctgcccctcttccgcgagtacgggagcacctcgtccatcgacgtgcagggcatgcccgagcagagcttcttcgacatcctgaacgagttccgcagcgagcagcccgacgcccgagggtgccaggccctcaccgagctcctccgggcagatcctggcccacacctcatggggggcggcggcggagccaagggggactcccacaacgggcagcccgccaaggacagcctcctgccactgcagcccacgaaggagaaggagaaggcccggaagaaacctgcgcggggcctcggcggcggggacacggtggactcgtccatctttcggaagctaaggagcagcaaacccgagggggaggctgggcgttccccgggggaggccgacgagggccggagccccccggaagccagcaggccgtgggtgtgtcagaagagcttcgcccacttcgacgtgcagagcatgctgttcgacctcaacgaggcggccgccaacagggtgtcggtgtcgcagcggcggaacaccaccacgggtgcttcggccgcttccgccgcctcggccatggcctccctcacggcctcgcgggcccacagcctcggaggcctggacccggccttcaccagcacagaggacctaaactgcaaggagaacttggagcaggacctcggcgatgacaacagcaacgacctgctgctcagctgcccgcacttccgcaatgagatcgggggcgagtgtgagcgcaacgtgagcttctcccgggcttccgtgggctccccgagcagcggcgagggccacctggcagagcccgccctgagcgcctaccgcaccaacgccagcatctcggtgttggaagttcccaaggagcagcagcggacgcagagtcggccccggcagtacagcatcgagcatgtggacctgggcgcccgctactaccaggattacttcgtgggcaaagaacatgccaattacttcggcgtggatgagaagctggggccagtggctgtgagcattaagcgggagaagctggaagaccacaaggagcacggacctcagtaccagtacaggatcatcttccggacccgcgagctcatcaccctgcggggctccatcctggaagatgctacgcccacagccaccaagcatgggaccgggcggggcctgcccttgaaggatgccctggagtatgtcatccccgagctcaacatccactgcctgcggctggccctcaacacccccaaggtgacggagcaactgctgaagctcgatgagcaagggctctgccggaagcacaaggtgggcatcctctattgcaaggccggccagagctccgaggaggagatgtacaacaatgaggaggccggccccgcctttgaggagttcctctccctcatcggcgagaaggtctgcctgaagggcttcaccaagtacgctgcccagctggacgtcaagaccgactccacgggaacccactccctctacacgatgtaccaggactacgagatcatgttccatgtctccaccctgctcccttacacccccaacaacaggcagcagctgctacggaagaggcacataggaaatgacatcgtgacgatcatcttccaggagcctggcgcgctaccgttcacccccaagaacatccgctcccacttccagcacgtcttcatcattgtccgagtccacaacccctgcactgataacgtctgttacagtatggctgtgacccgatccaaagacgctcctcctttcggcccccccatccccagtggaaccacattccgcaaatccgacgtcttcagagacttcttgctggccaaggtgattaacgctgagaacgccgcgcacaagtccgacaagttccacaccatggccaccaggacccgccaggagtatctcaaggacctggccgaaaactgtgtctccaacacccccatcgactccaccggcaaattcaacctcatctccctgacctccaagaagaaggaaaagacaaaagcacgggctggcgctgagcagcacagtgcaggggccatcgcctggagggtggtggcccaggactacgcccagggggtggaaatcgactgcattttgggaatttccaatgagtttgtggtgctcctggacttacgcaccaaggaggtggtgttcaactgctactgcggggatgtcattggctggactccagactcctccacactcaaaatcttctatggacgaggagaccacatcttcctacaggcgacagagggttctgtggaggacataagggagatagtgcagagactgaaggtgatgaccagtggctgggagacggtggacatgacgcttcggcggaacgggctcgggcagctgggcttccacgtgaagtacgacggcacggtggccgaggttgaggactatgggttcgcctggcaggccggcctccggcagggcagccgactagtggagatctgcaaggtggccgtggtcacactgacccacgaccagatgatcgacctgctgcgcacctctgtcactgtgaaggtggtcatcatcccgccttttgaggacggcactccccggaggggttggccggagacctacgacatgaatacctcggagcccaagacggagcaggaaagcatcactcctgggggccggcccccctaccgcagcaatgctccctggcagtggagcgggcccgcatcccataactctctaccagcctccaagtgggccactccaaccactcccggccatgcccagtccctgagccggcccctgaagcagacccccatagtccccttccgggagtcccagccactgcacagcaagaggcctgtcagcttcccagaaaccccttacacagtatcaccagcaggggccgacagagtccctccctaccgacagccttctgggagcttctccacccccggttcggccacctacgtgagatacaagccatccccagaaaggtacacggctgccccacaccccctgctatctcttgatccccacttcagccacgatgggacgtccagcggcgactcctcttccggcggcctgaccagccaggagagcaccatggaacgccagaagccagagcctttgtggcatgtgcctgcccaggccaggctctcagccatagccggaagcagcgggaacaagcacccgtccaggcaggatgcagcaggcaaagattcccccaacaggcattccaaaggagaacctcaatactcaagtcattccagcagcaacaccctctccagcaacgcatccagcagccacagcgacgaccgctggttcgaccccctggaccccctggagccagagcaagaccccctctccaagggtggctctagtgacagcggcatcgacaccaccctctacacctccagccctagctgcatgtccctggccaaggctccacggcccgccaagccacacaagccccctggaagtatgggcctttgtggcgggggtcgcgaggccgctgggaggtcccaccacgcagacaggcggcgggaggtctcccctgcccccgcagttgccggccaaagcaagggctaccgaccgaagctgtactcctccggctccagcacccccacgggactggcggggggcagccgagacccaccgaggcagcccagtgacatgggctcgagggttggctaccccgctcaggtttacaaaactgccagtgcagagactcctcggccctcccagctggcccagcccagcccctttcagctctccgcctccgtccccaagtccttcttctccaagcagcctgtacgcaataagcacccaacagggtggaagagaacggaggagcccccaccacggccactccccttcagtgacccaaagaagcaggtggacacgaacaccaaaaatgtctttgggcaaccgaggttgagggcatccctccgagacctccggtcaccacggaagaactacaaatccaccatcgaggatgacctgaagaaactcatcatcatggacaacctggggccagagcaggagagagacacgggacagtcaccgcagaagggcctgcagcggacgctgtcggacgagagcctgtgcagcgggcgccgggagcccagcttcgccagccccgctggcctagagccagggctgcccagcgacgtgctcttcaccagcacctgcgccttcccgtccagcacgctgcctgcacgccgccagcaccagcacccccacccgcccgtcggccccggtgccacccctgccgccggcagcggctttcccgagaagaaatccaccatctcagcctcggagctctcgctggctgatgggcgggaccgccccctgcggcgcctggaccctgggctgatgcccctgcctgacacagctgctggcctcgagtggtccagcctggtgaacgcagccaaggcatacgaagtgcaaagagccgtctcactcttctctctgaacgacccggccctgagcccggacatcccgcctgcacacagtcctgtccacagccacctgagcctggagaggggacccccgacccccaggaccacccctaccatgagcgaggagccacccctggatctgacaggcaaggtgtaccagctggaggtgatgctgaaacagctgcacactgacctgcagaaggagaagcaggacaaggtggtgctccagtcagaggtggccagcctgcggcagaacaaccagcggctgcaggaggagtcgcaggccgccagcgagcagctgcgcaagtttgcggagatcttctgcagggagaagaaggagctctgaggtgggaggccgccgcccgccttcgctccttcccctcaggccgtggccctgctgcctctctccctccactcagctcccagctgccggtgtgaccaagatgacccatccagggccctccccatggacacggaaactccgatggcctcactagggctgtgagtcagggtcagcgcgcacagccctcatgccccagagggcgaagtggtctcaggcctccctccaagctgcccagctgtggtcccggtgagctgggctgtgcttacaccgctcccgggcctgccccgctgtccccatctagcctcttcctgggaccagcccttcgaagctgatggggacggagagaggagccagtctccagacgcctcggctccaggaggtcacacagcaggtttctgcaccacgcacaacaaagttgcggcttgtggggccgaggcccctgcatgaaaagtacagcgtgaaagcaaccctttcttccccacacccagagaggtgaggcccgcgtggacacagaccagggcgcctcggtccctagcacgtgagctccaaaaagcacgaacatgatcccctccctaaccccctcctcccaaaaagcagccaggagcactttcttagagtttaaattattttcttgggggcctgaggatagagagaggcaaggctagcctccagagccgatttatttgagagagaaactctatttggatctccaggacggtttatacgatctttttctatcagctcctcttccgccagaggccactgcacctgggctaggggtccacaggcccctccaccttccagctaaccaggccaggccggggcggtggagccaccacacagccgactctctcctcctcctcccggcacgacctggccctgaccagcagcctcggcctcttctgggttccaggaggggctcccgaagccctcaggacagggctggaggagaacagccttcatctcctcctctggtttttttttcctttgcaagtctcccagcccatctctccgagcagcggccaccagaccccctcaccatgctccccggggagcactgcaccccgcgaaccccactggacgctggttctctaaaggcaataaggggcggccatgccggtgtggtaccacgctgttcctccaggaaaccgtttctttttttccttctttaaaagcaaacagaaaaagatatatatatatatatatatatatttattttttcatgtagagttggcgccagaacaagcctgtatggccacagtctgtggattcatccccccaacctcaagctgaggaccaaggcgtgtcccctgtgggctgggggtcagtgggaggaccagagggatgaagtcagggcaggccggtgccctttttgggaggcaccaggcggggaggagttggcggagcaggtctggctgtgagccagcaccaggcaacccggcccttgtccagggacctctgctgccttctctctggggtcaggaacctcagaggagggggctctggggactgcataggacgcaggcactcggaggtgccggtgtggatgggtgggggtgagagaagagggttcttatcgcgtctcctgtgatcagcctctggccccctggaggaggaaacctcagcgctgcccctgcccccaccctcacccccaacaccaagagtgaggtgggcgtgccccaggcagcgtcctcagccctggccagctactgtgatgccatcttctcccccatccccttctctggggggcccacccgtcccccacccccaccccttagaccctcatcgggtccctttttttttttttttttcagttgtctcctcccatcttcagatcattcgaatcattttggggacttaatcatgtacatggacaagtgtaaattatgatttttggttttgttttctgttattttttaaggatttctgcaaaaacagatctatttaatttgaggttgatgttctatccaatggccgaagatagcagcaggttttttttttcatatgttgatttgtttcatttggattttttttttattattctttattgtcttttttttttccccatccctgtcttgagattttctggcatgtttctggaggtttcaaaggaaataaaggtttcatagaaatgg

SEQ ID NO: 181665 - DNA, 785 bp, Homo sapiens
  Payload ID: 15779
  Gene Symbol: SIPA1L3
  Gene Name: signal-induced proliferation-associated 1 like 3
  ENST ID: ENST00000595384
  CDS Start-End: 1-496
catcctggaagatgctacgcccacagccaccaagcatgggaccgggcggggcctgcccttgaaggatgccctggagtatgtcatccccgagctcaacatccactgcctgcggctggccctcaacacccccaaggtgacggagcaactgctgaagctcgatgagcaagggctctgccggaagcacaaggtgggcatcctctattgcaaggccggccagagctccgaggaggagatgtacaacaatgaggaggccggccccgcctttgaggagttcctctccctcatcggcgagaaggtctgcctgaagggcttcaccaagtacgctgcccagctggacgtcaagatagagacggggtttcaccatgttggccaggctggtctcgaactcctgacctcagatgatccacctgcctcagcctcccaaagtgctgggattataggtgtgaaccaccaggcctggccagtgtatttaatttttaagagtagattgaagtgaaagcaccaagttaaaaaccagcacagatggtacgtgggatatggcaaaaacccagaggttttggaaacatggtcctaactggcatttctgtttcagccgactccacgggaacccactccctctacacgatgtaccaggactacgagatcatgttccatgtctccaccctgctcccttacacccccaacaacaggcagcagctgctacggaagaggcacataggaaatgacatcgtgacgatcatcttccaggagcctggcgcgctaccgttcacccccaagaacatccg

SEQ ID NO: 181666 - DNA, 572 bp, Homo sapiens
  Payload ID: 15779
  Gene Symbol: SIPA1L3
  Gene Name: signal-induced proliferation-associated 1 like 3
  ENST ID: ENST00000601054
  CDS Start-End: 19-572
gcgccaggagtccctgggatgcccttctggggacacagccctgaaagtgacatgggctcgagggttggctaccccgctcaggtttacaaaactgccagtgcagagactcctcggccctcccagctggcccagcccagcccctttcagctctccgcctccgtccccaagtccttcttctccaagcagcctgtacgcaataagcacccaacagggtggaagagaacggaggagcccccaccacggccactccccttcagtgacccaaagaagcaggtggacacgaacaccaaaaatgtctttgggcaaccgaggttgagggcatccctccgagacctccggtcaccacggaagaactacaaatccaccatcgaggatgacctgaagaaactcatcatcatggacaacctggggccagagcaggagagagacacgggatcaccgcagaagggcctgcagcggacgctgtcggacgagagcctgtgcagcgggcgccgggagcccagcttcgccagccccgctggcctagagccagggctgcccagcgacgtgctcttcaccagcacctgcgcctt

SEQ ID NO: 181667 - DNA, 883 bp, Homo sapiens
  Payload ID: 15780
  Gene Symbol: SLAMF1
  Gene Name: signaling lymphocytic activation molecule family member 1
  ENST ID: ENST00000235739
  CDS Start-End: 351-785
ggagacagctaaggaaagaagctggggcgcatgtttctgcccaaagccgggttttggccgaggtgactacacaccccctttcctggctcccataggctaagtgcctggcttcttgagaagcctgcttcttgagaacaaaaaagtgatttaaagcctcatgggagatgagcaatcctcaagacacaagcagaaaaagtcccagtgatacaggaagcgggttcaggaacctgctggttcctgatacataaatcagacagcctctgctgcatgacacgaagcttgcttctgcctggcatctgtgagcagctgccaggctccggccaggatcccttccttctcctcattggctgatggatcccaaggggctcctctccttgaccttcgtgctgtttctctccctggcttttggggcaagctacggaacaggtgggcgcatgatgaactgcccaaagattctccggcagttgggaagcaaagtgctgctgcccctgacatatgaaaggataaataagagcatgaacaaaagcatccacattgtcgtcacaatggcaaaatcactggagaacagtgtcgagaacaaaatagtgtctcttgatccatccgaagcaggccctccacgttatctaggagatcgctacaagttttatctggagaatctcaccctggggatacgggaaagcaggaaggaggatgagggatggtaccttatgaccctggagaaaagtttacattttggctatctttactttgttctgggagctgatcatgataacctgcagacctgatcaagcctctgtgcctcagtttctctctcaggataaagagtgaatagaggctgaagggtgaatttcttattatacataaaacactctgatattattgt

SEQ ID NO: 181668 - DNA, 4006 bp, Homo sapiens
  Payload ID: 15780
  Gene Symbol: SLAMF1
  Gene Name: signaling lymphocytic activation molecule family member 1
  Uniprot ID: Q13291
  ENST ID: ENST00000302035
  CDS Start-End: 351-1358
ggagacagctaaggaaagaagctggggcgcatgtttctgcccaaagccgggttttggccgaggtgactacacaccccctttcctggctcccataggctaagtgcctggcttcttgagaagcctgcttcttgagaacaaaaaagtgatttaaagcctcatgggagatgagcaatcctcaagacacaagcagaaaaagtcccagtgatacaggaagcgggttcaggaacctgctggttcctgatacataaatcagacagcctctgctgcatgacacgaagcttgcttctgcctggcatctgtgagcagctgccaggctccggccaggatcccttccttctcctcattggctgatggatcccaaggggctcctctccttgaccttcgtgctgtttctctccctggcttttggggcaagctacggaacaggtgggcgcatgatgaactgcccaaagattctccggcagttgggaagcaaagtgctgctgcccctgacatatgaaaggataaataagagcatgaacaaaagcatccacattgtcgtcacaatggcaaaatcactggagaacagtgtcgagaacaaaatagtgtctcttgatccatccgaagcaggccctccacgttatctaggagatcgctacaagttttatctggagaatctcaccctggggatacgggaaagcaggaaggaggatgagggatggtaccttatgaccctggagaaaaatgtttcagttcagcgcttttgcctgcagttgaggctttatgagcaggtctccactccagaaattaaagttttaaacaagacccaggagaacgggacctgcaccttgatactgggctgcacagtggagaagggggaccatgtggcttacagctggagtgaaaaggcgggcacccacccactgaacccagccaacagctcccacctcctgtccctcaccctcggcccccagcatgctgacaatatctacatctgcaccgtgagcaaccctatcagcaacaattcccagaccttcagcccgtggcccggatgcaggacagacccctcagaaacaaaaccatgggcagtgtatgctgggctgttagggggtgtcatcatgattctcatcatggtggtaatactacagttgagaagaagaggtaaaacgaaccattaccagacaacagtggaaaaaaaaagccttacgatctatgcccaagtccagaaaccaggtcctcttcagaagaaacttgactccttcccagctcaggacccttgcaccaccatatatgttgctgccacagagcctgtcccagagtctgtccaggaaacaaattccatcacagtctatgctagtgtgacacttccagagagctgacaccagagaccaacaaagggactttctgaaggaaaatggaaaaaccaaaatgaacactgaacttggccacaggccccaagtttcctctggcagacatgctgcacgtctgtacccttctcagatcaactccctggtgatgtttcttccacatacatctgtgaaatgaacaaggaagtgaggcttcccaagaatttagcttgctgtgcagtggctgcaggcgcagaacagagcgttacttgataacagcgttccatctttgtgttgtagcagatgaaatggacagtaatgtgagttcagactttgggcatcttgctcttggctggaactggataataaaaatcagactgaaagccaggacatctgagtacctatctcacacactggaccaccagtcacaaagtctggaaaagtttacattttggctatctttactttgttctgggagctgatcatgataacctgcagacctgatcaagcctctgtgcctcagtttctctctcaggataaagagtgaatagaggctgaagggtgaatttcttattatacataaaacactctgatattattgtataaaggaagctaagaatattattttatttgcaaaacccagaagctaaaaagtcaataaacagaaagaatgattttgagatctctgagttttgaacagtggactggaaaccatgtaagagccttaaaagtacagttctgtgcaaatggcattcagttttaaagaaaaacgtagcaaatgtttgatggtgctgttacaaaggagcttggaatactcagaggaacttgtcccatggtgatttttcacttctcaaaatgatgtttaaatcccagttctctgttgattcccttgaacaacaaacctggaacctcagctaagactctctgtgaccagattctgaacctcttatatccagggcttcaaggggtattgcaggtcaaggtctttcctaggcactttctactccctgcatacctctcctcacactaaatttatcctctagtagaaaattaagttattttggtctaacagcttcaaatctttgaatgctcaataacttattttgcaagctgcaggcagaaagagactttttaagtaaagtcctttgttttttcctattctctgcttttagacaggctgtcctcaatttaagccctgctttttcttattgtttcttatataaacttggtaagtactgtaagaaacagccactatcataccattgcataataaggagcaccaacttcccagctcaaaactcaggtccttattgccttgtatcttacctcctctatgaggtcaattcacattgtaagcctgttgcttagtgcatctcgtttcctggtaccagcttctttaatagagttcttagttgcaatcaacagaagctggctttggcttttttatgtagaaaaggaacctattgaaaagatactgattggttccaataactgctagaagtttctgcaaaaccatgctttgaaagtgagcaggaaaagaagagactaggctgtggctgggagcacagccaaaattacaaaaccagcccagggatgatgatcctgttcatgcacagccactgtccccagcactaggcacagactctaccactgcctcactgtctctgctggacttggaaacttgatattactgttactgctgcactgtctgccatgaaaatgaattctccagggtcccttcttcatcctttcatctctagcttataattcaaagtctgggattgagtggccaatcctaggtcacatgtccatgtcctatctccaaggggggctgggaattgaatatctggcattttccactttcacttcttatgaattaaggaattctacaaataatagaagtgggattcaggtggtaggcagacaaaaaagcctcacaattatccactacgccacccttgtataaccttaccctcattcactgtctactctcaaaactgtggagctactaatgaagatttgtaaacccgggcttatgagcacccattcctttactacaactcagattgctctagaagctcagttcccagcacttggatttttccagtagctgaattctacctgaaggaagggcagaaacaaagggtgaagaagaggctatcacttccaagtatcctgcacccctgggctcaagacctcactggggagggagtcttttgggccacccaccaaacagcactggcattatgcctctcaccctagaccatggttacacgtggtaaaacaaccccttctggtgatacattcacaactctctagtttcccccaaatggcactatggggagcgggagcttgccttttcctcagacttaaaacaataagttttccccgtgtttcccctctaatgctgttttcttttgaccaagcatgtctgaattctagagaagtcaggaggaacacacccattctcggtttgaagggactgatgttctgaagtacaactgggcacagtcccaggctcttcaggacgcttcctccattcacacagcggggatgtgattgttacagcgggtggtgtgtgctggctgagaagccactgtgaattgattcttcttctgaagtttatgtttctactttttggaaatgaataaattacagccagtccatcaaggaaattgcaa

SEQ ID NO: 181669 - DNA, 1087 bp, Homo sapiens
  Payload ID: 15780
  Gene Symbol: SLAMF1
  Gene Name: signaling lymphocytic activation molecule family member 1
  ENST ID: ENST00000538290
  CDS Start-End: 14-1087
tcctcattggctgatggatcccaaggggctcctctccttgaccttcgtgctgtttctctccctggcttttggggcaagctacggaacaggtgggcgcatgatgaactgcccaaagattctccggcagttgggaagcaaagtgctgctgcccctgacatatgaaaggataaataagagcatgaacaaaagcatccacattgtcgtcacaatggcaaaatcactggagaacagtgtcgagaacaaaatagtgtctcttgatccatccgaagcaggccctccacgttatctaggagatcgctacaagttttatctggagaatctcaccctggggatacgggaaagcaggaaggaggatgagggatggtaccttatgaccctggagaaaaatgtttcagttcagcgcttttgcctgcagttgaggctttatgagcaggtctccactccagaaattaaagttttaaacaagacccaggagaacgggacctgcaccttgatactgggctgcacagtggagaagggggaccatgtggcttacagctggagtgaaaaggcgggcacccacccactgaacccagccaacagctcccacctcctgtccctcaccctcggcccccagcatgctgacaatatctacatctgcaccgtgagcaaccctatcagcaacaattcccagaccttcagcccgtggcccggatgcaggacagacccctcagaaacaaaaccatgggcagtgtatgctgggctgttagggggtgtcatcatgattctcatcatggtggtaatactacagttgagaagaagagccaccttgactactaccaaccaatactggagtcaaaatgtcctgacccaagaccaggagagatgccccggctgccttcccatggtaaaacgaaccattaccagacaacagtggaaaaaaaaagccttacgatctatgcccaagtccagaaaccaggtcctcttcagaagaaacttgactccttcccagctcaggacccttgcaccaccatatatgttgctgccacagagcctgtcccagagtctgtccaggaaacaaattccatcacagtctatgctagtgtga

SEQ ID NO: 181670 - DNA, 1231 bp, Homo sapiens
  Payload ID: 15781
  Gene Symbol: SIT1
  Gene Name: signaling threshold regulating transmembrane adaptor 1
  Uniprot ID: Q9Y3P8
  ENST ID: ENST00000259608
  CDS Start-End: 88-678
gccaccaccagtattggggatgctgagctgcggggtacgggcctgaggagggatgggagtaagaagtgctgtggaaaccgtcaggccatgaaccaggctgaccctcggctcagagcagtgtgcttgtggactctcacatctgcagccatgagcagaggcgacaactgcacggatctactcgcactgggaatcccctccataacccaggcctggggactgtgggtcctcttaggggctgtgacgctgctatttctcatctcgctggctgcacacttgtcccagtggaccaggggccggagcaggagccatccggggcagggacgctctggagagtctgtggaagaggtcccgctgtatgggaacctgcattatctacagacaggacggctgtctcaagacccagagccagaccagcaggatccaactcttggaggccctgccagggctgcagaggaggtgatgtgctataccagcctgcagctgcggcctcctcagggtcggatccccggtcctggaacccccgtcaagtactcggaggtggtgctggactctgagccaaagtcccaggcctcgggccccgagccggagctctatgcctcagtatgtgcccagacccgcagggcccgggcctccttcccggatcaggcctatgccaacagccagcctgcagccagctgagatggagggcctggcacagcggggcgtgcactgccccagccccccgtagcaggggcatgactgtttcccaaccagcacccaaagacgggcgccattgccaagtcacaggatgtgatctaccccggacttcctatctgagcttcaagggagacatctcagggcaaagctttcgtgatggaggaggcaaagacagtagccccctccttatttcttttttctatctgttcctcttagcccccaaactcccaggttctcacttccttcttctggagtttaaccagatcctccccacccccgctccctcatagtctacccccacgcctcagtgtctcctcaggcacaggaagtgggcggtgggggaggggtaagggcctgacagtgggtgggtgggtatattcctcaggagtccacagactggagtggacctggaacttagagacgggagggacccgagcctggcttttgacctaagaaccctagcaggagaatacagtctccatcctgctgtctctgtcctgtccccaagttttcaaataaaactttccaaaaagtg

SEQ ID NO: 181671 - DNA, 1317 bp, Homo sapiens
  Payload ID: 15781
  Gene Symbol: SIT1
  Gene Name: signaling threshold regulating transmembrane adaptor 1
  ENST ID: ENST00000618781
  CDS Start-End: 98-772
cagagactttgccaccaccagtattggggatgctgagctgcggggtacgggcctgaggagggatgggagtaagaagtgctgtggaaaccgtcaggccatgaaccaggctgaccctcggctcagagcagtgtgcttgtggactctcacatctgcagccatgagcagaggcgacaactgcacggatctactcgcactgggaatcccctccataacccaggcctggggactgtgggtcctcttaggggctgtgacgctgctatttctcatctcgctggctgcacacttgtcccagtggaccaggggccggagcaggagccatccggggcagggacggtgggtgaaggacaacagggatgggttgactgagagttctctcttaccgagaagtccccactcatcccctaaactctgcgttgcatctggagagtctgtggaagaggtcccgctgtatgggaacctgcattatctacagacaggacggctgtctcaagacccagagccagaccagcaggatccaactcttggaggccctgccagggctgcagaggaggtgatgtgctataccagcctgcagctgcggcctcctcagggtcggatccccggtcctggaacccccgtcaagtactcggaggtggtgctggactctgagccaaagtcccaggcctcgggccccgagccggagctctatgcctcagtatgtgcccagacccgcagggcccgggcctccttcccggatcaggcctatgccaacagccagcctgcagccagctgagatggagggcctggcacagcggggcgtgcactgccccagccccccgtagcaggggcatgactgtttcccaaccagcacccaaagacgggcgccattgccaagtcacaggatgtgatctaccccggacttcctatctgagcttcaagggagacatctcagggcaaagctttcgtgatggaggaggcaaagacagtagccccctccttatttcttttttctatctgttcctcttagcccccaaactcccaggttctcacttccttcttctggagtttaaccagatcctccccacccccgctccctcatagtctacccccacgcctcagtgtctcctcaggcacaggaagtgggcggtgggggaggggtaagggcctgacagtgggtgggtgggtatattcctcaggagtccacagactggagtggacctggaacttagagacgggagggacccgagcctggcttttgacctaagaaccctagcaggagaatacagtctccatcctgctgtctctgtcctgtccccaagttttcaaataaaactttcc

SEQ ID NO: 181672 - DNA, 3867 bp, Homo sapiens
  Payload ID: 15782
  Gene Symbol: SIRPA
  Gene Name: signal-regulatory protein alpha
  Uniprot ID: P78324
  ENST ID: ENST00000356025
  CDS Start-End: 24-1538
cgctcgcagagaagccgcggcccatggagcccgccggcccggcccccggccgcctcgggccgctgctctgcctgctgctcgccgcgtcctgcgcctggtcaggagtggcgggtgaggaggagctgcaggtgattcagcctgacaagtccgtgttggttgcagctggagagacagccactctgcgctgcactgcgacctctctgatccctgtggggcccatccagtggttcagaggagctggaccaggccgggaattaatctacaatcaaaaagaaggccacttcccccgggtaacaactgtttcagacctcacaaagagaaacaacatggacttttccatccgcatcggtaacatcaccccagcagatgccggcacctactactgtgtgaagttccggaaagggagccccgatgacgtggagtttaagtctggagcaggcactgagctgtctgtgcgcgccaaaccctctgcccccgtggtatcgggccctgcggcgagggccacacctcagcacacagtgagcttcacctgcgagtcccacggcttctcacccagagacatcaccctgaaatggttcaaaaatgggaatgagctctcagacttccagaccaacgtggaccccgtaggagagagcgtgtcctacagcatccacagcacagccaaggtggtgctgacccgcgaggacgttcactctcaagtcatctgcgaggtggcccacgtcaccttgcagggggaccctcttcgtgggactgccaacttgtctgagaccatccgagttccacccaccttggaggttactcaacagcccgtgagggcagagaaccaggtgaatgtcacctgccaggtgaggaagttctacccccagagactacagctgacctggttggagaatggaaacgtgtcccggacagaaacggcctcaaccgttacagagaacaaggatggtacctacaactggatgagctggctcctggtgaatgtatctgcccacagggatgatgtgaagctcacctgccaggtggagcatgacgggcagccagcggtcagcaaaagccatgacctgaaggtctcagcccacccgaaggagcagggctcaaataccgccgctgagaacactggatctaatgaacggaacatctatattgtggtgggtgtggtgtgcaccttgctggtggccctactgatggcggccctctacctcgtccgaatcagacagaagaaagcccagggctccacttcttctacaaggttgcatgagcccgagaagaatgccagagaaataacacaggacacaaatgatatcacatatgcagacctgaacctgcccaaggggaagaagcctgctccccaggctgcggagcccaacaaccacacggagtatgccagcattcagaccagcccgcagcccgcgtcggaggacaccctcacctatgctgacctggacatggtccacctcaaccggacccccaagcagccggcccccaagcctgagccgtccttctcagagtacgccagcgtccaggtcccgaggaagtgaatgggaccgtggtttgctctagcacccatctctacgcgctttcttgtcccacagggagccgccgtgatgagcacagccaacccagttcccggagggctggggcggtgcaggctctgggacccaggggccagggtggctcttctctccccacccctccttggctctccagcacttcctgggcagccacggccccctccccccacattgccacatacctggaggctgacgttgccaaaccagccagggaaccaacctgggaagtggccagaactgcctggggtccaagaactcttgtgcctccgtccatcaccatgtgggttttgaagaccctcgactgcctccccgatgctccgaagcctgatcttccagggtggggaggagaaaatcccacctcccctgacctccaccacctccaccaccaccaccaccaccaccaccaccactaccaccaccacccaactggggctagagtggggaagatttcccctttagatcaaactgccccttccatggaaaagctggaaaaaaactctggaacccatatccaggcttggtgaggttgctgccaacagtcctggcctcccccatccctaggctaaagagccatgagtcctggaggaggagaggacccctcccaaaggactggagacaaaaccctctgcttccttgggtccctccaagactccctggggcccaactgtgttgctccacccggacccatctctcccttctagacctgagcttgcccctccagctagcactaagcaacatctcgctgtggacgcctgtaaattactgagaaatgtgaaacgtgcaatcttgaaactgaggtgttagaaaacttgatctgtggtgttttgttttgttttttttcttaaaacaacagcaacgtgatcttggctgtctgtcatgtgttgaagtccatggttgggtcttgtgaagtctgaggtttaacagtttgttgtcctggagggattttcttacagcgaagacttgagttcctccaagtcccagaaccccaagaatgggcaagaaggatcaggtcagccactccctggagacacagccttctggctgggactgacttggccatgttctcagctgagccacgcggctggtagtgcagccttctgtgaccccgctgtggtaagtccagcctgcccagggctgctgagggctgcctcttgacagtgcagtcttatcgagacccaatgcctcagtctgctcatccgtaaagtggggatagtgaagatgacacccctccccaccacctctcataagcactttaggaacacacagagggtagggatagtggccctggccgtctatcctacccctttagtgaccgcccccatcccggctttctgagctgatccttgaagaagaaatcttccatttctgctctcaaaccctactgggatcaaactggaataaattgaagacagccagggggatggtgcagctgtgaagctcgggctgattccccctctgtcccagaaggttggccagagggtgtgacccagttaccctttaacccccacccttccagtcgggtgtgagggcctgaccgggcccagggcaagcagatgtcgcaagccctatttattcagtcttcactataactcttagagttgagacgctaatgttcatgactcctggccttgggatgcccaagggatttctggctcaggctgtaaaagtagctgagccatcctgcccattcctggaggtcctacaggtgaaactgcaggagctcagcatagacccagctctctgggggatggtcacctggtgatttcaatgatggcatccaggaattagctgagccaacagaccatgtggacagctttggccagagctcccgtgtggcatctgggagccacagtgacccagccacctggctcaggctagttccaaattccaaaagattggcttgtaaaccttcgtctccctctcttttacccagagacagcacatacgtgtgcacacgcatgcacacacacattcagtattttaaaagaatgttttcttggtgccattttcattttattttattttttaattcttggagggggaaataagggaataaggccaaggaagatgtatagctttagctttagcctggcaacctggagaatccacataccttgtgtattgaaccccaggaaaaggaagaggtcgaaccaaccctgcggaaggagcatggtttcaggagtttattttaagactgctgggaaggaaacaggccccattttgtatatagttgcaacttaaactttttggcttgcaaaatatttttgtaataaagatttctgggtaataatgagtc

SEQ ID NO: 181673 - DNA, 3996 bp, Homo sapiens
  Payload ID: 15782
  Gene Symbol: SIRPA
  Gene Name: signal-regulatory protein alpha
  Uniprot ID: P78324
  ENST ID: ENST00000358771
  CDS Start-End: 153-1667
gcggccgctccaggcgcccgttccggagtcggggggaggcccagccgggaggggggaagggggggagccttagtcatttccccgctccagcctgctcccgcccgagcgcgcactcacggccgctctccctcctcgctccgcagccgcggcccatggagcccgccggcccggcccccggccgcctcgggccgctgctctgcctgctgctcgccgcgtcctgcgcctggtcaggagtggcgggtgaggaggagctgcaggtgattcagcctgacaagtccgtgttggttgcagctggagagacagccactctgcgctgcactgcgacctctctgatccctgtggggcccatccagtggttcagaggagctggaccaggccgggaattaatctacaatcaaaaagaaggccacttcccccgggtaacaactgtttcagacctcacaaagagaaacaacatggacttttccatccgcatcggtaacatcaccccagcagatgccggcacctactactgtgtgaagttccggaaagggagccccgatgacgtggagtttaagtctggagcaggcactgagctgtctgtgcgcgccaaaccctctgcccccgtggtatcgggccctgcggcgagggccacacctcagcacacagtgagcttcacctgcgagtcccacggcttctcacccagagacatcaccctgaaatggttcaaaaatgggaatgagctctcagacttccagaccaacgtggaccccgtaggagagagcgtgtcctacagcatccacagcacagccaaggtggtgctgacccgcgaggacgttcactctcaagtcatctgcgaggtggcccacgtcaccttgcagggggaccctcttcgtgggactgccaacttgtctgagaccatccgagttccacccaccttggaggttactcaacagcccgtgagggcagagaaccaggtgaatgtcacctgccaggtgaggaagttctacccccagagactacagctgacctggttggagaatggaaacgtgtcccggacagaaacggcctcaaccgttacagagaacaaggatggtacctacaactggatgagctggctcctggtgaatgtatctgcccacagggatgatgtgaagctcacctgccaggtggagcatgacgggcagccagcggtcagcaaaagccatgacctgaaggtctcagcccacccgaaggagcagggctcaaataccgccgctgagaacactggatctaatgaacggaacatctatattgtggtgggtgtggtgtgcaccttgctggtggccctactgatggcggccctctacctcgtccgaatcagacagaagaaagcccagggctccacttcttctacaaggttgcatgagcccgagaagaatgccagagaaataacacaggacacaaatgatatcacatatgcagacctgaacctgcccaaggggaagaagcctgctccccaggctgcggagcccaacaaccacacggagtatgccagcattcagaccagcccgcagcccgcgtcggaggacaccctcacctatgctgacctggacatggtccacctcaaccggacccccaagcagccggcccccaagcctgagccgtccttctcagagtacgccagcgtccaggtcccgaggaagtgaatgggaccgtggtttgctctagcacccatctctacgcgctttcttgtcccacagggagccgccgtgatgagcacagccaacccagttcccggagggctggggcggtgcaggctctgggacccaggggccagggtggctcttctctccccacccctccttggctctccagcacttcctgggcagccacggccccctccccccacattgccacatacctggaggctgacgttgccaaaccagccagggaaccaacctgggaagtggccagaactgcctggggtccaagaactcttgtgcctccgtccatcaccatgtgggttttgaagaccctcgactgcctccccgatgctccgaagcctgatcttccagggtggggaggagaaaatcccacctcccctgacctccaccacctccaccaccaccaccaccaccaccaccaccactaccaccaccacccaactggggctagagtggggaagatttcccctttagatcaaactgccccttccatggaaaagctggaaaaaaactctggaacccatatccaggcttggtgaggttgctgccaacagtcctggcctcccccatccctaggctaaagagccatgagtcctggaggaggagaggacccctcccaaaggactggagacaaaaccctctgcttccttgggtccctccaagactccctggggcccaactgtgttgctccacccggacccatctctcccttctagacctgagcttgcccctccagctagcactaagcaacatctcgctgtggacgcctgtaaattactgagaaatgtgaaacgtgcaatcttgaaactgaggtgttagaaaacttgatctgtggtgttttgttttgttttttttcttaaaacaacagcaacgtgatcttggctgtctgtcatgtgttgaagtccatggttgggtcttgtgaagtctgaggtttaacagtttgttgtcctggagggattttcttacagcgaagacttgagttcctccaagtcccagaaccccaagaatgggcaagaaggatcaggtcagccactccctggagacacagccttctggctgggactgacttggccatgttctcagctgagccacgcggctggtagtgcagccttctgtgaccccgctgtggtaagtccagcctgcccagggctgctgagggctgcctcttgacagtgcagtcttatcgagacccaatgcctcagtctgctcatccgtaaagtggggatagtgaagatgacacccctccccaccacctctcataagcactttaggaacacacagagggtagggatagtggccctggccgtctatcctacccctttagtgaccgcccccatcccggctttctgagctgatccttgaagaagaaatcttccatttctgctctcaaaccctactgggatcaaactggaataaattgaagacagccagggggatggtgcagctgtgaagctcgggctgattccccctctgtcccagaaggttggccagagggtgtgacccagttaccctttaacccccacccttccagtcgggtgtgagggcctgaccgggcccagggcaagcagatgtcgcaagccctatttattcagtcttcactataactcttagagttgagacgctaatgttcatgactcctggccttgggatgcccaagggatttctggctcaggctgtaaaagtagctgagccatcctgcccattcctggaggtcctacaggtgaaactgcaggagctcagcatagacccagctctctgggggatggtcacctggtgatttcaatgatggcatccaggaattagctgagccaacagaccatgtggacagctttggccagagctcccgtgtggcatctgggagccacagtgacccagccacctggctcaggctagttccaaattccaaaagattggcttgtaaaccttcgtctccctctcttttacccagagacagcacatacgtgtgcacacgcatgcacacacacattcagtattttaaaagaatgttttcttggtgccattttcattttattttattttttaattcttggagggggaaataagggaataaggccaaggaagatgtatagctttagctttagcctggcaacctggagaatccacataccttgtgtattgaaccccaggaaaaggaagaggtcgaaccaaccctgcggaaggagcatggtttcaggagtttattttaagactgctgggaaggaaacaggccccattttgtatatagttgcaacttaaactttttggcttgcaaaatatttttgtaataaagatttctgggtaataatgagtc

SEQ ID NO: 181674 - DNA, 4201 bp, Homo sapiens
  Payload ID: 15782
  Gene Symbol: SIRPA
  Gene Name: signal-regulatory protein alpha
  Uniprot ID: P78324
  ENST ID: ENST00000400068
  CDS Start-End: 361-1875
tccggcccgcacccacccccaagaggggccttcagctttggggctcagaggcacgacctcctggggagggttaaaaggcagacgcccccccgccccccgcgcccccgcgccccgactccttcgccgcctccagcctctcgccagtgggaagcggggagcagccgcgcggccggagtccggaggcgaggggaggtcggccgcaacttccccggtccaccttaagaggacgatgtagccagctcgcagcgctgaccttagaaaaacaagtttgcgcaaagtggagcggggacccggcctctgggcagccccggcggcgcttccagtgccttccagccctcgcgggcggcgcagccgcggcccatggagcccgccggcccggcccccggccgcctcgggccgctgctctgcctgctgctcgccgcgtcctgcgcctggtcaggagtggcgggtgaggaggagctgcaggtgattcagcctgacaagtccgtgttggttgcagctggagagacagccactctgcgctgcactgcgacctctctgatccctgtggggcccatccagtggttcagaggagctggaccaggccgggaattaatctacaatcaaaaagaaggccacttcccccgggtaacaactgtttcagacctcacaaagagaaacaacatggacttttccatccgcatcggtaacatcaccccagcagatgccggcacctactactgtgtgaagttccggaaagggagccccgatgacgtggagtttaagtctggagcaggcactgagctgtctgtgcgcgccaaaccctctgcccccgtggtatcgggccctgcggcgagggccacacctcagcacacagtgagcttcacctgcgagtcccacggcttctcacccagagacatcaccctgaaatggttcaaaaatgggaatgagctctcagacttccagaccaacgtggaccccgtaggagagagcgtgtcctacagcatccacagcacagccaaggtggtgctgacccgcgaggacgttcactctcaagtcatctgcgaggtggcccacgtcaccttgcagggggaccctcttcgtgggactgccaacttgtctgagaccatccgagttccacccaccttggaggttactcaacagcccgtgagggcagagaaccaggtgaatgtcacctgccaggtgaggaagttctacccccagagactacagctgacctggttggagaatggaaacgtgtcccggacagaaacggcctcaaccgttacagagaacaaggatggtacctacaactggatgagctggctcctggtgaatgtatctgcccacagggatgatgtgaagctcacctgccaggtggagcatgacgggcagccagcggtcagcaaaagccatgacctgaaggtctcagcccacccgaaggagcagggctcaaataccgccgctgagaacactggatctaatgaacggaacatctatattgtggtgggtgtggtgtgcaccttgctggtggccctactgatggcggccctctacctcgtccgaatcagacagaagaaagcccagggctccacttcttctacaaggttgcatgagcccgagaagaatgccagagaaataacacaggacacaaatgatatcacatatgcagacctgaacctgcccaaggggaagaagcctgctccccaggctgcggagcccaacaaccacacggagtatgccagcattcagaccagcccgcagcccgcgtcggaggacaccctcacctatgctgacctggacatggtccacctcaaccggacccccaagcagccggcccccaagcctgagccgtccttctcagagtacgccagcgtccaggtcccgaggaagtgaatgggaccgtggtttgctctagcacccatctctacgcgctttcttgtcccacagggagccgccgtgatgagcacagccaacccagttcccggagggctggggcggtgcaggctctgggacccaggggccagggtggctcttctctccccacccctccttggctctccagcacttcctgggcagccacggccccctccccccacattgccacatacctggaggctgacgttgccaaaccagccagggaaccaacctgggaagtggccagaactgcctggggtccaagaactcttgtgcctccgtccatcaccatgtgggttttgaagaccctcgactgcctccccgatgctccgaagcctgatcttccagggtggggaggagaaaatcccacctcccctgacctccaccacctccaccaccaccaccaccaccaccaccaccactaccaccaccacccaactggggctagagtggggaagatttcccctttagatcaaactgccccttccatggaaaagctggaaaaaaactctggaacccatatccaggcttggtgaggttgctgccaacagtcctggcctcccccatccctaggctaaagagccatgagtcctggaggaggagaggacccctcccaaaggactggagacaaaaccctctgcttccttgggtccctccaagactccctggggcccaactgtgttgctccacccggacccatctctcccttctagacctgagcttgcccctccagctagcactaagcaacatctcgctgtggacgcctgtaaattactgagaaatgtgaaacgtgcaatcttgaaactgaggtgttagaaaacttgatctgtggtgttttgttttgttttttttcttaaaacaacagcaacgtgatcttggctgtctgtcatgtgttgaagtccatggttgggtcttgtgaagtctgaggtttaacagtttgttgtcctggagggattttcttacagcgaagacttgagttcctccaagtcccagaaccccaagaatgggcaagaaggatcaggtcagccactccctggagacacagccttctggctgggactgacttggccatgttctcagctgagccacgcggctggtagtgcagccttctgtgaccccgctgtggtaagtccagcctgcccagggctgctgagggctgcctcttgacagtgcagtcttatcgagacccaatgcctcagtctgctcatccgtaaagtggggatagtgaagatgacacccctccccaccacctctcataagcactttaggaacacacagagggtagggatagtggccctggccgtctatcctacccctttagtgaccgcccccatcccggctttctgagctgatccttgaagaagaaatcttccatttctgctctcaaaccctactgggatcaaactggaataaattgaagacagccagggggatggtgcagctgtgaagctcgggctgattccccctctgtcccagaaggttggccagagggtgtgacccagttaccctttaacccccacccttccagtcgggtgtgagggcctgaccgggcccagggcaagcagatgtcgcaagccctatttattcagtcttcactataactcttagagttgagacgctaatgttcatgactcctggccttgggatgcccaagggatttctggctcaggctgtaaaagtagctgagccatcctgcccattcctggaggtcctacaggtgaaactgcaggagctcagcatagacccagctctctgggggatggtcacctggtgatttcaatgatggcatccaggaattagctgagccaacagaccatgtggacagctttggccagagctcccgtgtggcatctgggagccacagtgacccagccacctggctcaggctagttccaaattccaaaagattggcttgtaaaccttcgtctccctctcttttacccagagacagcacatacgtgtgcacacgcatgcacacacacattcagtattttaaaagaatgttttcttggtgccattttcattttattttattttttaattcttggagggggaaataagggaataaggccaaggaagatgtatagctttagctttagcctggcaacctggagaatccacataccttgtgtattgaaccccaggaaaaggaagaggtcgaaccaaccctgcggaaggagcatggtttcaggagtttattttaagactgctgggaaggaaacaggccccattttgtatatagttgcaacttaaactttttggcttgcaaaatatttttgtaataaagatttctgggtaataatga

SEQ ID NO: 181675 - DNA, 4570 bp, Homo sapiens
  Payload ID: 15782
  Gene Symbol: SIRPA
  Gene Name: signal-regulatory protein alpha
  Uniprot ID: P78324
  ENST ID: ENST00000622179
  CDS Start-End: 20-1546
ggcggcgcagccgcggcccatggagcccgccggcccggcccccggccgcctcgggccgctgctctgcctgctgctcgccgcgtcctgcgcctggtcaggagtggcgggtgaggaggagctgcaggtgattcagcctgacaagtccgtgttggttgcagctggagagacagccactctgcgctgcactgcgacctctctgatccctgtggggcccatccagtggttcagaggagctggaccaggccgggaattaatctacaatcaaaaagaaggccacttcccccgggtaacaactgtttcagacctcacaaagagaaacaacatggacttttccatccgcatcggtaacatcaccccagcagatgccggcacctactactgtgtgaagttccggaaagggagccccgatgacgtggagtttaagtctggagcaggcactgagctgtctgtgcgcgccaaaccctctgcccccgtggtatcgggccctgcggcgagggccacacctcagcacacagtgagcttcacctgcgagtcccacggcttctcacccagagacatcaccctgaaatggttcaaaaatgggaatgagctctcagacttccagaccaacgtggaccccgtaggagagagcgtgtcctacagcatccacagcacagccaaggtggtgctgacccgcgaggacgttcactctcaagtcatctgcgaggtggcccacgtcaccttgcagggggaccctcttcgtgggactgccaacttgtctgagaccatccgagttccacccaccttggaggttactcaacagcccgtgagggcagagaaccaggtgaatgtcacctgccaggtgaggaagttctacccccagagactacagctgacctggttggagaatggaaacgtgtcccggacagaaacggcctcaaccgttacagagaacaaggatggtacctacaactggatgagctggctcctggtgaatgtatctgcccacagggatgatgtgaagctcacctgccaggtggagcatgacgggcagccagcggtcagcaaaagccatgacctgaaggtctcagcccacccgaaggagcagggctcaaataccgccgctgagaacactggatctaatgaacggaacatctatattgtggtgggtgtggtgtgcaccttgctggtggccctactgatggcggccctctacctcgtccgaatcagacagaagaaagcccagggctccacttcttctacaaggttgcatgagcccgagaagaatgccagagaaataacacaggtacagtccttggacacaaatgatatcacatatgcagacctgaacctgcccaaggggaagaagcctgctccccaggctgcggagcccaacaaccacacggagtatgccagcattcagaccagcccgcagcccgcgtcggaggacaccctcacctatgctgacctggacatggtccacctcaaccggacccccaagcagccggcccccaagcctgagccgtccttctcagagtacgccagcgtccaggtcccgaggaagtgaatgggaccgtggtttgctctagcacccatctctacgcgctttcttgtcccacagggagccgccgtgatgagcacagccaacccagttcccggagggctggggcggtgcaggctctgggacccaggggccagggtggctcttctctccccacccctccttggctctccagcacttcctgggcagccacggccccctccccccacattgccacatacctggaggctgacgttgccaaaccagccagggaaccaacctgggaagtggccagaactgcctggggtccaagaactcttgtgcctccgtccatcaccatgtgggttttgaagaccctcgactgcctccccgatgctccgaagcctgatcttccagggtggggaggagaaaatcccacctcccctgacctccaccacctccaccaccaccaccaccaccaccaccaccactaccaccaccacccaactggggctagagtggggaagatttcccctttagatcaaactgccccttccatggaaaagctggaaaaaaactctggaacccatatccaggcttggtgaggttgctgccaacagtcctggcctcccccatccctaggctaaagagccatgagtcctggaggaggagaggacccctcccaaaggactggagacaaaaccctctgcttccttgggtccctccaagactccctggggcccaactgtgttgctccacccggacccatctctcccttctagacctgagcttgcccctccagctagcactaagcaacatctcgctgtggacgcctgtaaattactgagaaatgtgaaacgtgcaatcttgaaactgaggtgttagaaaacttgatctgtggtgttttgttttgttttttttcttaaaacaacagcaacgtgatcttggctgtctgtcatgtgttgaagtccatggttgggtcttgtgaagtctgaggtttaacagtttgttgtcctggagggattttcttacagcgaagacttgagttcctccaagtcccagaaccccaagaatgggcaagaaggatcaggtcagccactccctggagacacagccttctggctgggactgacttggccatgttctcagctgagccacgcggctggtagtgcagccttctgtgaccccgctgtggtaagtccagcctgcccagggctgctgagggctgcctcttgacagtgcagtcttatcgagacccaatgcctcagtctgctcatccgtaaagtggggatagtgaagatgacacccctccccaccacctctcataagcactttaggaacacacagagggtagggatagtggccctggccgtctatcctacccctttagtgaccgcccccatcccggctttctgagctgatccttgaagaagaaatcttccatttctgctctcaaaccctactgggatcaaactggaataaattgaagacagccagggggatggtgcagctgtgaagctcgggctgattccccctctgtcccagaaggttggccagagggtgtgacccagttaccctttaacccccacccttccagtcgggtgtgagggcctgaccgggcccagggcaagcagatgtcgcaagccctatttattcagtcttcactataactcttagagttgagacgctaatgttcatgactcctggccttgggatgcccaagggatttctggctcaggctgtaaaagtagctgagccatcctgcccattcctggaggtcctacaggtgaaactgcaggagctcagcatagacccagctctctgggggatggtcacctggtgatttcaatgatggcatccaggaattagctgagccaacagaccatgtggacagctttggccagagctcccgtgtggcatctgggagccacagtgacccagccacctggctcaggctagttccaaattccaaaagattggcttgtaaaccttcgtctccctctcttttacccagagacagcacatacgtgtgcacacgcatgcacacacacattcagtattttaaaagaatgttttcttggtgccattttcattttattttattttttaattcttggagggggaaataagggaataaggccaaggaagatgtatagctttagctttagcctggcaacctggagaatccacataccttgtgtattgaaccccaggaaaaggaagaggtcgaaccaaccctgcggaaggagcatggtttcaggagtttattttaagactgctgggaaggaaacaggccccattttgtatatagttgcaacttaaactttttggcttgcaaaatatttttgtaataaagatttctgggtaataatgagtccttccggtgttcagtattcttgtctttgtgagtgcgtcccggggccgcctcggggcctgcctgccctcctgccaaagcctggaagaggattgaatggaccccagggtttggaaacaacctacagcatttgagcccctcacgtaggttttagagacgtacaatttttgtttgccctggctcagaaggagccggtgtaaggttgagataaaattccatatagacaactgagtttggatctcggctctgctgctttgtagctgtgggagttcaaacagcacctctttgagacttgggccccgcgtcggcacaatggggcaggaatagtccctgccagggtgactgtgtggattcaaggaggttggaagcactgagcccacgcttggcactgggtaggccatcactgaggcttgtgtctttccttcctgccctgaccctgcatagctgagtctcgtggcctctcaccactgatgggatctcggacacccggctcaccctcctcctggggcctcactttccttccccaccaaatgcagacatctaatgcttgtcctgtaatatccttgccagatgactgatgtcaagtgctggtttatagtgggtgctcaataaatgttagtttcctttctatccctccattagatcattaatgatattagtgctaattatgtaataaagttaaggcataaatatgttaa

SEQ ID NO: 181676 - DNA, 1659 bp, Homo sapiens
  Payload ID: 15783
  Gene Symbol: SIRPB1
  Gene Name: signal-regulatory protein beta 1
  ENST ID: ENST00000262929
  CDS Start-End: 1-543
atgcctgtcccagcctcctggccccaccctccttgtcctttcctgctgctgactctattgctgggactcacaggagtggcaggtgaggacgagctacaggtgattcagcctgaaaagtccgtatcagttgcagctggagagtcggccactctgcgctgtgctatgacgtccctgatccctgtggggcccatcatgtggtttagaggagctggagcaggccgggaattaatctacaatcagaaagaaggccacttcccacgggtaacaactgtttcagaactcacaaagagaaacaacctggacttttccatcagcatcagtaacatcaccccagcagacgccggcacctactactgtgtgaagttccggaaagggagccctgacgacgtggagtttaagtctggagcaggcactgagctgtctgtgcgcgaagcagcgctggctcctactgctccactcctcgtagctctcctcctgggccccaagctgctactggtggttggtgtctctgccatctacatctgctggaaacagaaggcctgactgaccctcagtctctgctgcctcctcctttcttgagaagctcagcctgagagaaggagctggcgagaaccttccccacactcagctccaaacgcctcctctcccaggtcatctgcctgcccacacgctcctgttccaccttcacaagaccatgatgccccaaagcagtgtctctattcacggtcctgagcaggggccatgggattgggctctgggcactgactcatggcacctccctagaaggtgagaaacactccaaatctaaacacaccaggacttctcccatccgtcgccttgggactggccataaaccacagactctctccaggctctcaagagttatcctgtcttctggattcctgcctaccccaactcccccagccttgttgaggttctctactgcctcctgaatacacatgaacccctataccaattttaagaaaaaaatgattctctttcctctttgtccaagcatcctatccctcaaacccaaaaagaaagaagctctcccttctctctctgtgatggagacagtatttcttctagtatcctgcagccttcccagtcctgctgcttgtggtagaaatgctgccacagcccaacattgaggagccctcgatgactgccctttacaactcatattcagttctgcctccaaaatgcatgtgtccacttacatgagatggtaaatgtttaacaatggactttctgaaagggaaaaaccaaaagctgttttgcagtgcttgccaatttctctagtgtaataactcccaacctgaccaatttcacactgccaacagttaaacaaccagattgcaagattcctgaaatttaacaattggttttcagggcccagtccaagcctgctgctggaaacctcagagttaaatccctattctccacacctctcacctccaccacccctccctgtcccagccagcatcatctctttggggaccactcctctggctttcatttttcagccacagtgattctttggaaaagtcaaatcatatcacttctctgcttcttccccaacacagctgcatggctcccgctctccctccttcaagtctctgctcaatgtcacttcattaaaggcaccttctataaact

SEQ ID NO: 181677 - DNA, 2207 bp, Homo sapiens
  Payload ID: 15783
  Gene Symbol: SIRPB1
  Gene Name: signal-regulatory protein beta 1
  Uniprot ID: Q5TFQ8
  ENST ID: ENST00000279477
  CDS Start-End: 66-1262
agagcagagtctgcgatcttcccagcacagacgtttggacagagcaggctcctaaggtctccagaatgcccgtgccagcctcctggccccaccttcctagtcctttcctgctgatgacgctactgctggggagactcacaggggtagctggcgaggaagagctgcaggtgattcagcctgacaagtccatatcagttgcagctggagagtcggccactctgcactgcactgtgacttccctgatccctgtggggcccatccagtggttcagaggagctggaccaggccgggaattaatctacaatcagaaagaaggccacttcccacgggtaacaactgtttcagacctcacaaagagaaacaacatggacttttccatccgcatcagtaacatcaccccagcagatgccggcacctactactgtgtgaagttccggaaagggagccccgaccacgtggagtttaagtctggagcaggcaccgagctgtctgtgcgtgccaaaccctctgcccccgtggtatcgggccctgcggcgagggccacacctcagcacacagtgagcttcacctgcgagtcccacggcttctcacccagagacatcaccctgaaatggttcaaaaatgggaatgagctctcagacttccagaccaacgtggaccccgcaggagacagtgtgtcctacagcatccacagcacagccaaggtggtgctgacccgcgaggacgttcactctcaagtcatctgcgaggtggcccacgtcaccttgcagggggaccctcttcgtgggactgccaacttgtctgagaccatccgagttccacccaccttggaggttactcaacagcccgtgagggcagagaaccaggtgaatgtcacctgccaggtgaggaagttctacccccagagactacagctgacctggttggagaatggaaacgtgtccaggacagaaacggcctcaacccttacagaaaacaaggatggtacctacaactggatgagctggctcctggtgaatgtatctgcccacagggatgatgtgaagctcacctgccaggtggagcatgacgggcagccagcggtcagcaaaagccatgacctgaaggtctcagcccacccgaaggagcagggctcaaatactgctcctggcccagcactggcttctgctgctccacttctcatagctttcctcctgggccccaaggtgctgctggtggttggtgtctctgtcatctatgtctactggaagcagaaggcctgactgcatcccagaaggagaccagcaccaggaatacaacagcctcccaggaaatgtttcttaaatgatgagcagatgattaaatatggacatgttacccacagctccttccctcctcccctgccacatggaacccccagtctctcctgcctacttccttccttgaatggctctgactgagagaaggggctggtgagaagcttccccagactgagctccaaacacctcccctcccaggacatcttcctgcccacaggctcctgttgctcctttgcagagtccttgattctccagagcagtcttcattcatggtcctgagcagaggccatgggatggggctctggggagtgactcatgacacctccctaggatgtgggaaacacgccaaatctaaacacatcaggacacctctcctccatcgtcttggactctccgtaagccacaaactgcagtccagattctcaagagttattctgccttctggattcctgcctacccaattacccagccttgttgagattctctattgcctcctgaatacaaattaacactcatcctggttttaaggagaaaaatgattatccttcctctttgtttatacgtatgatataatttggatattttttccctacaaatctcaatgtgaaatttcatcccctatgttggaggtggggtcaggtgggaggtgtttgggtcatggggatggattcatcatgaatgacttggtgttatcttggtctattagcacccacaagatctgattgtttaaaagtgcctagcagctccctcttctctttttctcttcctctctccccatgttatgccaactccacttcactgtccactgtgagcagaagcactctgaggccctcagcagcagatgcaagtaccatgcttcttgtacagtctgcagaaccaaaagccaaataaacctctctttataaatta

SEQ ID NO: 181678 - DNA, 1715 bp, Homo sapiens
  Payload ID: 15783
  Gene Symbol: SIRPB1
  Gene Name: signal-regulatory protein beta 1
  Uniprot ID: O00241
  ENST ID: ENST00000381603
  CDS Start-End: 53-598
cgatcttcccagcacagacgtttggacagagcaggctcctaaggtctccagaatgcccgtgccagcctcctggccccaccttcctagtcctttcctgctgatgacgctactgctggggagactcacaggagtggcaggtgaggacgagctacaggtgattcagcctgaaaagtccgtatcagttgcagctggagagtcggccactctgcgctgtgctatgacgtccctgatccctgtggggcccatcatgtggtttagaggagctggagcaggccgggaattaatctacaatcagaaagaaggccacttcccacgggtaacaactgtttcagaactcacaaagagaaacaacctggacttttccatcagcatcagtaacatcaccccagcagacgccggcacctactactgtgtgaagttccggaaagggagccctgacgacgtggagtttaagtctggagcaggcactgagctgtctgtgcgcgaagcagcgctggctcctactgctccactcctcgtagctctcctcctgggccccaagctgctactggtggttggtgtctctgccatctacatctgctggaaacagaaggcctgactgaccctcagtctctgctgcctcctcctttcttgagaagctcagcctgagagaaggagctggcgagaaccttccccacactcagctccaaacgcctcctctcccaggtcatctgcctgcccacacgctcctgttccaccttcacaagaccatgatgccccaaagcagtgtctctattcacggtcctgagcaggggccatgggattgggctctgggcactgactcatggcacctccctagaaggtgagaaacactccaaatctaaacacaccaggacttctcccatccgtcgccttgggactggccataaaccacagactctctccaggctctcaagagttatcctgtcttctggattcctgcctaccccaactcccccagccttgttgaggttctctactgcctcctgaatacacatgaacccctataccaattttaagaaaaaaatgattctctttcctctttgtccaagcatcctatccctcaaacccaaaaagaaagaagctctcccttctctctctgtgatggagacagtatttcttctagtatcctgcagccttcccagtcctgctgcttgtggtagaaatgctgccacagcccaacattgaggagccctcgatgactgccctttacaactcatattcagttctgcctccaaaatgcatgtgtccacttacatgagatggtaaatgtttaacaatggactttctgaaagggaaaaaccaaaagctgttttgcagtgcttgccaatttctctagtgtaataactcccaacctgaccaatttcacactgccaacagttaaacaaccagattgcaagattcctgaaatttaacaattggttttcagggcccagtccaagcctgctgctggaaacctcagagttaaatccctattctccacacctctcacctccaccacccctccctgtcccagccagcatcatctctttggggaccactcctctggctttcatttttcagccacagtgattctttggaaaagtcaaatcatatcacttctctgcttcttccccaacacagctgcatggctcccgctctccctccttcaagtctctgctcaatgtcacttcattaaaggcaccttctataaacta

SEQ ID NO: 181679 - DNA, 3241 bp, Homo sapiens
  Payload ID: 15783
  Gene Symbol: SIRPB1
  Gene Name: signal-regulatory protein beta 1
  Uniprot ID: O00241
  ENST ID: ENST00000381605
  CDS Start-End: 66-1262
agagcagagtctgcgatcttcccagcacagacgtttggacagagcaggctcctaaggtctccagaatgcccgtgccagcctcctggccccaccttcctagtcctttcctgctgatgacgctactgctggggagactcacaggagtggcaggtgaggacgagctacaggtgattcagcctgaaaagtccgtatcagttgcagctggagagtcggccactctgcgctgtgctatgacgtccctgatccctgtggggcccatcatgtggtttagaggagctggagcaggccgggaattaatctacaatcagaaagaaggccacttcccacgggtaacaactgtttcagaactcacaaagagaaacaacctggacttttccatcagcatcagtaacatcaccccagcagacgccggcacctactactgtgtgaagttccggaaagggagccctgacgacgtggagtttaagtctggagcaggcactgagctgtctgtgcgcgccaaaccctctgcccccgtggtatcgggccctgcggtgagggccacacctgagcacacagtgagcttcacctgcgagtcccatggcttctctcccagagacatcaccctgaaatggttcaaaaatgggaatgagctctcagacttccagaccaacgtggaccccgcaggagacagtgtgtcctacagcatccacagcacagccagggtggtgctgacccgtggggacgttcactctcaagtcatctgcgagatagcccacatcaccttgcagggggaccctcttcgtgggactgccaacttgtctgaggccatccgagttccacccaccttggaggttactcaacagcccatgagggcagagaaccaggcaaacgtcacctgccaggtgagcaatttctacccccggggactacagctgacctggttggagaatggaaatgtgtcccggacagaaacagcttcgaccctcatagagaacaaggatggcacctacaactggatgagctggctcctggtgaacacctgtgcccacagggacgatgtggtgctcacctgtcaggtggagcatgatgggcagcaagcagtcagcaaaagctatgccctggagatctcagcgcaccagaaggagcacggctcagatatcacccatgaagcagcgctggctcctactgctccactcctcgtagctctcctcctgggccccaagctgctactggtggttggtgtctctgccatctacatctgctggaaacagaaggcctgactgaccctcagtctctgctgcctcctcctttcttgagaagctcagcctgagagaaggagctggcgagaaccttccccacactcagctccaaacgcctcctctcccaggtcatctgcctgcccacacgctcctgttccaccttcacaagaccatgatgccccaaagcagtgtctctattcacggtcctgagcaggggccatgggattgggctctgggcactgactcatggcacctccctagaaggtgagaaacactccaaatctaaacacaccaggacttctcccatccgtcgccttgggactggccataaaccacagactctctccaggctctcaagagttatcctgtcttctggattcctgcctaccccaactcccccagccttgttgaggttctctactgcctcctgaatacacatgaacccctataccaattttaagaaaaaaatgattctctttcctctttgtccaagcatcctatccctcaaacccaaaaagaaagaagctctcccttctctctctgtgatggagacagtatttcttctagtatcctgcagccttcccagtcctgctgcttgtggtagaaatgctgccacagcccaacattgaggagccctcgatgactgccctttacaactcatattcagttctgcctccaaaatgcatgtgtccacttacatgagatggtaaatgtttaacaatggactttctgaaagggaaaaaccaaaagctgttttgcagtgcttgccaatttctctagtgtaataactcccaacctgaccaatttcacactgccaacagttaaacaaccagattgcaagattcctgaaatttaacaattggttttcagggcccagtccaagcctgctgctggaaacctcagagttaaatccctattctccacacctctcacctccaccacccctccctgtcccagccagcatcatctctttggggaccactcctctggctttcatttttcagccacagtgattctttggaaaagtcaaatcatatcacttctctgcttcttccccaacacagctgcatggctcccgctctccctccttcaagtctctgctcaatgtcacttcattaaaggcaccttctataaactaccttgtataaaatattatttattttctctatcccggcattctaatttctcttatcctaattaatttttctttagcccttattttgatgagtattatgccgaatacaggcagccctcacttttcatggcagtgcaagattgcaaaaatgactgtgcaacctgaaacccaggaaagcagtctccatagtcaatcagaaaaacaatgatcattctgtgacctttaccattttttgtcaaaatattagaaactctcacactctcagttacaaatgtagaggacaatgaaaatataatgaaataaatatttatttgtgcactacaattcaaagcattagaaacattgagagttcaagtgctgtttctttgtaaaaatgtatccagagtagttggaagagtgcttgcctttttttgtatatttctaatatggagtgatatagtttggctctgtgtctccatccaaatctcatcttaaattgtaatctgcatgtgttgtgggatgggcctggtaggaggtgactgaatcatgggggcggacttcccccttgctgttcttgtgatagtgagttctcataagatctcagtgagttctcatgagatctggttttttgaaagtgtgtggcaagtcccccttcgctctctctctctctctccctcctgccaccatgtgaagaaggtgcctgcttccttttctccttccaccatggttgtaagtttcctgaggcctcccagtcatgcttcctgttaagcctgtggaactgtgagtccaattaaacctcttttattcataaaatatccagtttctggtagttctttatagcagtgtgagaatgggctaatacacggagcaagcattgtttcttttc

SEQ ID NO: 181680 - DNA, 807 bp, Homo sapiens
  Payload ID: 15783
  Gene Symbol: SIRPB1
  Gene Name: signal-regulatory protein beta 1
  ENST ID: ENST00000562014
  CDS Start-End: 1-711
cacacagtgagcttcacctgcgagtcccacggcttctcacccagagacatcaccctgaaatggttcaaaaatgggaatgagctctcagacttccagaccaacgtggaccccgcaggagacagtgtgtcctacagcatccacagcacagccaaggtggtgctgacccgcgaggacgttcactctcaagtcatctgcgaggtggcccacgtcaccttgcagggggaccctcttcgtgggactgccaacttgtctgagaccatccgagttccacccaccttggaggttactcaacagcccgtgagggcagagaaccaggtgaatgtcacctgccaggtgaggaagttctacccccagagactacagctgacctggttggagaatggaaacgtgtccaggacagaaacggcctcaacccttacagaaaacaaggatggtacctacaactggatgagctggctcctggtgaatgtatctgcccacagggatgatgtgaagctcacctgccaggtggagcatgacgggcagccagcggtcagcaaaagccatgacctgaaggtctcagcccacccgaaggagcagggctcaaatactgctcctggcccagcactggcttctgctgctccacttctcatagctttcctcctgggccccaaggtgctgctggtggttggtgtctctgtcatctatgtctactggaagcagaaggcctgactaagcactctgaggccctcagcagcagatgcaagtaccatgcttcttgtacagtctgcagaaccaaaagccaaataaacctctctttataaatta

SEQ ID NO: 181681 - DNA, 583 bp, Homo sapiens
  Payload ID: 15783
  Gene Symbol: SIRPB1
  Gene Name: signal-regulatory protein beta 1
  ENST ID: ENST00000563840
  CDS Start-End: 116-583
atagccacttcctcttgaactgagggaggcagggcttgtcttctctcctcagagcagagcctgacatctccccaccacagacgtttgaacagagcaggctcctgaggtctccaggatgcctgtcccagcctcctggccccaccctccttgtcctttcctgctgctgactctattgctgggactcacaggagtggcaggtgaggacgagctacaggtgattcagcctgaaaagtccgtatcagttgcagctggagagtcggccactctgcgctgtgctatgacgtccctgatccctgtggggcccatcatgtggtttagaggagctggagcaggccgggaattaatctacaatcagaaagaaggccacttcccacgggtaacaactgtttcagaactcacaaagagaaacaacctggacttttccatcagcatcagtaacatcaccccagcagacgccggcacctactactgtgtgaagttccggaaagggagccctgacgacgtggagtttaagtctggagcaggcactgagctgtctgtgcgcgaagcagcgctggctcctactgctccactcctcgtagct

SEQ ID NO: 181682 - DNA, 947 bp, Homo sapiens
  Payload ID: 15783
  Gene Symbol: SIRPB1
  Gene Name: signal-regulatory protein beta 1
  ENST ID: ENST00000569387
  CDS Start-End: 1-234
cacagggatgatgtgaagctcacctgccaggtggagcatgacgggcagccagcggtcagcaaaagccatgacctgaaggtctcagcccacccgaaggagcagggctcaaatactgctcctggcccagcactggcttctgctgctccacttctcatagctttcctcctgggccccaaggtgctgctggtggttggtgtctctgtcatctatgtctactggaagcagaaggcctgactgacatcttcctgcccacaggctcctgttgctcctttgcagagtccttgattctccagagcagtcttcattcatggtcctgagcagaggccatgggatggggctctggggagtgactcatgacacctccctaggatgtgggaaacacgccaaatctaaacacatcaggacacctctcctccatcgtcttggactctccgtaagccacaaactgcagtccagattctcaagagttattctgccttctggattcctgcctacccaattacccagccttgttgagattctctattgcctcctgaatacaaattaacactcatcctggttttaaggagaaaaatgattatccttcctctttgtttatacgtatgatataatttggatattttttccctacaaatctcaatgtgaaatttcatcccctatgttggaggtggggtcaggtgggaggtgtttgggtcatggggatggattcatcatgaatgacttggtgttatcttggtctattagcacccacaagatctgattgtttaaaagtgcctagcagctccctcttctctttttctcttcctctctccccatgttatgccaactccacttcactgtccactgtgagcagaagcactctgaggccctcagcagcagatgcaagtaccatgcttcttgtacagtctgcagaaccaaaagccaaataaacctctctttataaatta

SEQ ID NO: 181683 - DNA, 655 bp, Homo sapiens
  Payload ID: 15783
  Gene Symbol: SIRPB1
  Gene Name: signal-regulatory protein beta 1
  ENST ID: ENST00000565230
  CDS Start-End: 1-395
ttccacccaccttggaggttactcaacagcccgtgagggcagagaaccaggtgaatgtcacctgccaggtgaggaagttctacccccagagactacagctgacctggttggagaatggaaacgtgtccaggacagaaacggcctcaacccttacagaaaacaaggatggtacctacaactggatgagctggctcctggtgaatgtatctgcccacagggatgatgtgaagctcacctgccaggtggagcatgacgggcagccagcggtcagcaaaagccatgacctgaaggtctcagcccacccgaaggagcagggctcaaatactgctcctgtgagtctggagttttacagaaggggaaaccaggacttgggaagcaatgggggatattgttgaagacaattagatcaaggcattagaccagatgactggcccaaactaattaaggcccagcactggcttctgctgctccacttctcatagctttcctcctgggccccaaggtgctgctggtggttggtgtctctgtcatctatgtctactggaagcagaaggcctgactaagcactctgaggccctcagcagcagatgcaagtaccatgcttcttgtacagtctgcagaaccaaaagccaaataaacctctctttataaatta

SEQ ID NO: 181684 - DNA, 1701 bp, Homo sapiens
  Payload ID: 15783
  Gene Symbol: SIRPB1
  Gene Name: signal-regulatory protein beta 1
  Uniprot ID: Q5TFQ8
  ENST ID: ENST00000568365
  CDS Start-End: 66-1262
agagcagagtctgcgatcttcccagcacagacgtttggacagagcaggctcctaaggtctccagaatgcccgtgccagcctcctggccccaccttcctagtcctttcctgctgatgacgctactgctggggagactcacaggggtagctggcgaggaagagctgcaggtgattcagcctgacaagtccatatcagttgcagctggagagtcggccactctgcactgcactgtgacttccctgatccctgtggggcccatccagtggttcagaggagctggaccaggccgggaattaatctacaatcagaaagaaggccacttcccacgggtaacaactgtttcagacctcacaaagagaaacaacatggacttttccatccgcatcagtaacatcaccccagcagatgccggcacctactactgtgtgaagttccggaaagggagccccgaccacgtggagtttaagtctggagcaggcaccgagctgtctgtgcgtgccaaaccctctgcccccgtggtatcgggccctgcggcgagggccacacctcagcacacagtgagcttcacctgcgagtcccacggcttctcacccagagacatcaccctgaaatggttcaaaaatgggaatgagctctcagacttccagaccaacgtggaccccgcaggagacagtgtgtcctacagcatccacagcacagccaaggtggtgctgacccgcgaggacgttcactctcaagtcatctgcgaggtggcccacgtcaccttgcagggggaccctcttcgtgggactgccaacttgtctgagaccatccgagttccacccaccttggaggttactcaacagcccgtgagggcagagaaccaggtgaatgtcacctgccaggtgaggaagttctacccccagagactacagctgacctggttggagaatggaaacgtgtccaggacagaaacggcctcaacccttacagaaaacaaggatggtacctacaactggatgagctggctcctggtgaatgtatctgcccacagggatgatgtgaagctcacctgccaggtggagcatgacgggcagccagcggtcagcaaaagccatgacctgaaggtctcagcccacccgaaggagcagggctcaaatactgctcctggcccagcactggcttctgctgctccacttctcatagctttcctcctgggccccaaggtgctgctggtggttggtgtctctgtcatctatgtctactggaagcagaaggcctgactctccttccctcctcccctgccacatggaacccccagtctctcctgcctacttccttccttgaatggctctgactgagagaaggggctggtgagaagcttccccagactgagctccaaacacctcccctcccaggacatcttcctgcccacaggctcctgttgctcctttgcagagtccttgattctccagagcagtcttcattcatggtcctgagcagaggccatgggatggggctctggggagtgactcatgacacctccctaggatgtgggaaacacgccaaatctaaacacatcaggacacctctcctccatcgtcttggactctccgtaagccacaaactgcagtccagattctcaagagttattctgccttctggattcctgcctacccaattacccagccttgttgagattctctattgcctcctgaatac

SEQ ID NO: 181685 - DNA, 472 bp, Homo sapiens
  Payload ID: 15783
  Gene Symbol: SIRPB1
  Gene Name: signal-regulatory protein beta 1
  ENST ID: ENST00000569629
  CDS Start-End: 1-177
cggaaagggagccccgaccacgtggagtttaagtctggagcaggcaccgagctgtctgtgcgtgaagcagcgctggctcctactgctccactcctcgtagctctcctcctgggccccaagctgctactggtggttggtgtctctgccatctacatctgctggaaacagaaggcctgactgaccctcagtctctgctgcctcctcctttcttgagaagctcagcctgagagaaggagctggcgagaaccttccccacactcagctccaaacgcctcctctcccaggtcatctgcctgcccacacgctcctgttccaccttcacaagaccatgatgccccaaagcagtgtctctattcacggtcctgagcaggggccatgggattgggctctgggcactgactcatggcacctccctagaaggtgagaaacactccaaatctaaacacaccaggacttctcccatccgtcgcct

SEQ ID NO: 181686 - DNA, 928 bp, Homo sapiens
  Payload ID: 15783
  Gene Symbol: SIRPB1
  Gene Name: signal-regulatory protein beta 1
  ENST ID: ENST00000566055
  CDS Start-End: 1-234
cacagggatgatgtgaagctcacctgccaggtggagcatgacgggcagccagcggtcagcaaaagccatgacctgaaggtctcagcccacccgaaggagcagggctcaaatactgctcctggcccagcactggcttctgctgctccacttctcatagctttcctcctgggccccaaggtgctgctggtggttggtgtctctgtcatctatgtctactggaagcagaaggcctgactgctcctgttgctcctttgcagagtccttgattctccagagcagtcttcattcatggtcctgagcagaggccatgggatggggctctggggagtgactcatgacacctccctaggatgtgggaaacacgccaaatctaaacacatcaggacacctctcctccatcgtcttggactctccgtaagccacaaactgcagtccagattctcaagagttattctgccttctggattcctgcctacccaattacccagccttgttgagattctctattgcctcctgaatacaaattaacactcatcctggttttaaggagaaaaatgattatccttcctctttgtttatacgtatgatataatttggatattttttccctacaaatctcaatgtgaaatttcatcccctatgttggaggtggggtcaggtgggaggtgtttgggtcatggggatggattcatcatgaatgacttggtgttatcttggtctattagcacccacaagatctgattgtttaaaagtgcctagcagctccctcttctctttttctcttcctctctccccatgttatgccaactccacttcactgtccactgtgagcagaagcactctgaggccctcagcagcagatgcaagtaccatgcttcttgtacagtctgcagaaccaaaagccaaataaacctctctttataaatta

SEQ ID NO: 181687 - DNA, 814 bp, Homo sapiens
  Payload ID: 15783
  Gene Symbol: SIRPB1
  Gene Name: signal-regulatory protein beta 1
  ENST ID: ENST00000565076
  CDS Start-End: 1-549
gggaatgagctctcagacttccagaccaacgtggaccccgcaggagacagtgtgtcctacagcatccacagcacagccagggtggtgctgacccgtggggacgttcactctcaagtcatctgcgagatagcccacatcaccttgcagggggaccctcttcgtgggactgccaacttgtctgaggccatccgagttccacccaccttggaggttactcaacagcccatgagggcagagaaccaggcaaacgtcacctgccaggtgagcaatttctacccccggggactacagctgacctggttggagaatggaaatgtgtcccggacagaaacagcttcgaccctcatagagaacaaggatggcacctacaactggatgagctggctcctggtgaacacctgtgcccacagggacgatgtggtgctcacctgtcaggtggagcatgatgggcagcaagcagtcagcaaaagctatgccctggagatctcagcgcaccagaaggagcacggctcagatatcacccatggtgcggttacttcccatttttaaattttgtctttttctttaatgttaaaagcaatattcatgcttgtcataaaataagctagaagtctataaatataaagtagaattttaacgtctacattaaaatcctacactccatgggtcaccactacttagaaggttcaaggtaacaattggccatttgtagacacccttaagccccatctaccaggagaaactgtgcgtcaagtctgatgcacaacttgatagatattttgacataaatatacattaaaggaaaaaagagaga

SEQ ID NO: 181688 - DNA, 907 bp, Homo sapiens
  Payload ID: 15783
  Gene Symbol: SIRPB1
  Gene Name: signal-regulatory protein beta 1
  ENST ID: ENST00000565087
  CDS Start-End: 1-234
cacagggatgatgtgaagctcacctgccaggtggagcatgacgggcagccagcggtcagcaaaagccatgacctgaaggtctcagcccacccgaaggagcagggctcaaatactgctcctggcccagcactggcttctgctgctccacttctcatagctttcctcctgggccccaaggtgctgctggtggttggtgtctctgtcatctatgtctactggaagcagaaggcctgactagtccttgattctccagagcagtcttcattcatggtcctgagcagaggccatgggatggggctctggggagtgactcatgacacctccctaggatgtgggaaacacgccaaatctaaacacatcaggacacctctcctccatcgtcttggactctccgtaagccacaaactgcagtccagattctcaagagttattctgccttctggattcctgcctacccaattacccagccttgttgagattctctattgcctcctgaatacaaattaacactcatcctggttttaaggagaaaaatgattatccttcctctttgtttatacgtatgatataatttggatattttttccctacaaatctcaatgtgaaatttcatcccctatgttggaggtggggtcaggtgggaggtgtttgggtcatggggatggattcatcatgaatgacttggtgttatcttggtctattagcacccacaagatctgattgtttaaaagtgcctagcagctccctcttctctttttctcttcctctctccccatgttatgccaactccacttcactgtccactgtgagcagaagcactctgaggccctcagcagcagatgcaagtaccatgcttcttgtacagtctgcagaaccaaaagccaaataaacctctctttataaatta

SEQ ID NO: 181689 - DNA, 2642 bp, Homo sapiens
  Payload ID: 15784
  Gene Symbol: SIRPB2
  Gene Name: signal-regulatory protein beta 2
  Uniprot ID: Q5JXA9
  ENST ID: ENST00000359801
  CDS Start-End: 38-1066
agaggagccccaagtcttggggaccacagaagatgccatgtgctccacgatgtcggcccccacctgcctggcccacttgcctccctgcttcctgctgctggcactggtccttgtcccctcagatgcctctgggcagagcagcaggaatgactggcaggtgctacagcccgagggccccatgctggtggcagaaggtgagacacttctactgaggtgtatggtggtcggctcctgcactgatggtatgataaaatgggtgaaggtgagcactcaggaccaacaggaaatttataactttaaacgtggctccttccctggggtaatgcccatgatccaacggacatcagaaccactgaattgtgattattccatctatatccacaatgtcaccagggagcacactggaacctaccactgtgtgaggtttgatggtttgagtgaacactcagaaatgaaatcggatgaaggcacctcagtgcttgtgaagggagctggggaccctgaaccagacctgtggatcatccagccccaggaattggtgttggggaccactggagacactgtctttctgaactgcacagtgcttggagacggtccccctggacccatcaggtggttccagggagctggtctgagccgggaggccatttacaactttggaggcatctcccaccccaaggagacagcggtgcaggcctccaacaatgacttcagcattcttctgcaaaacgtctccagtgaggatgcaggcacctattactgtgtaaagtttcagaggaaacccaacaggcaatacctgtctggacagggcaccagcctgaaagtgaaagcaaaatctacctcttccaaagaggcagaattcaccagtgaacctgcaactgagatgtctccaacaggcctcctggttgtgttcgcacctgtggtcctggggctgaaggcaattaccttggctgcactcctactggccctggctacctctcggaggagccctgggcaagaagatgtcaagaccacaggcccagcaggagccatgaacaccttagcatggagcaagggtcaagagtgaggggtcagccccagagtgaggaccctctgagttggagaggagccagggctcctcaaccatttccctacctccagtcccagcctctaggtgcccccaggcctcatgacaaactcctagatccctacatctggttttggtccacctagtgaaattcccttctttgcaccgggcttccctctaaaatgtctccctttctctttttggcctgttcaagacctccttgcttttcagtccctggctcagtctctcctcaacacccttgcccctgctgcagccctttctggtgcgccctgcccctttccccacctcgctacatccttcttggcctccaacatccaactcagagtcttcttcccaggagatgtctgtaagaatctctgaactcaaccagccagaccatctgtgcccctccatctacacctttctccccactccttcctgccttccttccatccccctcatggctggcttgggcaggtataatattagaatgcaggttcagcaactataacaaagctcttaaataacagtggcttaaaccagtggaaatcaaccagaaagttgaccatcagcaggccaagcaatacagagactccctggtattgagacccaggattcactgatctcattgctaccaggtccaccttctaggcagccagactggaaaagagggcaggaaaggggagcaggaccctcccctttaagtgcacagtcaggaacttggccacctcacttatctctacttggctggaatgtggtcacatggtcacacctagctgcaagaaacactgggagatgtagtctttatttctggcagcaatgcgcccagctgcaagttttcactagagaaaccagatggcagatatcaggggataaccagttatctccaccacagcagcatacagacagcctctcacctgccctgtgggacacctgagttcaatgcccagctagctagccagcacttcttcccactatcacctcccctggggcagcatgatgtggggcagtagttcccaagatgagtgattttgcccccactggacttttggcaatgtctagagatgtttttggttggcacaacctgggggggtgctaccaccatctagtggactgagaagccctgacatggggaagagtgtgcatgcccaggagtcagacacacctgcctttaaccctgaggcctctgcctcctccctgtgcaccctcagtgactaatcagagtcccttcccatcacggaacatccaggatactaatgtggacttctctgcattgtgtaagaaccaattcaagaccaggcacggtggcttatgcatgtaatcccagcactttgggaggccgaggtgggtggatcacctgagttcaggagtttgagaccagcctggctaacatggtgaaacctcgtctctactaaaaatacaaaaaattagccaggcgtggtggtgtgcacctgtaatcccagctacttgggaggatggggcaggagaaccgcttgaactgggaggcagaggctgcagtgagctgagatcgcgccattgcactccagcctgggcaacaagagcaaaactccgtctc

SEQ ID NO: 181690 - DNA, 884 bp, Homo sapiens
  Payload ID: 15784
  Gene Symbol: SIRPB2
  Gene Name: signal-regulatory protein beta 2
  Uniprot ID: Q5JXA9
  ENST ID: ENST00000444444
  CDS Start-End: 123-857
acttccccaagcagctgtggccaagagacgcagaaactgccttgtccacgggccccgcctcagactccaacactcacaagagagcagaggagccccaagtcttggggaccacagaagatgccatgtgctccacgatgtcggcccccacctgcctggcccacttgcctccctgcttcctgctgctggcactggtccttgtcccctcagatgcctctgggcagagcagcaggaatgactggcaggtgctacagcccgagggccccatgctggtggcagaaggagctggggaccctgaaccagacctgtggatcatccagccccaggaattggtgttggggaccactggagacactgtctttctgaactgcacagtgcttggagacggtccccctggacccatcaggtggttccagggagctggtctgagccgggaggccatttacaactttggaggcatctcccaccccaaggagacagcggtgcaggcctccaacaatgacttcagcattcttctgcaaaacgtctccagtgaggatgcaggcacctattactgtgtaaagtttcagaggaaacccaacaggcaatacctgtctggacagggcaccagcctgaaagtgaaagcaaaatctacctcttccaaagaggcagaattcaccagtgaacctgcaactgagatgtctccaacaggcctcctggttgtgttcgcacctgtggtcctggggctgaaggcaattaccttggctgcactcctactggccctggctacctctcggaggagccctgggcaagaagatgtcaagaccacaggcccagcaggagccatgaacaccttagcatggagcaagggtcaagagtgaggggtcagccccagagtgaggaccctc

SEQ ID NO: 181691 - DNA, 1930 bp, Homo sapiens
  Payload ID: 15784
  Gene Symbol: SIRPB2
  Gene Name: signal-regulatory protein beta 2
  ENST ID: ENST00000481731
  CDS Start-End: 160-1029
tattgcaccaacagccttgtgttgctgcaatgaaaacacttccccaagcagctgtggccaagagacgcagaaactgccttgtccacgggccccgcctcagactccaacactcacaagagagcagaggagccccaagtcttggggaccacagaagatgccatgtgctccacgatgtcggcccccacctgcctggcccacttgcctccctgcttcctgctgctggcactggtccttgtcccctcagatgcctctgggcagagcagcaggaatgactggcaggtgctacagcccgagggccccatgctggtggcagaaggtgagacacttctactgaggtgtatggtggtcggctcctgcactgatggtatgataaaatgggtgaaggtgagcactcaggaccaacaggaaatttataactttaaacgtggctccttccctggggtaatgcccatgatccaacggacatcagaaccactgaattgtgattattccatctatatccacaatgtcaccagggagcacactggaacctaccactgtgtgaggtttgatggtttgagtgaacactcagaaatgaaatcggatgaaggcacctcagtgcttgtgaagggagctggggaccctgaaccagacctgtggatcatccagccccaggaattggtgttggggaccactggagacactgtctttctgaactgcacagtgcttggagacggtccccctggacccatcaggtggttccagggagctggtctgagccgggaggccatttacaactttggaggcatctcccaccccaaggagacagcggtgcaggcctccaacaatgacttcagcattcttctgcaaaacgtctccagtgaggatgcaggcacctattactgtgtaaagtttcagaggaaacccaacaggcaatacctgtctggacagggcaccagcctgaaagtgaaagcaaaatctacctcttccaaagaggcagaattcaccagtgaacctgcaactgagatgtctccaacaggtttgcagtgatctgttacagcggccacgggaagctgaaacagcaggaaagcatggaggtggttctccactaactggagccaccctcattgaatcctgaaacgtggttgaaagctgactctgtgccaggccctaatcagtgtgctgagaaagaaacagaagtctgctctctcagagcttacctcctcccgagagaagacagacaatgagcaagtaaccctagggtggacagaagaggcctcctgataaagtgacatttgagcagacacctgaaggaggtgaggaagagagccctgcagatacccaggggaagagctgaaaagtacaaggaacagcgaatgcaaaggtcctgaggcaggagcgtgcttgacttgcacaagaacagcaaacaccaagcagaatgcctggcctgtattagaccccgtaaacgcctgaactacatacatggcagagatgaagcacacagtctcggaaatctggctgtgcaggttcaaattccagttctcctacttatctcttggggaagtgcgggaatcttcagttcttgtctgcttggaagaaagatttcagccaagagacacacagcaaaggtgaagtagcagagtttattgaagaaagataaagtacgttcctagaaaggagtgggctgacctggctggaaaacagcatcaggcaaaaaacagcagtagcagtgtttatttaaagagacagtacactctgaaagaacgagccagcagcagctggtgctgggggaccctctttatgagaatcttacatgattattcgtgcaggggcatgagggagcgtcacttacaatcatgttttaggtggtccccctggctgtgaatgttgtgtgtttgtacgcgctagtaaacacattgcctgtctcattagcatttaaaatctccactca

SEQ ID NO: 181692 - DNA, 1605 bp, Homo sapiens
  Payload ID: 15784
  Gene Symbol: SIRPB2
  Gene Name: signal-regulatory protein beta 2
  ENST ID: ENST00000486775
  CDS Start-End: 229-1098
ttagcacagtgactacaggaatcacagcccagacacaaaagcaggaaaccctttgaccgggctccttcctattgcaccaacagccttgtgttgctgcaatgaaaacacttccccaagcagctgtggccaagagacgcagaaactgccttgtccacgggccccgcctcagactccaacactcacaagagagcagaggagccccaagtcttggggaccacagaagatgccatgtgctccacgatgtcggcccccacctgcctggcccacttgcctccctgcttcctgctgctggcactggtccttgtcccctcagatgcctctgggcagagcagcaggaatgactggcaggtgctacagcccgagggccccatgctggtggcagaaggtgagacacttctactgaggtgtatggtggtcggctcctgcactgatggtatgataaaatgggtgaaggtgagcactcaggaccaacaggaaatttataactttaaacgtggctccttccctggggtaatgcccatgatccaacggacatcagaaccactgaattgtgattattccatctatatccacaatgtcaccagggagcacactggaacctaccactgtgtgaggtttgatggtttgagtgaacactcagaaatgaaatcggatgaaggcacctcagtgcttgtgaagggagctggggaccctgaaccagacctgtggatcatccagccccaggaattggtgttggggaccactggagacactgtctttctgaactgcacagtgcttggagacggtccccctggacccatcaggtggttccagggagctggtctgagccgggaggccatttacaactttggaggcatctcccaccccaaggagacagcggtgcaggcctccaacaatgacttcagcattcttctgcaaaacgtctccagtgaggatgcaggcacctattactgtgtaaagtttcagaggaaacccaacaggcaatacctgtctggacagggcaccagcctgaaagtgaaagcaaaatctacctcttccaaagaggcagaattcaccagtgaacctgcaactgagatgtctccaacaggtttgcagtgatctgttacagcggccacgggaagctgaaacagcaggaaagcatggaggtggttctccactaactggaggccctaatcagtgtgctgagaaagaaacagaagtctgctctctcagagcttacctcctcccgagagaagacagacaatgagcaagtaaccctagggtggacagaagaggcctcctgataaagtgacatttgagcagacacctgaaggaggtgaggaagagagccctgcagatacccaggggaagagctgaaaagtacaaggaacagcgaatgcaaaggtcctgaggcaggagcgtgcttgacttgcacaagaacagcaaacaccaagcagaatgcctggcctgtattagaccccgtaaacgcctgaactacatacatggcagagatgaagcacacagtctcggaaatctggctgtgcaggttcaaattccagttctcctacttatctcttgggtgagtttgtttctctcagtttccttgtctataaactggtaataaca

SEQ ID NO: 181693 - DNA, 478 bp, Homo sapiens
  Payload ID: 15784
  Gene Symbol: SIRPB2
  Gene Name: signal-regulatory protein beta 2
  ENST ID: ENST00000608073
  CDS Start-End: 55-315
aacactcacaagagagcagaggagccccaagtcttggggaccacagaagatgccatgtgctccacgatgtcggcccccacctgcctggcccacttgcctccctgcttcctgctgctggcactggtccttgtcccctcagatgcctctgggcagagcagcaggaatgactggcaggtgctacagcccgagggccccatgctggtggcagaaggtgagacacttctactgaggtgtatggtggtcggctcctgcactgatggtatgataaaatgggtgaagggagcacactggaacctaccactgtgtgaggtttgatggtttgagtgaacactcagaaatgaaatcggatgaaggcacctcagtgcttgtgaagggagctggggaccctgaaccagacctgtggatcatccagccccaggaattggtgttggggaccactggagacactgtctttctgaactgcacagtgcttggagac

SEQ ID NO: 181694 - DNA, 823 bp, Homo sapiens
  Payload ID: 15785
  Gene Symbol: SIRPD
  Gene Name: signal-regulatory protein delta
  ENST ID: ENST00000381621
  CDS Start-End: 53-649
gggcatctccaggacaggcattcaggcagagcaagctccaggtttcaccacaatgcccatccctgcctccccactccacccacctctgccttccttactgctgtatctgctgcttgaactggcaggagtcacacatgtgttccatgtgcaacaaacggagatgtcacagactgtatcaactggggagtcaatcatcttgagttgcagcgtacccaataccttaccaaatggacctgtcttgtggttcaagggaacagggccaaaccggaaattaatctacaatttcaaacaaggtaactttcccagagtaaaagagattggagacaccaccaagcctggcaacacagacttttccacccgcatccgtgaaatctctcttgctgatgctggcacctattactgcgtgaagttcataaaaggaagagctatcaaggagtaccaatcaggtcggggcactcaggtgtttgttactgcagagcagaatccaagacctcccaagaacagacctgcaggcagagcaggctccagggcccaccatgatgcccatacctgcctctcggccctgcctgagagaaacagcacaaactatttcgtccaaccctgctgctgcctccggctgctgggactcacaggcttgctgtcaaaataatccaaacagggaaggaacgtacaagtaaataacaaaagcccccatactcttctgactccctggagacagctactttttaggagtttcatttgccttcttcaagagagctttcttccactgacataaaatgccagcttgatcgtacaataaatctgtctatttacctgggtccaa

SEQ ID NO: 181695 - DNA, 1958 bp, Homo sapiens
  Payload ID: 15785
  Gene Symbol: SIRPD
  Gene Name: signal-regulatory protein delta
  Uniprot ID: Q9H106
  ENST ID: ENST00000381623
  CDS Start-End: 1191-1784
atttcagaacaacgggataggatgatgacatcacaaggggatggggactcttgtcgtctcagagagaacgtgccagcctggctctgctttcttttcctagagggtctaacacctctcccggccctgacatctagctggttcctgaggaggaggcagaagtcatgaggaggcaatggggaaacagccatggcagccagtgcctgcctgtggatgcttggacattaaagggtcaccagctgagtgtgggctgagtgtccctgaacacaacatttgtgcttaggaagaacccattccagagctgagagagaaggatgccaacatgctgcttcctccctctttctgggggcatttcttctgcccctccaatcccatctctgagagctggtcccaggtccagcccaagcaggagaggcagccctcaccttcccaggtgtttgtaggcatgttactctccctcctagagagtgttccccgcagctccgccttccctgcaggcctcctccatcctctaaagcacaaatcatcaccacctgcacaactcgaatgtctttctcagccatgcctgattcctctgcaggaaggaaaaaggaagcagttcctggtagtgtatggagggacccacagaaaagccaagagcccacagcagatattgcttgttttttacctctaactactctggagtgcaagaaagggcatccattgtaaagtccaactcttaccaagtgggtgaggctatagacatcttgtctctttcttcagctgtgcagctcagacaggcccagatgttgagctcatgcaggagctagacccatacctgcgcatcatgtggatgaggcctttgtctagcctatgtgtctgaggctcctagataggcaaaggccatgaagttggggagaacctgtgagatgggatgaaactcaggaaggagtataaggctgtgggtgtcaagccccccagccccagcaaagctaaatacttccagcagcaacttcctagcttgaagcaaccttgtctgttcaattttataatcacaaaggaaaaagtgtcccagtcccctggcctttcctctcatcacaatccccttcctctgacatcacagaggcaagaactgtcttctctgctcggagcactgagtcgagggcatctccaggacaggcattcaggcagagcaagctccaggtttcaccacaatgcccatccctgcctccccactccacccacctctgccttccttactgctgtatctgctgcttgaactggcaggagtcacacatgtgttccatgtgcaacaaacggagatgtcacagactgtatcaactggggagtcaatcatcttgagttgcagcgtacccaataccttaccaaatggacctgtcttgtggttcaagggaacagggccaaaccggaaattaatctacaatttcaaacaaggtaactttcccagagtaaaagagattggagacaccaccaagcctggcaacacagacttttccacccgcatccgtgaaatctctcttgctgatgctggcacctattactgcgtgaagttcataaaaggaagagctatcaaggagtaccaatcaggtcggggcactcaggtgtttgttactgagcagaatccaagacctcccaagaacagacctgcaggcagagcaggctccagggcccaccatgatgcccatacctgcctctcggccctgcctgagagaaacagcacaaactatttcgtccaaccctgctgctgcctccggctgctgggactcacaggcttgctgtcaaaataatccaaacagggaaggaacgtacaagtaaataacaaaagcccccatactcttctgactccctggagacagctactttttaggagtttcatttgccttcttcaagagagctttcttccactgacataaaatgccagcttgatcgtacaataaatctgtctatttacctgggtccaa

SEQ ID NO: 181696 - DNA, 416 bp, Homo sapiens
  Payload ID: 15785
  Gene Symbol: SIRPD
  Gene Name: signal-regulatory protein delta
  ENST ID: ENST00000429387
  CDS Start-End: 1-242
caaatggacctgtcttgtggttcaagggaacagggccaaaccggaaattaatctacaatttcaaacaagagcagaatccaagacctcccaagaacagacctgcaggcagagcaggctccagggcccaccatgatgcccatacctgcctctcggccctgcctgagagaaacagcacaaactatttcgtccaaccctgctgctgcctccggctgctgggactcacaggcttgctgtcaaaataatccaaacagggaaggaacgtacaagtaaataacaaaagcccccatactcttctgactccctggagacagctactttttaggagtttcatttgccttcttcaagagagctttcttccactgacataaaatgccagcttgatcgtacaataaatctgtctatttacctgggtccaa

SEQ ID NO: 181697 - DNA, 831 bp, Homo sapiens
  Payload ID: 15786
  Gene Symbol: SIRPG
  Gene Name: signal-regulatory protein gamma
  Uniprot ID: Q9P1W8
  ENST ID: ENST00000216927
  CDS Start-End: 1-831
atgcctgtcccagcctcctggccccatcctcctggtcctttcctgcttctgactctactgctgggacttacagaagtggcaggtgaggaggagctacagatgattcagcctgagaagctcctgttggtcacagttggaaagacagccactctgcactgcactgtgacctccctgcttcccgtgggacccgtcctgtggttcagaggagttggaccaggccgggaattaatctacaatcaaaaagaaggccacttccccagggtaacaacagtttcagacctcacaaagagaaacaacatggacttttccatccgcatcagtagcatcaccccagcagatgtcggcacatactactgtgtgaagtttcgaaaagggagccctgagaacgtggagtttaagtctggaccaggcactgagatggctttgggtgccaaaccctctgcccccgtggtattgggccctgcggcgaggaccacacctgagcatacagtgagtttcacctgtgagtcccatggcttctctcccagagacatcaccctgaaatggttcaaaaatgggaatgagctctcagacttccagaccaacgtggaccccacaggacagagtgtggcctacagcatccgcagcacagccagggtggtactggacccctgggacgttcgctctcaggtcatctgcgaggtggcccatgtcaccttgcagggggaccctcttcgtgggactgccaacttgtctgaggccatccgaggcccggcatcatcccttactgcgctgctcctcatagctgtcctcctgggccccatctacgtcccctggaagcagaagacctga

SEQ ID NO: 181698 - DNA, 1716 bp, Homo sapiens
  Payload ID: 15786
  Gene Symbol: SIRPG
  Gene Name: signal-regulatory protein gamma
  Uniprot ID: Q9P1W8
  ENST ID: ENST00000303415
  CDS Start-End: 66-1229
agagcagggcctgacatctccccagaacagacgtttgaacagagcaggcttctgaggtctccaaaatgcctgtcccagcctcctggccccatcctcctggtcctttcctgcttctgactctactgctgggacttacagaagtggcaggtgaggaggagctacagatgattcagcctgagaagctcctgttggtcacagttggaaagacagccactctgcactgcactgtgacctccctgcttcccgtgggacccgtcctgtggttcagaggagttggaccaggccgggaattaatctacaatcaaaaagaaggccacttccccagggtaacaacagtttcagacctcacaaagagaaacaacatggacttttccatccgcatcagtagcatcaccccagcagatgtcggcacatactactgtgtgaagtttcgaaaagggagccctgagaacgtggagtttaagtctggaccaggcactgagatggctttgggtgccaaaccctctgcccccgtggtattgggccctgcggcgaggaccacacctgagcatacagtgagtttcacctgtgagtcccatggcttctctcccagagacatcaccctgaaatggttcaaaaatgggaatgagctctcagacttccagaccaacgtggaccccacaggacagagtgtggcctacagcatccgcagcacagccagggtggtactggacccctgggacgttcgctctcaggtcatctgcgaggtggcccatgtcaccttgcagggggaccctcttcgtgggactgccaacttgtctgaggccatccgagttccacccaccttggaggttactcaacagcccatgagggtggggaaccaggtaaacgtcacctgccaggtgaggaagttctacccccagagcctacagctgacctggtcggagaatggaaacgtgtgccagagagaaacagcctcgacccttacagagaacaaggatggtacctacaactggacaagctggttcctggtgaacatatctgaccaaagggatgatgtggtcctcacctgccaggtgaagcatgatgggcagctggcggtcagcaaacgccttgccctagaggtcacagtccaccagaaggaccagagctcagatgctacccctggcccggcatcatcccttactgcgctgctcctcatagctgtcctcctgggccccatctacgtcccctggaagcagaagacctgactctccttccttcctcccctgccacgtgggaccctcatctctgctgcctccttcctttcctgagaggctcagcttgagagaatgagccagtgagaagcttctctagacttggctccaaacatctcccctcccaagacatctgcctgcccacaggctcctgttgctccttcacacagacctggatgccccagagcaaggtcttcattcatggtcctgagcaggtgccatgggattgggctctgggcactgacttaacggcacctccctagaaggcgagaaacatgccaaatctaaacacaccaggactcccatccatcgccttgagactgaccgtaaaccacagacgctctccaggttctcaagagttatcctgccttccagattcctgcctatcccaactccccagccttgttgaggttctctattgcctcttgaatacaaatgcactcccaaagtggttttaagaaaataaaaagattatccttcc

SEQ ID NO: 181699 - DNA, 1042 bp, Homo sapiens
  Payload ID: 15786
  Gene Symbol: SIRPG
  Gene Name: signal-regulatory protein gamma
  Uniprot ID: Q9P1W8
  ENST ID: ENST00000344103
  CDS Start-End: 43-555
agaacagacgtttgaacagagcaggcttctgaggtctccaaaatgcctgtcccagcctcctggccccatcctcctggtcctttcctgcttctgactctactgctgggacttacagaagtggcaggtgaggaggagctacagatgattcagcctgagaagctcctgttggtcacagttggaaagacagccactctgcactgcactgtgacctccctgcttcccgtgggacccgtcctgtggttcagaggagttggaccaggccgggaattaatctacaatcaaaaagaaggccacttccccagggtaacaacagtttcagacctcacaaagagaaacaacatggacttttccatccgcatcagtagcatcaccccagcagatgtcggcacatactactgtgtgaagtttcgaaaagggagccctgagaacgtggagtttaagtctggaccaggcactgagatggctttgggtggcccggcatcatcccttactgcgctgctcctcatagctgtcctcctgggccccatctacgtcccctggaagcagaagacctgactctccttccttcctcccctgccacgtgggaccctcatctctgctgcctccttcctttcctgagaggctcagcttgagagaatgagccagtgagaagcttctctagacttggctccaaacatctcccctcccaagacatctgcctgcccacaggctcctgttgctccttcacacagacctggatgccccagagcaaggtcttcattcatggtcctgagcaggtgccatgggattgggctctgggcactgacttaacggcacctccctagaaggcgagaaacatgccaaatctaaacacaccaggactcccatccatcgccttgagactgaccgtaaaccacagacgctctccaggttctcaagagttatcctgccttccagattcctgcctatcccaactccccagccttgttgaggttctctattgcctcttgaatacaaatgcactcccaaagtggttttaagaaaataaaaagattatccttcc

SEQ ID NO: 181700 - DNA, 1732 bp, Homo sapiens
  Payload ID: 15786
  Gene Symbol: SIRPG
  Gene Name: signal-regulatory protein gamma
  Uniprot ID: Q9P1W8
  ENST ID: ENST00000381580
  CDS Start-End: 181-1245
aagcatgatgggttttactagaacgtttcagtgtcactaagtcacagaagaggaggacaagaagaggaattatggcagggaccagctttatcacagtggtgtacctggtttggcagggtgctcacaacttgtttgtgggatgtggaggtatcagaagtggcaggtgaggaggagctacagatgattcagcctgagaagctcctgttggtcacagttggaaagacagccactctgcactgcactgtgacctccctgcttcccgtgggacccgtcctgtggttcagaggagttggaccaggccgggaattaatctacaatcaaaaagaaggccacttccccagggtaacaacagtttcagacctcacaaagagaaacaacatggacttttccatccgcatcagtagcatcaccccagcagatgtcggcacatactactgtgtgaagtttcgaaaagggagccctgagaacgtggagtttaagtctggaccaggcactgagatggctttgggtgccaaaccctctgcccccgtggtattgggccctgcggcgaggaccacacctgagcatacagtgagtttcacctgtgagtcccatggcttctctcccagagacatcaccctgaaatggttcaaaaatgggaatgagctctcagacttccagaccaacgtggaccccacaggacagagtgtggcctacagcatccgcagcacagccagggtggtactggacccctgggacgttcgctctcaggtcatctgcgaggtggcccatgtcaccttgcagggggaccctcttcgtgggactgccaacttgtctgaggccatccgagttccacccaccttggaggttactcaacagcccatgagggtggggaaccaggtaaacgtcacctgccaggtgaggaagttctacccccagagcctacagctgacctggtcggagaatggaaacgtgtgccagagagaaacagcctcgacccttacagagaacaaggatggtacctacaactggacaagctggttcctggtgaacatatctgaccaaagggatgatgtggtcctcacctgccaggtgaagcatgatgggcagctggcggtcagcaaacgccttgccctagaggtcacagtccaccagaaggaccagagctcagatgctacccctggcccggcatcatcccttactgcgctgctcctcatagctgtcctcctgggccccatctacgtcccctggaagcagaagacctgactctccttccttcctcccctgccacgtgggaccctcatctctgctgcctccttcctttcctgagaggctcagcttgagagaatgagccagtgagaagcttctctagacttggctccaaacatctcccctcccaagacatctgcctgcccacaggctcctgttgctccttcacacagacctggatgccccagagcaaggtcttcattcatggtcctgagcaggtgccatgggattgggctctgggcactgacttaacggcacctccctagaaggcgagaaacatgccaaatctaaacacaccaggactcccatccatcgccttgagactgaccgtaaaccacagacgctctccaggttctcaagagttatcctgccttccagattcctgcctatcccaactccccagccttgttgaggttctctattgcctcttgaatacaaatgcactcccaaagtggttttaagaaaataaaaagattatccttcc

SEQ ID NO: 181701 - DNA, 1383 bp, Homo sapiens
  Payload ID: 15786
  Gene Symbol: SIRPG
  Gene Name: signal-regulatory protein gamma
  Uniprot ID: Q9P1W8
  ENST ID: ENST00000381583
  CDS Start-End: 66-896
agagcagggcctgacatctccccagaacagacgtttgaacagagcaggcttctgaggtctccaaaatgcctgtcccagcctcctggccccatcctcctggtcctttcctgcttctgactctactgctgggacttacagaagtggcaggtgaggaggagctacagatgattcagcctgagaagctcctgttggtcacagttggaaagacagccactctgcactgcactgtgacctccctgcttcccgtgggacccgtcctgtggttcagaggagttggaccaggccgggaattaatctacaatcaaaaagaaggccacttccccagggtaacaacagtttcagacctcacaaagagaaacaacatggacttttccatccgcatcagtagcatcaccccagcagatgtcggcacatactactgtgtgaagtttcgaaaagggagccctgagaacgtggagtttaagtctggaccaggcactgagatggctttgggtgccaaaccctctgcccccgtggtattgggccctgcggcgaggaccacacctgagcatacagtgagtttcacctgtgagtcccatggcttctctcccagagacatcaccctgaaatggttcaaaaatgggaatgagctctcagacttccagaccaacgtggaccccacaggacagagtgtggcctacagcatccgcagcacagccagggtggtactggacccctgggacgttcgctctcaggtcatctgcgaggtggcccatgtcaccttgcagggggaccctcttcgtgggactgccaacttgtctgaggccatccgaggcccggcatcatcccttactgcgctgctcctcatagctgtcctcctgggccccatctacgtcccctggaagcagaagacctgactctccttccttcctcccctgccacgtgggaccctcatctctgctgcctccttcctttcctgagaggctcagcttgagagaatgagccagtgagaagcttctctagacttggctccaaacatctcccctcccaagacatctgcctgcccacaggctcctgttgctccttcacacagacctggatgccccagagcaaggtcttcattcatggtcctgagcaggtgccatgggattgggctctgggcactgacttaacggcacctccctagaaggcgagaaacatgccaaatctaaacacaccaggactcccatccatcgccttgagactgaccgtaaaccacagacgctctccaggttctcaagagttatcctgccttccagattcctgcctatcccaactccccagccttgttgaggttctctattgcctcttgaatacaaatgcactcccaaagtggttttaagaaaataaaaagattatccttcc

SEQ ID NO: 181702 - DNA, 6213 bp, Homo sapiens
  Payload ID: 15787
  Gene Symbol: SIK3
  Gene Name: SIK family kinase 3
  ENST ID: ENST00000375300
  CDS Start-End: 7-3972
aacaagatggcggcggcggcggcgagcggagctggcggggctgccggggccgggactgggggagccgggcccgcgggccgcctgctgcctccgcccgcgccggggtccccagccgcccccgctgccgtgtcccctgcggccggccagccgcgtcccccagccccggcctcccgcggacccatgcccgcccgtatcggctactacgagatcgaccgcaccatcggcaagggcaacttcgcggtggtcaagcgggccacgcacctcgtcaccaaggccaaggttgctatcaagatcatagataagacccagctggatgaagaaaacttgaagaagattttccgggaagttcaaattatgaagatgctttgccacccccatatcatcaggctctaccaggttatggagacagaacggatgatttatctggtgacagaatatgctagtggaggggaaatatttgaccacctggtggcccatggtagaatggcagaaaaggaggcacgtcggaagttcaaacagatcgtcacagctgtctatttttgtcactgtcggaacattgttcatcgtgatttaaaagctgaaaatttacttctggatgccaatctgaatatcaaaatagcagattttggtttcagtaacctcttcactcctgggcagctgctgaagacctggtgtggcagccctccctatgctgcacctgaactctttgaaggaaaagaatatgatgggcccaaagtggacatctggagccttggagttgtcctctacgtgcttgtgtgcggtgccctgccatttgatggaagcacactgcagaatctgcgggcccgcgtgctgagtggaaagttccgcatcccattttttatgtccacagaatgtgagcatttgatccgccatatgttggtgttagatcccaataagcgcctctccatggagcagatctgcaagcacaagtggatgaagctaggggacgccgatcccaactttgacaggttaatagctgaatgccaacaactaaaggaagaaagacaggtggaccccctgaatgaggatgtcctcttggccatggaggacatgggactggacaaagaacagacactgcagtcattaagatcagatgcctatgatcactatagtgcaatctacagcctgctgtgtgatcgacataagagacataaaaccctgcgtctcggagcacttcctagcatgccccgagccctggcctttcaagcaccagtcaatatccaggcggagcaggcaggtactgctatgaacatcagcgttccccaggtgcagctgatcaacccagagaaccaaattgtggagccggatgggacactgaatttggacagtgatgagggtgaagagccttcccctgaagcattggtgcgctatttgtcaatgaggaggcacacagtgggtgtggctgacccacgcacggaagttatggaagatctgcagaagctcctacctggctttcctggagtcaacccccaggctccattcctgcaggtggcccctaatgtgaacttcatgcacaacctgttgcctatgcaaaacttgcaaccaaccgggcaacttgagtacaaggagcagtctctcctacagccgcccacgctacagctgttgaatggaatgggcccccttggccggagggcatcagatggaggagccaacatccaactgcatgcccagcagctgctgaagcgcccacggggaccctctccgcttgtcaccatgacaccagcagtgccagcagttacccctgtggacgaggagagctcagacggggagccagaccaggaagctgtgcagagctctacctacaaggactccaacactctgcacctccctacggagcgtttctcccctgtgcgccggttctcagatggggctgcgagcatccaggccttcaaagctcacctggaaaaaatgggcaacaacagcagcatcaaacagctgcagcaggagtgtgagcagctgcagaagatgtacggggggcagattgatgaaagaaccctggagaagacccagcagcagcatatgttataccagcaggagcagcaccatcaaattctccagcaacaaattcaagactctatctgtcctcctcagccatctccacctcttcaggctgcatgtgaaaatcagccagccctccttacccatcagctccagaggttaaggattcagccttcaagcccaccccccaaccaccccaacaaccatctcttcaggcagcccagtaatagtcctccccccatgagcagtgccatgatccagcctcacggggctgcatcttcttcccagtttcaaggcttaccttcccgcagtgcaatctttcagcagcaacctgagaactgttcctctcctcccaacgtggcactaacctgcttgggtatgcagcagcctgctcagtcacagcaggtcaccatccaagtccaagagcctgttgacatgctcagcaacatgccaggcacagctgcaggctccagtgggcgcggcatctccatcagccccagtgctggtcagatgcagatgcagcaccgtaccaacctgatggccaccctcagctatgggcaccgtcccttgtccaagcagctgagtgctgacagtgcagaggctcacagcttgaacgtgaatcggttctcccctgctaactacgaccaggcgcatttacacccccatctgttttcggaccagtcccggggttcccccagcagctacagcccttcaacaggagtggggttctctccaacccaagccctgaaagtccctccacttgaccaattccccaccttccctcccagtgcacatcagcagccgccacactataccacgtcggcactacagcaggccctgctgtctcccacgccgccagactatacaagacaccagcaggtaccccacatccttcaaggactgctttctccccggcattcgctcaccggccactcggacatccggctgcccccaacagagtttgcacagctcattaaaaggcagcagcaacaacggcagcagcagcagcaacagcagcaacagcaagaataccaggaactgttcaggcacatgaaccaaggggatgcggggagtctggctcccagccttgggggacagagcatgacagagcgccaggctttatcttatcaaaatgctgactcttatcaccatcacaccagcccccagcatctgctacaaatcagggcacaagaatgtgtctcacaggcttcctcacccaccccgccccacgggtatgctcaccagccggcactgatgcattcagagagcatggaggaggactgctcgtgtgagggggccaaggatggcttccaagacagtaagagttcaagtacattgaccaaaggttgccatgacagccctctgctcttgagtaccggtggacctggggaccctgaatctttgctaggaactgtgagtcatgcccaagaattggggatacatccctatggtcatcagccaactgctgcattcagtaaaaataaggtgcccagcagagagcctgtcatagggaactgcatggatagaagttctccaggacaagcagtggagctgccggatcacaatgggctcgggtacccagcacgcccctccgtccatgagcaccacaggccccgggccctccagagacaccacacgatccagaacagcgacgatgcttatgtacagctggataacttgccaggaatgagtctcgtggctgggaaagcacttagctctgcccggatgtcggatgcagttctcagtcagtcttcgctcatgggcagccagcagtttcaggatggggaaaatgaggaatgtggggcaagcctgggaggtcatgagcacccagacctgagtgatggcagccagcatttaaactcctcttgctatccatctacgtgtattacagacattctgctcagctacaagcaccccgaagtctccttcagcatggagcaggcaggcgtgtaacaagaaacagagagttttgtgtacagcttgggaatgaaaaggttgattgtaaacccacagtatctagcagcgttgtgccaaattgcccttgtgtttctctccacccaaaatatcacagctgctttcctcacatttggttcatccgtgtgctgttcttttgggttctgagagggttttgccatgtttgcttgtatgaccaagtcaccaaggaaataaacaggaaggaaatccatgttctccatcttttgtgaaagtatatttgagttggtggttttttgttttgtttgggggtttgtgttttgttttgtttttggtatgttttcttccagaggtgatatactttcttttttttcttcctttcttttttttctttcgttccttttttgaaacaggagagcaaagcagttagagttcagaggccagcggcctcagggccactccctccctagccttcatcagcagagcaccctccatccccctgcattgctcttctgtgaaagcaaatactaaaggatgccatcctctggaatcctaatggcaggcaaagggagagaggaagggtgacggcttctggcacttagaaaacaaaaagaacaaaaaaagagaaacccccaagcctggaacgcagagaggtctttactgctgggatccacggaaaacatgtctgtcctagccaagatcatatgaagagtttggcacggaggctgagaatgacctggcatagatggtttgccagttaggatgtctcaatttgagcctttgcttttggtggataactcagctcccctcttgtaacctggaaagttggttgcctttatcatcctgctggttttatccatggactgaacacccaacagcagtgcactatgctttctatggcatctttcattctcattttatattgtgctataaaaaggattgtttctccatatatatattatatatgtgtgtatatatataatataatatatgtgtatatatatattatatatataatatataatataatatattatatatatattatatatataatatatatataaaatatatatatatatgctctcctctttcagcctctttgtcacagggaagaagtgtaggaggttgccttgggccctgcctctctcctaacctcctcttccccactgggtaccctcagcccctatattttaattcttgatcatgtagaaattgtttttggtaaatgttgatattattgttattatcattattaataaataaagagaaaaggaatttttgtttaaatgagaaatgtttaaccagattctgttctatttgaattgtgacttgcaccttttgttcaaagtatttcctttaggcattgtaattgtgaacagctcttacttgtgccagtgacagatgcagtggtctcctttccccagttgaagcagtgcatacgcagtagctattatttgtgttatctttatttctcttcattgttagaaaccaaagtcttctctgctggctggggctgagagagggtctgggttatctccttctgatcttcaaaacaagagagagaccttgaatacactgactcttccaccctttttttttctgggaaaggagagcaagaggtcccgagtcccctcctagtctttcatcctgaatttgcacagaggaaagcgggtgcccggcatggccatcctgatgttgctggcgggatccccatgcaccttgtccttctccactgatactggcagctcggctcctggacccaagatcccttgagtggaattctgcagtgcaagagcccttcgtgggagctgtcccatgtttccatggtccccagtctcccctccacttggtggggtcaccaactactcaccagaagggggcttaccaagaaagccctaaaaagctgttgacttatctgcgcttgttccaactcttatgcccccaacctgccctaccaccaccacgcgctcagcctgatgtgtttacatggtactgtatgtatgggagagcagactgcaccctccagcaacaacagatgaaagccagtgagcctactaaccgtgccatcttgcaaactacactttaaaaaaaactcattgctttgtattgtagtaaccaatatgtgcagtatacgttgaatgtatatgaacatactttcctatttctgttctttgaaaatgtcagaaatatttttttctttctcattttatgttgaactaaaaaggattaaaaaaaaaatctccagactcaagttgctaa

SEQ ID NO: 181703 - DNA, 3858 bp, Homo sapiens
  Payload ID: 15787
  Gene Symbol: SIK3
  Gene Name: SIK family kinase 3
  ENST ID: ENST00000446921
  CDS Start-End: 23-3808
ggaggtttcactgcacaacaagatggcggcggcggcggcgagcggagctggcggggctgccggggccgggactgggggagccgggcccgcgggccgcctgctgcctccgcccgcgccggggtccccagccgcccccgctgccgtgtcccctgcggccggccagccgcgtcccccagccccggcctcccgcggacccatgcccgcccgtatcggctactacgagatcgaccgcaccatcggcaagggcaacttcgcggtggtcaagcgggccacgcacctcgtcaccaaggccaaggttgctatcaagatcatagataagacccagctggatgaagaaaacttgaagaagattttccgggaagttcaaattatgaagatgctttgccacccccatatcatcaggctctaccaggttatggagacagaacggatgatttatctggtgacagaatatgctagtggaggggaaatatttgaccacctggtggcccatggtagaatggcagaaaaggaggcacgtcggaagttcaaacagatcgtcacagctgtctatttttgtcactgtcggaacattgttcatcgtgatttaaaagctgaaaatttacttctggatgccaatctgaatatcaaaatagcagattttggtttcagtaacctcttcactcctgggcagctgctgaagacctggtgtggcagccctccctatgctgcacctgaactctttgaaggaaaagaatatgatgggcccaaagtggacatctggagccttggagttgtcctctacgtgcttgtgtgcggtgccctgccatttgatggaagcacactgcagaatctgcgggcccgcgtgctgagtggaaagttccgcatcccattttttatgtccacagaatgtgagcatttgatccgccatatgttggtgttagatcccaataagcgcctctccatggagcagatctgcaagcacaagtggatgaagctaggggacgccgatcccaactttgacaggttaatagctgaatgccaacaactaaaggaagaaagacaggtggaccccctgaatgaggatgtcctcttggccatggaggacatgggactggacaaagaacagacactgcaggcggagcaggcaggtactgctatgaacatcagcgttccccaggtgcagctgatcaacccagagaaccaaattgtggagccggatgggacactgaatttggacagtgatgagggtgaagagccttcccctgaagcattggtgcgctatttgtcaatgaggaggcacacagtgggtgtggctgacccacgcacggaagttatggaagatctgcagaagctcctacctggctttcctggagtcaacccccaggctccattcctgcaggtggcccctaatgtgaacttcatgcacaacctgttgcctatgcaaaacttgcaaccaaccgggcaacttgagtacaaggagcagtctctcctacagccgcccacgctacagctgttgaatggaatgggcccccttggccggagggcatcagatggaggagccaacatccaactgcatgcccagcagctgctgaagcgcccacggggaccctctccgcttgtcaccatgacaccagcagtgccagcagttacccctgtggacgaggagagctcagacggggagccagaccaggaagctgtgcagaggtacttggcaaataggtccaaaagacatacactggccatgaccaaccctacagctgagatcccaccggacctacaacggcagctaggacagcagcctttccgttcccgggtctggcctcctcacctggtacctgatcagcatcgctctacctacaaggactccaacactctgcacctccctacggagcgtttctcccctgtgcgccggttctcagatggggctgcgagcatccaggccttcaaagctcacctggaaaaaatgggcaacaacagcagcatcaaacagctgcagcaggagtgtgagcagctgcagaagatgtacggggggcagattgatgaaagaaccctggagaagacccagcagcagcatatgttataccagcaggagcagcaccatcaaattctccagcaacaaattcaagactctatctgtcctcctcagccatctccacctcttcaggctgcatgtgaaaatcagccagccctccttacccatcagctccagaggttaaggattcagccttcaagcccaccccccaaccaccccaacaaccatctcttcaggcagcccagtaatagtcctccccccatgagcagtgccatgatccagcctcacggggctgcatcttcttcccagtttcaaggcttaccttcccgcagtgcaatctttcagcagcaacctgagaactgttcctctcctcccaacgtggcactaacctgcttgggtatgcagcagcctgctcagtcacagcaggtcaccatccaagtccaagagcctgttgacatgctcagcaacatgccaggcacagctgcaggctccagtgggcgcggcatctccatcagccccagtgctggtcagatgcagatgcagcaccgtaccaacctgatggccaccctcagctatgggcaccgtcccttgtccaagcagctgagtgctgacagtgcagaggctcacagtgcacatcagcagccgccacactataccacgtcggcactacagcaggccctgctgtctcccacgccgccagactatacaagacaccagcaggtaccccacatccttcaaggactgctttctccccggcattcgctcaccggccactcggacatccggctgcccccaacagagtttgcacagctcattaaaaggcagcagcaacaacggcagcagcagcagcaacagcagcaacagcaagaataccaggaactgttcaggcacatgaaccaaggggatgcggggagtctggctcccagccttgggggacagagcatgacagagcgccaggctttatcttatcaaaatgctgactcttatcaccatcacaccagcccccagcatctgctacaaatcagggcacaagaatgtgtctcacaggcttcctcacccaccccgccccacgggtatgctcaccagccggcactgatgcattcagagagcatggaggaggactgctcgtgtgagggggccaaggatggcttccaagacagtaagagttcaagtacattgaccaaaggttgccatgacagccctctgctcttgagtaccggtggacctggggaccctgaatctttgctaggaactgtgagtcatgcccaagaattggggatacatccctatggtcatcagccaactgctgcattcagtaaaaataaggtgcccagcagagagcctgtcatagggaactgcatggatagaagttctccaggacaagcagtggagctgccggatcacaatgggctcgggtacccagcacgcccctccgtccatgagcaccacaggccccgggccctccagagacaccacacgatccagaacagcgacgatgcttatgtacagctggataacttgccaggaatgagtctcgtggctgggaaagcacttagctctgcccggatgtcggatgcagttctcagtcagtcttcgctcatgggcagccagcagtttcaggatggggaaaatgaggaatgtggggcaagcctgggaggtcatgagcacccagacctgagtgatggcagccagcatttaaactcctcttgctatccatctacgtgtattacagacattctgctcagctacaagcaccccgaagtctccttcagcatggagcaggcaggcgtgtaacaagaaacagagagttttgtgtacagcttgggaatgaaaaggttgattgt

SEQ ID NO: 181704 - DNA, 6331 bp, Homo sapiens
  Payload ID: 15787
  Gene Symbol: SIK3
  Gene Name: SIK family kinase 3
  ENST ID: ENST00000445177
  CDS Start-End: 1-4090
cggagctggcggggctgccggggccgggactgggggagccgggcccgcgggccgcctgctgcctccgcccgcgccggggtccccagccgcccccgctgccgtgtcccctgcggccggccagccgcgtcccccagccccggcctcccgcggacccatgcccgcccgtatcggctactacgagatcgaccgcaccatcggcaagggcaacttcgcggtggtcaagcgggccacgcacctcgtcaccaaggccaaggttgctatcaagatcatagataagacccagctggatgaagaaaacttgaagaagattttccgggaagttcaaattatgaagatgctttgccacccccatatcatcaggctctaccaggttatggagacagaacggatgatttatctggtgacagaatatgctagtggaggggaaatatttgaccacctggtggcccatggtagaatggcagaaaaggaggcacgtcggaagttcaaacagatcgtcacagctgtctatttttgtcactgtcggaacattgttcatcgtgatttaaaagctgaaaatttacttctggatgccaatctgaatatcaaaatagcagattttggtttcagtaacctcttcactcctgggcagctgctgaagacctggtgtggcagccctccctatgctgcacctgaactctttgaaggaaaagaatatgatgggcccaaagtggacatctggagccttggagttgtcctctacgtgcttgtgtgcggtgccctgccatttgatggaagcacactgcagaatctgcgggcccgcgtgctgagtggaaagttccgcatcccattttttatgtccacagaatgtgagcatttgatccgccatatgttggtgttagatcccaataagcgcctctccatggagcagatctgcaagcacaagtggatgaagctaggggacgccgatcccaactttgacaggttaatagctgaatgccaacaactaaaggaagaaagacaggtggaccccctgaatgaggatgtcctcttggccatggaggacatgggactggacaaagaacagacactgcagtcattaagatcagatgcctatgatcactatagtgcaatctacagcctgctgtgtgatcgacataagagacataaaaccctgcgtctcggagcacttcctagcatgccccgagccctggcctttcaagcaccagtcaatatccaggcggagcaggcaggtactgctatgaacatcagcgttccccaggtgcagctgatcaacccagagaaccaaattgtggagccggatgggacactgaatttggacagtgatgagggtgaagagccttcccctgaagcattggtgcgctatttgtcaatgaggaggcacacagtgggtgtggctgacccacgcacggaagttatggaagatctgcagaagctcctacctggctttcctggagtcaacccccaggctccattcctgcaggtggcccctaatgtgaacttcatgcacaacctgttgcctatgcaaaacttgcaaccaaccgggcaacttgagtacaaggagcagtctctcctacagccgcccacgctacagctgttgaatggaatgggcccccttggccggagggcatcagatggaggagccaacatccaactgcatgcccagcagctgctgaagcgcccacggggaccctctccgcttgtcaccatgacaccagcagtgccagcagttacccctgtggacgaggagagctcagacggggagccagaccaggaagctgtgcagaggtacttggcaaataggtccaaaagacatacactggccatgaccaaccctacagctgagatcccaccggacctacaacggcagctaggacagcagcctttccgttcccgggtctggcctcctcacctggtacctgatcagcatcgctctacctacaaggactccaacactctgcacctccctacggagcgtttctcccctgtgcgccggttctcagatggggctgcgagcatccaggccttcaaagctcacctggaaaaaatgggcaacaacagcagcatcaaacagctgcagcaggagtgtgagcagctgcagaagatgtacggggggcagattgatgaaagaaccctggagaagacccagcagcagcatatgttataccagcaggagcagcaccatcaaattctccagcaacaaattcaagactctatctgtcctcctcagccatctccacctcttcaggctgcatgtgaaaatcagccagccctccttacccatcagctccagaggttaaggattcagccttcaagcccaccccccaaccaccccaacaaccatctcttcaggcagcccagtaatagtcctccccccatgagcagtgccatgatccagcctcacggggctgcatcttcttcccagtttcaaggcttaccttcccgcagtgcaatctttcagcagcaacctgagaactgttcctctcctcccaacgtggcactaacctgcttgggtatgcagcagcctgctcagtcacagcaggtcaccatccaagtccaagagcctgttgacatgctcagcaacatgccaggcacagctgcaggctccagtgggcgcggcatctccatcagccccagtgctggtcagatgcagatgcagcaccgtaccaacctgatggccaccctcagctatgggcaccgtcccttgtccaagcagctgagtgctgacagtgcagaggctcacagcttgaacgtgaatcggttctcccctgctaactacgaccaggcgcatttacacccccatctgttttcggaccagtcccggggttcccccagcagctacagcccttcaacaggagtggggttctctccaacccaagccctgaaagtccctccacttgaccaattccccaccttccctcccagtgcacatcagcagccgccacactataccacgtcggcactacagcaggccctgctgtctcccacgccgccagactatacaagacaccagcaggtaccccacatccttcaaggactgctttctccccggcattcgctcaccggccactcggacatccggctgcccccaacagagtttgcacagctcattaaaaggcagcagcaacaacggcagcagcagcagcaacagcagcaacagcaagaataccaggaactgttcaggcacatgaaccaaggggatgcggggagtctggctcccagccttgggggacagagcatgacagagcgccaggctttatcttatcaaaatgctgactcttatcaccatcacaccagcccccagcatctgctacaaatcagggcacaagaatgtgtctcacaggcttcctcacccaccccgccccacgggtatgctcaccagccggcactgatgcattcagagagcatggaggaggactgctcgtgtgagggggccaaggatggcttccaagacagtaagagttcaagtacattgaccaaaggttgccatgacagccctctgctcttgagtaccggtggacctggggaccctgaatctttgctaggaactgtgagtcatgcccaagaattggggatacatccctatggtcatcagccaactgctgcattcagtaaaaataaggtgcccagcagagagcctgtcatagggaactgcatggatagaagttctccaggacaagcagtggagctgccggatcacaatgggctcgggtacccagcacgcccctccgtccatgagcaccacaggccccgggccctccagagacaccacacgatccagaacagcgacgatgcttatgtacagctggataacttgccaggaatgagtctcgtggctgggaaagcacttagctctgcccggatgtcggatgcagttctcagtcagtcttcgctcatgggcagccagcagtttcaggatggggaaaatgaggaatgtggggcaagcctgggaggtcatgagcacccagacctgagtgatggcagccagcatttaaactcctcttgctatccatctacgtgtattacagacattctgctcagctacaagcaccccgaagtctccttcagcatggagcaggcaggcgtgtaacaagaaacagagagttttgtgtacagcttgggaatgaaaaggttgattgtaaacccacagtatctagcagcgttgtgccaaattgcccttgtgtttctctccacccaaaatatcacagctgctttcctcacatttggttcatccgtgtgctgttcttttgggttctgagagggttttgccatgtttgcttgtatgaccaagtcaccaaggaaataaacaggaaggaaatccatgttctccatcttttgtgaaagtatatttgagttggtggttttttgttttgtttgggggtttgtgttttgttttgtttttggtatgttttcttccagaggtgatatactttcttttttttcttcctttcttttttttctttcgttccttttttgaaacaggagagcaaagcagttagagttcagaggccagcggcctcagggccactccctccctagccttcatcagcagagcaccctccatccccctgcattgctcttctgtgaaagcaaatactaaaggatgccatcctctggaatcctaatggcaggcaaagggagagaggaagggtgacggcttctggcacttagaaaacaaaaagaacaaaaaaagagaaacccccaagcctggaacgcagagaggtctttactgctgggatccacggaaaacatgtctgtcctagccaagatcatatgaagagtttggcacggaggctgagaatgacctggcatagatggtttgccagttaggatgtctcaatttgagcctttgcttttggtggataactcagctcccctcttgtaacctggaaagttggttgcctttatcatcctgctggttttatccatggactgaacacccaacagcagtgcactatgctttctatggcatctttcattctcattttatattgtgctataaaaaggattgtttctccatatatatattatatatgtgtgtatatatataatataatatatgtgtatatatatattatatatataatatataatataatatattatatatatattatatatataatatatatataaaatatatatatatatgctctcctctttcagcctctttgtcacagggaagaagtgtaggaggttgccttgggccctgcctctctcctaacctcctcttccccactgggtaccctcagcccctatattttaattcttgatcatgtagaaattgtttttggtaaatgttgatattattgttattatcattattaataaataaagagaaaaggaatttttgtttaaatgagaaatgtttaaccagattctgttctatttgaattgtgacttgcaccttttgttcaaagtatttcctttaggcattgtaattgtgaacagctcttacttgtgccagtgacagatgcagtggtctcctttccccagttgaagcagtgcatacgcagtagctattatttgtgttatctttatttctcttcattgttagaaaccaaagtcttctctgctggctggggctgagagagggtctgggttatctccttctgatcttcaaaacaagagagagaccttgaatacactgactcttccaccctttttttttctgggaaaggagagcaagaggtcccgagtcccctcctagtctttcatcctgaatttgcacagaggaaagcgggtgcccggcatggccatcctgatgttgctggcgggatccccatgcaccttgtccttctccactgatactggcagctcggctcctggacccaagatcccttgagtggaattctgcagtgcaagagcccttcgtgggagctgtcccatgtttccatggtccccagtctcccctccacttggtggggtcaccaactactcaccagaagggggcttaccaagaaagccctaaaaagctgttgacttatctgcgcttgttccaactcttatgcccccaacctgccctaccaccaccacgcgctcagcctgatgtgtttacatggtactgtatgtatgggagagcagactgcaccctccagcaacaacagatgaaagccagtgagcctactaaccgtgccatcttgcaaactacactttaaaaaaaactcattgctttgtattgtagtaaccaatatgtgcagtatacgttgaatgtatatgaacatactttcctatttctgttctttgaaaatgtcagaaatatttttttctttctcattttatgttgaactaaaaaggattaaaaaaaaaatctccagactcaagttgctaa

SEQ ID NO: 181705 - DNA, 3816 bp, Homo sapiens
  Payload ID: 15787
  Gene Symbol: SIK3
  Gene Name: SIK family kinase 3
  ENST ID: ENST00000415541
  CDS Start-End: 1-456
cgtcccccagccccggcctcccgcggacccatgcccgcccgtatcggctactacgagatcgaccgcaccatcggcaagggcaacttcgcggtggtcaagcgggccacgcacctcgtcaccaaggccaaggttgctatcaagatcatagataagacccagctggatgaagaaaacttgaagaagattttccgggaagttcaaattatgaagatgctttgccacccccatatcatcaggctctaccaggttatggagacagaacggatgatttatctggtgacagaatatgctagtggaggggaaatatttggaggatttggacatcagcaattctcattctgccccgagctgcctattgctgagtcctggagaagtgcagttaagagatgggggccccttcttctactcagcccccacttgtggaacttgatcagaccacctggtggcccatggtagaatggcagaaaaggaggcacgtcggaagttcaaacagatcgtcacagctgtctatttttgtcactgtcggaacattgttcatcgtgatttaaaagctgaaaatttacttctggatgccaatctgaatatcaaaatagcagattttggtttcagtaacctcttcactcctgggcagctgctgaagacctggtgtggcagccctccctatgctgcacctgaactctttgaaggaaaagaatatgatgggcccaaagtggacatctggagccttggagttgtcctctacgtgcttgtgtgcggtgccctgccatttgatggaagcacactgcagaatctgcgggcccgcgtgctgagtggaaagttccgcatcccattttttatgtccacagaatgtgagcatttgatccgccatatgttggtgttagatcccaataagcgcctctccatggagcagatctgcaagcacaagtggatgaagctaggggacgccgatcccaactttgacaggttaatagctgaatgccaacaactaaaggaagaaagacaggtggaccccctgaatgaggatgtcctcttggccatggaggacatgggactggacaaagaacagacactgcagtcattaagatcagatgcctatgatcactatagtgcaatctacagcctgctgtgtgatcgacataagagacataaaaccctgcgtctcggagcacttcctagcatgccccgagccctggcctttcaagcaccagtcaatatccaggcggagcaggcaggtactgctatgaacatcagcgttccccaggtgcagctgatcaacccagagaaccaaattgtggagccggatgggacactgaatttggacagtgatgagggtgaagagccttcccctgaagcattggtgcgctatttgtcaatgaggaggcacacagtgggtgtggctgacccacgcacggaagttatggaagatctgcagaagctcctacctggctttcctggagtcaacccccaggctccattcctgcaggtggcccctaatgtgaacttcatgcacaacctgttgcctatgcaaaacttgcaaccaaccgggcaacttgagtacaaggagcagtctctcctacagccgcccacgctacagctgttgaatggaatgggcccccttggccggagggcatcagatggaggagccaacatccaactgcatgcccagcagctgctgaagcgcccacggggaccctctccgcttgtcaccatgacaccagcagtgccagcagttacccctgtggacgaggagagctcagacggggagccagaccaggaagctgtgcagagctctacctacaaggactccaacactctgcacctccctacggagcgtttctcccctgtgcgccggttctcagatggggctgcgagcatccaggccttcaaagctcacctggaaaaaatgggcaacaacagcagcatcaaacagctgcagcaggagtgtgagcagctgcagaagatgtacggggggcagattgatgaaagaaccctggagaagacccagcagcagcatatgttataccagcaggagcagcaccatcaaattctccagcaacaaattcaagactctatctgtcctcctcagccatctccacctcttcaggctgcatgtgaaaatcagccagccctccttacccatcagctccagaggttaaggattcagccttcaagcccaccccccaaccaccccaacaaccatctcttcaggcagcccagtaatagtcctccccccatgagcagtgccatgatccagcctcacggggctgcatcttcttcccagtttcaaggcttaccttcccgcagtgcaatctttcagcagcaacctgagaactgttcctctcctcccaacgtggcactaacctgcttgggtatgcagcagcctgctcagtcacagcaggtcaccatccaagtccaagagcctgttgacatgctcagcaacatgccaggcacagctgcaggctccagtgggcgcggcatctccatcagccccagtgctggtcagatgcagatgcagcaccgtaccaacctgatggccaccctcagctatgggcaccgtcccttgtccaagcagctgagtgctgacagtgcagaggctcacagtgcacatcagcagccgccacactataccacgtcggcactacagcaggccctgctgtctcccacgccgccagactatacaagacaccagcaggtaccccacatccttcaaggactgctttctccccggcattcgctcaccggccactcggacatccggctgcccccaacagagtttgcacagctcattaaaaggcagcagcaacaacggcagcagcagcagcaacagcagcaacagcaagaataccaggaactgttcaggcacatgaaccaaggggatgcggggagtctggctcccagccttgggggacagagcatgacagagcgccaggctttatcttatcaaaatgctgactcttatcaccatcacaccagcccccagcatctgctacaaatcagggcacaagaatgtgtctcacaggcttcctcacccaccccgccccacgggtatgctcaccagccggcactgatgcattcagagagcatggaggaggactgctcgtgtgagggggccaaggatggcttccaagacagtaagagttcaagtacattgaccaaaggttgccatgacagccctctgctcttgagtaccggtggacctggggaccctgaatctttgctaggaactgtgagtcatgcccaagaattggggatacatccctatggtcatcagccaactgctgcattcagtaaaaataaggtgcccagcagagagcctgtcatagggaactgcatggatagaagttctccaggacaagcagtggagctgccggatcacaatgggctcgggtacccagcacgcccctccgtccatgagcaccacaggccccgggccctccagagacaccacacgatccagaacagcgacgatgcttatgtacagctggataacttgccaggaatgagtctcgtggctgggaaagcacttagctctgcccggatgtcggatgcagttctcagtcagtcttcgctcatgggcagccagcagtttcaggatggggaaaatgaggaatgtggggcaagcctgggaggtcatgagcacccagacctgagtgatggcagccagcatttaaactcctcttgctatccatctacgtgtattacagacattctgctcagctacaagcaccccgaagtctccttcagcatggagcaggcaggcgtgtaacaagaaacagagagttttgtgtacagcttgggaatgaaaaggttgattgt

SEQ ID NO: 181706 - DNA, 294 bp, Homo sapiens
  Payload ID: 15787
  Gene Symbol: SIK3
  Gene Name: SIK family kinase 3
  ENST ID: ENST00000454905
  CDS Start-End: 1-214
gaacagcgacgatgcttatgtacagctggataacttgccaggaatgagtctcgtggctgggaaagcacttagctctgcccggatgtcggatgcagttctcagtcagtcttcgctcatgggcagccagcagtttcaggatggggaaaatgaggacattctgctcagctacaagcaccccgaagtctccttcagcatggagcaggcaggcgtgtaacaagaaacagagagagagcaaagcagttagagttcagaggccagcggcctcagggccactccctccctagccttcatcag

SEQ ID NO: 181707 - DNA, 3054 bp, Homo sapiens
  Payload ID: 15787
  Gene Symbol: SIK3
  Gene Name: SIK family kinase 3
  ENST ID: ENST00000413553
  CDS Start-End: 1-1519
taagacccagctggatgaagaaaacttgaagaagattttccgggaagttcaaattatgaagatgctttgccacccccatatcatcaggctctaccaggttatggagacagaacggatgatttatctggtgacagaatatgctagtggaggggaaatatttgaccacctggtggcccatggtagaatggcagaaaaggaggcacgtcggaagttcaaacagatcgtcacagctgtctatttttgtcactgtcggaacattgttcatcgtgatttaaaagctgaaaatttacttctggatgccaatctgaatatcaaaatagcagattttggtttcagtaacctcttcactcctgggcagctgctgaagacctggtgtggcagccctccctatgctgcacctgaactctttgaaggaaaagaatatgatgggcccaaagtggacatctggagccttggagttgtcctctacgtgcttgtgtgcggtgccctgccatttgatggaagcacactgcagaatctgcgggcccgcgtgctgagtggaaagttccgcatcccattttttatgtccacagaatgtgagcatttgatccgccatatgttggtgttagatcccaataagcgcctctccatggagcagatctgcaagcacaagtggatgaagctaggggacgccgatcccaactttgacaggttaatagctgaatgccaacaactaaaggaagaaagacaggtggaccccctgaatgaggatgtcctcttggccatggaggacatgggactggacaaagaacagacactgcagtcattaagatcagatgcctatgatcactatagtgcaatctacagcctgctgtgtgatcgacataagagacataaaaccctgcgtctcggagcacttcctagcatgccccgagccctggcctttcaagcaccagtcaatatccaggcggagcaggcaggtactgctatgaacatcagcgttccccaggtgcagctgatcaacccagagaaccaaattgtggagccggatgggacactgaatttggacagtgatgagggtgaagagccttcccctgaagcattggtgcgctatttgtcaatgaggaggcacacagtgggtgtggctgacccacgcacggaagttatggaagatctgcagaagctcctacctggctttcctggagtcaacccccaggctccattcctgcaggtggcccctaatgtgaacttcatgcacaacctgttgcctatgcaaaacttgcaaccaaccgggcaacttgagtacaaggagcagtctctcctacagccgcccacgctacagctgttgaatggaatgggcccccttggccggagggcatcagatggaggagccaacatccaactgcatgcccagcagctgctgaagcgcccacggggaccctctccgcttgtcaccatgacaccagcagtgccagcagttacccctgtggacgaggagagctcagacggggagccagaccaggaagctgtgcagaggtaatgtgacatctggcagtgcttgcagaagcccctgggcaggctcccctgcaaccagcgaaaggtcacctctgcccaaggaggtggtagagtgcagcttcaacatttgtgtggtctctttgctcaagccagatggcatgttccaccccacatggaagtaacagaagactacccagaaaatgtcatttctgtaagcaccattggaagtcccctaagtgacagcaataaccataagaactttttctttcctccctccttcttccttgtcccctgccttcatattgcaactctgatagtattcacaaggcacaaagcctgctcgtacctgccaagaactgtttactgaaaaggaattggagatgtgggatgacagtgatcctagctagtctggccatggacctctggcatggacttttcctttccaggagaatgaatacctcttgtactgtttgctgtgtgcttcttccacccccttgtaccaacaaagagatattgaaaaagagaatatgggattcgggccagggacagatgcaaatatccattgtttacagaaccttgttgagagatgcctaactcacagagaacggcagtgaccatcaggcatgctgtactgttcatttggcctcagttccgttagccctggtccttagctccatgcatgcccccttgtgggagttgattttcttattatccggggagggggtttcaccagaatccagcatgtattttcccagaaatacaggtgttcttcaagattatatgttttttcctttgagggaagttgaaataaaatggttttcatgggcttttggggaactttgggtgtctttatccaatggttattaaaacattaatggcttactctttggcaagttcacataacactgattactctacagtctgttaactgattttagctgaaaggggcaagatagttaagaatgaaatgagaccattttttaagaacctgccagttgctggctaggactctcatcctatccccagtagctctgtgtgagagctgctattcagaaagcagctggtcctatgtggaaagaaaaccatggcaaacaggggtgttggcaggtgggccagctccttctacagcttggccaatagaaggaaaattctggtaacttttttttttccttgatgctgttgtttctatagtttgctgataagagggtatataaggttacaaatgggccctactgggtcatgaagaaatgagaaatcaggaaatttactgcctttctaccttaaaagagacagcaatattttatcttctttgtcttagactttccttcctccaggtctaccttctttcttctttagaccaacatttcaagggtataatgcccatcagttttgatgtaataaaaaaggtgtagtgcctcttttattcatgcctccagaagagcagcagcggtggaggaagtcatccaccagacaaagagggacaatatcttattgatggtattaactaagtgctgggtctgaaagatcttccgaataaaagccatcagtttgggaactctt

SEQ ID NO: 181708 - DNA, 1895 bp, Homo sapiens
  Payload ID: 15788
  Gene Symbol: SIL1
  Gene Name: SIL1 nucleotide exchange factor
  Uniprot ID: Q9H173
  ENST ID: ENST00000265195
  CDS Start-End: 147-1532
ctggaattgtgggagttgtgtctgccactcggctgccggaggccgaaggccagctattacttctctactgaggccaactgtgagccctggtgtgtttcattggcaggagaagaggctaattaagtgaaactgaaaggtccctgactatggctccccagagcctgccttcatctaggatggctcctctgggcatgctgcttgggctgctgatggccgcctgcttcaccttctgcctcagtcatcagaacctgaaggagtttgccctgaccaacccagagaagagcagcaccaaagaaacagagagaaaagaaaccaaagccgaggaggagctggatgccgaagtcctggaggtgttccacccgacgcatgagtggcaggcccttcagccagggcaggctgtccctgcaggatcccacgtacggctgaatcttcagactggggaaagagaggcaaaactccaatatgaggacaagttccgaaataatttgaaaggcaaaaggctggatatcaacaccaacacctacacatctcaggatctcaagagtgcactggcaaaattcaaggagggggcagagatggagagttcaaaggaagacaaggcaaggcaggctgaggtaaagcggctcttccgccccattgaggaactgaagaaagactttgatgagctgaatgttgtcattgagactgacatgcagatcatggtacggctgatcaacaagttcaatagttccagctccagtttggaagagaagattgctgcgctctttgatcttgaatattatgtccatcagatggacaatgcgcaggacctgctttcctttggtggtcttcaagtggtgatcaatgggctgaacagcacagagcccctcgtgaaggagtatgctgcgtttgtgctgggcgctgccttttccagcaaccccaaggtccaggtggaggccatcgaagggggagccctgcagaagctgctggtcatcctggccacggagcagccgctcactgcaaagaagaaggtcctgtttgcactgtgctccctgctgcgccacttcccctatgcccagcggcagttcctgaagctcggggggctgcaggtcctgaggaccctggtgcaggagaagggcacggaggtgctcgccgtgcgcgtggtcacactgctctacgacctggtcacggagaagatgttcgccgaggaggaggctgagctgacccaggagatgtccccagagaagctgcagcagtatcgccaggtacacctcctgccaggcctgtgggaacagggctggtgcgagatcacggcccacctcctggcgctgcccgagcatgatgcccgtgagaaggtgctgcagacactgggcgtcctcctgaccacctgccgggaccgctaccgtcaggacccccagctcggcaggacactggccagcctgcaggctgagtaccaggtgctggccagcctggagctgcaggatggtgaggacgagggctacttccaggagctgctgggctctgtcaacagcttgctgaaggagctgagatgaggccccacaccaggactggactgggatgccgctagtgaggctgaggggtgccagcgtgggtgggcttctcaggcaggaggacatcttggcagtgctggcttggccattaaatggaaacctgaaggccatcctctttctgctgtgtgtctgtgtagactgggcacagccctgtggccggggggtcaggtgagtggttgggtgatgggctctgctgacgtgcagggctcagcccagggcatccaggaacaggctccagggcaggaacctgggcccaggagttgcaagtctctgcttcttaccaagcagcagctctgtaccttgggaagtcgcttaattgctctgagcttgtttcctcatctgtca

SEQ ID NO: 181709 - DNA, 1923 bp, Homo sapiens
  Payload ID: 15788
  Gene Symbol: SIL1
  Gene Name: SIL1 nucleotide exchange factor
  Uniprot ID: Q9H173
  ENST ID: ENST00000394817
  CDS Start-End: 141-1526
gcggcgtgacagctgccagctcaccggctcagacggtcgccgccgcgtttgcgcagggggagctggtcgccgccgcggccgcctggaattgtgggagttgtgtctgccactcggctgccggaggccgaaggtccctgactatggctccccagagcctgccttcatctaggatggctcctctgggcatgctgcttgggctgctgatggccgcctgcttcaccttctgcctcagtcatcagaacctgaaggagtttgccctgaccaacccagagaagagcagcaccaaagaaacagagagaaaagaaaccaaagccgaggaggagctggatgccgaagtcctggaggtgttccacccgacgcatgagtggcaggcccttcagccagggcaggctgtccctgcaggatcccacgtacggctgaatcttcagactggggaaagagaggcaaaactccaatatgaggacaagttccgaaataatttgaaaggcaaaaggctggatatcaacaccaacacctacacatctcaggatctcaagagtgcactggcaaaattcaaggagggggcagagatggagagttcaaaggaagacaaggcaaggcaggctgaggtaaagcggctcttccgccccattgaggaactgaagaaagactttgatgagctgaatgttgtcattgagactgacatgcagatcatggtacggctgatcaacaagttcaatagttccagctccagtttggaagagaagattgctgcgctctttgatcttgaatattatgtccatcagatggacaatgcgcaggacctgctttcctttggtggtcttcaagtggtgatcaatgggctgaacagcacagagcccctcgtgaaggagtatgctgcgtttgtgctgggcgctgccttttccagcaaccccaaggtccaggtggaggccatcgaagggggagccctgcagaagctgctggtcatcctggccacggagcagccgctcactgcaaagaagaaggtcctgtttgcactgtgctccctgctgcgccacttcccctatgcccagcggcagttcctgaagctcggggggctgcaggtcctgaggaccctggtgcaggagaagggcacggaggtgctcgccgtgcgcgtggtcacactgctctacgacctggtcacggagaagatgttcgccgaggaggaggctgagctgacccaggagatgtccccagagaagctgcagcagtatcgccaggtacacctcctgccaggcctgtgggaacagggctggtgcgagatcacggcccacctcctggcgctgcccgagcatgatgcccgtgagaaggtgctgcagacactgggcgtcctcctgaccacctgccgggaccgctaccgtcaggacccccagctcggcaggacactggccagcctgcaggctgagtaccaggtgctggccagcctggagctgcaggatggtgaggacgagggctacttccaggagctgctgggctctgtcaacagcttgctgaaggagctgagatgaggccccacaccaggactggactgggatgccgctagtgaggctgaggggtgccagcgtgggtgggcttctcaggcaggaggacatcttggcagtgctggcttggccattaaatggaaacctgaaggccatcctctttctgctgtgtgtctgtgtagactgggcacagccctgtggccggggggtcaggtgagtggttgggtgatgggctctgctgacgtgcagggctcagcccagggcatccaggaacaggctccagggcaggaacctgggcccaggagttgcaagtctctgcttcttaccaagcagcagctctgtaccttgggaagtcgcttaattgctctgagcttgtttcctcatctgtcaggagtgccattaaaggagaaaaatcacgtagaaa

SEQ ID NO: 181710 - DNA, 581 bp, Homo sapiens
  Payload ID: 15788
  Gene Symbol: SIL1
  Gene Name: SIL1 nucleotide exchange factor
  ENST ID: ENST00000507002
  CDS Start-End: 207-581
gtctgccactcggctgccggaggccgaaggccagctattacttctctactgaggccaactgtgagccctggtgtgtttcattggcaggagaagaggctaattaagtgaaactgaaagggcatatctcttgttggatggctggacccaccatggtagatggaggcttcagaattatctagaagtggtagaagactcgttatacctctatgcaggaaatgtctgacatgtccctgactatggctccccagagcctgccttcatctaggatggctcctctgggcatgctgcttgggctgctgatggccgcctgcttcaccttctgcctcagtcatcagaacctgaaggagtttgccctgaccaacccagagaagagcagcaccaaagaaacagagagaaaagaaaccaaagccgaggaggagctggatgccgaagtcctggaggtgttccacccgacgcatgagtggcaggcccttcagccagggcaggctgtccctgcaggatcccacgtacggctgaatcttcagactggggaaagagaggcaaaactccaatatgaggacaagttccgaaataatttgaaa

SEQ ID NO: 181711 - DNA, 442 bp, Homo sapiens
  Payload ID: 15788
  Gene Symbol: SIL1
  Gene Name: SIL1 nucleotide exchange factor
  ENST ID: ENST00000505353
  CDS Start-End: 159-442
ctctctctctctctctctcactctgtgtacgtgtgtgtgtatactgaggaaaggccatgtgaagacatggcaagagggcagccatctgcaagctaagatgagagtcttcagctggaaccttgatcttggacttctggccttcagaattgtccctgactatggctccccagagcctgccttcatctaggatggctcctctgggcatgctgcttgggctgctgatggccgcctgcttcaccttctgcctcagtcatcagaacctgaaggagtttgccctgaccaacccagagaagagcagcaccaaagaaacagagagaaaagaaaccaaagccgaggaggagctggatgccgaagtcctggaggtgttccacccgacgcatgagtggcaggcccttcagccagggcaggctgtccctgcaggatcccacgtacggctgaatct

SEQ ID NO: 181712 - DNA, 572 bp, Homo sapiens
  Payload ID: 15788
  Gene Symbol: SIL1
  Gene Name: SIL1 nucleotide exchange factor
  ENST ID: ENST00000513453
  CDS Start-End: 203-572
cacacccagggatggccagtcacctatccagagcctggtgtggtgctgtgaactcaatccctgtctttcagtgtgattggtgccccagggagccaggttgctgggggaagctctcgtggcactcagccgttccattttgtcggcaaaaaaagagggggggagctggcagaaagctaaggcttttgctgctgggtccctgactatggctccccagagcctgccttcatctaggatggctcctctgggcatgctgcttgggctgctgatggccgcctgcttcaccttctgcctcagtcatcagaacctgaaggagtttgccctgaccaacccagagaagagcagcaccaaagaaacagagagaaaagaaaccaaagccgaggaggagctggatgccgaagtcctggaggtgttccacccgacgcatgagtggcaggcccttcagccagggcaggctgtccctgcaggatcccacgtacggctgaatcttcagactggggaaagagaggcaaaactccaatatgaggacaagttccgaaataatttgaaaggcaaaaggctggatatcaacacca

SEQ ID NO: 181713 - DNA, 250 bp, Homo sapiens
  Payload ID: 15788
  Gene Symbol: SIL1
  Gene Name: SIL1 nucleotide exchange factor
  ENST ID: ENST00000505945
  CDS Start-End: 1-250
ctcaagagtgcactggcaaaattcaaggagggggcagagatggagagttcaaaggaagacaagatggacaatgcgcaggacctgctttcctttggtggtcttcaagtggtgatcaatgggctgaacagcacagagcccctcgtgaaggagtatgctgcgtttgtgctgggcgctgccttttccagcaaccccaaggtccaggtggaggccatcgaagggggagccctgcagaagctgctggtcatcctgg

SEQ ID NO: 181714 - DNA, 496 bp, Homo sapiens
  Payload ID: 15788
  Gene Symbol: SIL1
  Gene Name: SIL1 nucleotide exchange factor
  ENST ID: ENST00000505830
  CDS Start-End: 126-496
gagttgtgtctgccactcggctgccggaggccgaagggcatatctcttgttggatggctggacccaccatggtagatggaggcttcagaattatctagaagtggtagaagactcgttatacctctatgcaggaaatgtctgacatgtccctgactatggctccccagagcctgccttcatctaggatggctcctctgggcatgctgcttgggctgctgatggccgcctgcttcaccttctgcctcagtcatcagaacctgaaggagtttgccctgaccaacccagagaagagcagcaccaaagaaacagagagaaaagaaaccaaagccgaggaggagctggatgccgaagtcctggaggtgttccacccgacgcatgagtggcaggcccttcagccagggcaggctgtccctgcaggatcccacgtacggctgaatcttcagactggggaaagagaggcaaaactccaatatgaggacaagttccgaaataattt

SEQ ID NO: 181715 - DNA, 1714 bp, Homo sapiens
  Payload ID: 15788
  Gene Symbol: SIL1
  Gene Name: SIL1 nucleotide exchange factor
  ENST ID: ENST00000509534
  CDS Start-End: 214-1620
attacttctctactgaggccaactgtgagccctggtgtgtttcattggcaggagaagaggctaattaagtgaaactgaaagaacaaataaaatgatgagtccagtttctgtggctgatttcacagacccctcgagagacagcacggctatggaaagagcatggctttggggccaaactggctttgaattctgactctactgctctgtggctgcatgaactctggcacgtccctgactatggctccccagagcctgccttcatctaggatggctcctctgggcatgctgcttgggctgctgatggccgcctgcttcaccttctgcctcagtcatcagaacctggagtttgccctgaccaacccagagaagagcagcaccaaagaaacagagagaaaagaaaccaaagccgaggaggagctggatgccgaagtcctggaggtgttccacccgacgcatgagtggcaggcccttcagccagggcaggctgtccctgcaggatcccacgtacggctgaatcttcagactggggaaagagaggcaaaactccaatatgaggacaagttccgaaataatttgaaaggcaaaaggctggatatcaacaccaacacctacacatctcaggatctcaagagtgcactggcaaaattcaaggagggggcagagatggagagttcaaaggaagacaaggcaaggcaggctgaggtaaagcggctcttccgccccattgaggaactgaagaaagactttgatgagctgaatgttgtcattgagactgacatgcagatcatggtacggctgatcaacaagttcaatagttccagctccagtttggaagagaagattgctgcgctctttgatcttgaatattatgtccatcagatggacaatgcgcaggacctgctttcctttggtggtcttcaagtggtgatcaatgggctgaacagcacagagcccctcgtgaaggagtatgctgcgtttgtgctgggcgctgccttttccagcaaccccaaggtccaggtggaggccatcgaagggggagccctgcagaagctgctggtcatcctggccacggagcagccgctcactgcaaagaagaaggtcctgtttgcactgtgctccctgctgcgccacttcccctatgcccagcggcagttcctgaagctcggggggctgcaggtcctgaggaccctggtgcaggagaagggcacggaggtgctcgccgtgcgcgtggtcacactgctctacgacctggtcacggagaagatgttcgccgaggaggaggctgagctgacccaggagatgtccccagagaagctgcagcagtatcgccaggtacacctcctgccaggcctgtgggaacagggctggtgcgagatcacggcccacctcctggcgctgcccgagcatgatgcccgtgagaaggtgctgcagacactgggcgtcctcctgaccacctgccgggaccgctaccgtcaggacccccagctcggcaggacactggccagcctgcaggctgagtaccaggtgctggccagcctggagctgcaggatggtgaggacgagggctacttccaggagctgctgggctctgtcaacagcttgctgaaggagctgagatgaggccccacaccaggactggactgggatgccgctagtgaggctgaggggtgccagcgtgggtgggcttctcaggcaggaggacatcttggcagtg

SEQ ID NO: 181716 - DNA, 675 bp, Homo sapiens
  Payload ID: 15788
  Gene Symbol: SIL1
  Gene Name: SIL1 nucleotide exchange factor
  ENST ID: ENST00000508639
  CDS Start-End: 187-675
gggagttgtgtctgccactcggctgccggaggccgaagggcccaatccccacccccagtcttgtctgaattgtgtggaagacatgaggcactgagagaggtgggggccgagtggcctcctcccacctgctccccaaacatctgctctgggctgcagtaagctggcaatacagattggtccctgactatggctccccagagcctgccttcatctaggatggctcctctgggcatgctgcttgggctgctgatggccgcctgcttcaccttctgcctcagtcatcagaacctgaaggagtttgccctgaccaacccagagaagagcagcaccaaagaaacagagagaaaagaaaccaaagccgaggaggagctggatgccgaagtcctggaggtgttccacccgacgcatgagtggcaggcccttcagccagggcaggctgtccctgcaggatcccacgtacggctgaatcttcagactggggaaagagaggcaaaactccaatatgaggacaagttccgaaataatttgaaaggcaaaaggctggatatcaacaccaacacctacacatctcaggatctcaagagtgcactggcaaaattcaaggagggggcagagatggagagttcaaaggaagacaaggcaaggcaggctgaggtaaagcggctcttccgcccc

SEQ ID NO: 181717 - DNA, 5050 bp, Homo sapiens
  Payload ID: 15789
  Gene Symbol: SIN3A
  Gene Name: SIN3 transcription regulator family member A
  Uniprot ID: Q96ST3
  ENST ID: ENST00000360439
  CDS Start-End: 183-4004
gttaaacagctgcttttaatttggtccccccaatctcaggcgtttggggggctagtccgccggccgctcggtctggccggcccgacgtggtgtgggccctgcgggccctgggaccgagctgaggggaggctcggagttccgcggccgaggttttgtagtgcatccctgagcatgagcacagaatgaagcggcgtttggatgaccaggagtcaccggtgtatgcagcccagcagcgtcggatccctggcagcacagaggcttttcctcaccagcaccgggtgcttgcccctgcccctcctgtgtatgaagcagtgtctgagaccatgcagtcagctacgggaattcagtactctgtaacacccagctaccaggtttcagccatgccacagagctccggcagtcatgggcccgctatagcagcagttcatagcagccatcatcacccaacagcggtgcagccccacggaggccaggtggtccagagtcatgctcatccagccccaccagttgcaccagtgcagggacagcagcaatttcagaggctgaaggtggaggatgcgctatcttatcttgaccaggtgaagctgcagtttggtagtcagcctcaggtctacaatgatttccttgacatcatgaaggaatttaaatctcagagcatcgacaccccaggagtgattagtcgtgtgtcccagctattcaaaggccaccccgatctgataatgggattcaacaccttcttgccccctggctacaaaattgaggtgcaaaccaatgacatggtgaatgtgacaactcctggccaggttcatcagattcccacccatggcatccagccacagcctcaaccaccaccccaacatccttcccagccttcagcccagtcagccccagctcctgcccagccagctcctcagcccccacctgccaaagtcagcaagccctcccaactgcaagcacatactccggccagtcagcagactcccccacttccaccgtatgcatccccacgttctccgccggtccagcctcacacaccagtgacaatctcgttgggaacggccccatccttgcagaacaatcaacctgtggagtttaatcatgccatcaactatgttaataagatcaagaacagatttcagggccaaccagacatctacaaagcattcctggagattttgcacacatatcagaaagagcagagaaatgccaaggaagctggaggaaactacactccagcattgacagagcaggaggtgtatgcccaggttgctcgtctctttaaaaaccaggaagatttgttgtcagagtttggacaattcctaccagatgccaacagctccgtgcttttaagcaaaacaactgctgagaaggttgattctgtgagaaatgatcatggaggcactgtcaagaagccccaactgaacaacaagccgcagaggcccagccagaatggctgccagatccgcagacatcctacaggaaccacccctccagttaagaagaaacccaaactgctcaatctgaaggattcttctatggcagatgccagcaaacatggtggtggaacagaatcgttattttttgataaggtccgaaaggctcttcggagtgcagaagcctacgaaaatttcctacgctgtcttgttatttttaaccaggaggtgatctctcgtgctgagcttgtgcaactagtctctcctttcctggggaaattccctgagttgtttaattggtttaaaaactttctgggctataaggagtctgtacatctggaaacttatccaaaggagcgagccacagagggcattgctatggagatagattatgcttcttgtaaacgattgggctccagctatcgagccttaccaaagagttaccagcagcccaagtgtacaggacggactcctctctgtaaagaggttttaaatgatacctgggtttccttcccttcgtggtctgaggactctacctttgtgagttccaagaagactcaatatgaagaacatatttatcgttgtgaagatgaacgctttgagcttgatgtagttttagagaccaatctggcaacaatccgggttctggaagcaatacagaagaagctttcccgcttgtctgctgaagaacaagccaaatttcgcttggacaacacccttgggggcacatcagaagtcatccatagaaaagcactccagaggatatatgctgataaagcagctgacatcattgatggtctgagaaagaatccctccattgctgttccaattgtccttaaaaggttgaagatgaaagaggaagaatggcgagaagctcagagaggctttaacaaagtatggcgagaacaaaatgagaaatactacttgaagtctctggaccaccaggggatcaactttaaacagaatgacaccaaggtcctgaggtctaagagcttactcaatgagattgagagtatctatgatgagaggcaagagcaggctacggaggagaatgctggtgtacctgttggcccacacctctcacttgcgtatgaagacaaacaaatactggaagatgctgctgctctgattatccaccatgtgaagaggcagacaggcattcagaaggaggacaaatataagataaaacaaatcatgcatcattttattccagatttgctctttgcccaaagaggtgatctctcagatgtggaggaagaggaagaagaagagatggatgtagatgaagccacaggggcagttaagaagcacaatggtgttgggggcagtccccctaagtccaagttactgtttagtaacacagcagctcaaaaattaagaggaatggatgaagtatacaacctcttctatgtcaacaacaactggtatatttttatgcgactgcaccagattctctgcctgaggctgctacggatttgttcccaagccgaacggcaaattgaagaagaaaaccgagagagagaatgggaacgggaagtgctgggcataaagcgagacaagagtgacagccctgccattcagctacgtctcaaagaacctatggatgttgatgtagaagattattacccagctttcctggacatggtgcggagcctgctggatggcaacatagactcatcacagtatgaagattcactgagagagatgttcaccattcatgcctacattgcctttaccatggacaaactgatccagagcattgtcagacagctgcagcatatcgtgagtgatgagatctgtgtgcaggtgactgacctttacctggcagaaaataataatggggccaccggaggccagctgaacacacagaactcaaggagcctcctggagtcaacgtatcagcggaaagctgagcagctaatgtcagatgagaattgctttaagcttatgtttattcagagccaaggccaggtccagctgactattgagcttctggacacagaagaggagaattcggatgaccctgtggaagcagagcgctggtcagactacgtggagcgatacatgaattcagatactacctcgcctgagcttcgtgaacatctagcacagaaaccagtatttctccccaggaatctacggcggatccggaagtgtcaacgtggtcgagagcagcaggaaaaggaagggaaggaaggaaacagcaagaagaccatggagaatgtggatagtctggataagctggagtgtagattcaagctgaattcctacaagatggtgtatgtgatcaaatcagaggactatatgtatcggaggaccgccctgctccgggctcatcagtcccatgagcgtgtaagcaagcgtctacatcagagattccaggcctgggtagataaatggaccaaggagcatgtgccccgtgaaatggcagcagagaccagcaagtggctcatgggtgaggggctggagggcctggtgccctgtaccaccacctgtgatacagagaccctgcattttgtgagcattaacaagtatcgtgtcaaatacggcacagtattcaaagccccttaactgcaaagccagagcagataacttggggtgtgtgtggggatgtgtgtgtgggcctatgcactcacacactgaagaaacaaggaagatgcctttcaagcctcactgggcctctctgggacatggccacctgacctgtgtgtggctggtgcagcctggcaccaagtgggctacctgttaggaacatgaataccttacaaagctgaagctggaacttttcccaaagggttttgggtatagcctgccctggaggggaaggaagtccatgcaagcaaagacatgcagtttgcttgcacacaccagcagagctaagactggagtctcctgtggcctaactttcaatgagggaaccggatgctgttcacactttgactggatggagatgcatttacaaaacagactggagaaggacttaatactcagatggattggaactatcatggtcactgctcctctcccctccccacaaaaggaaaaaaaagctggatttgattttttttttctggtcactcgagcacatctaagatcacccattaggttttatctgggacctgcagtttggctttgggattgatcatcttgtggattttattcctgacgattcccttgctgcctacccttttctctcctctggttctcaacctcaacgagttcaaatcagttgtcctttttagctcccgtggaactgttttgtatctgcctctttactagtctaccttagtgccatccaccagctttactctctgacacacacacgcacacacacacacaattttaacttgtttttttgtacataatgtacatactgtcaattttttattaaaagaaatatgctttgatgtgctagcataactgctctagcttcttgtgtaccatagtactgtggcttcagatttagtacctatgaacagatgtacaagacatttattacactttttaccaaagggagttaccattgtagtacttttgtgtaaaacttgtcttcccctttgcccccaacttttttttttttttttttgtaaataaataaagcttggttcttacttaag

SEQ ID NO: 181718 - DNA, 6737 bp, Homo sapiens
  Payload ID: 15789
  Gene Symbol: SIN3A
  Gene Name: SIN3 transcription regulator family member A
  Uniprot ID: Q96ST3
  ENST ID: ENST00000394947
  CDS Start-End: 316-4137
gggatttcccgggtaacagagaagcggccgcggcggtagaggcggcggagacggtttctccatcttcccccctccccttcccccctcggagtttccctccctccctccctccctccttcccagtctgggcaccggagcctgtgaccgcttcgttagtggagaggtagctggcagtccgcttcggcgggcctgtgccccgcgccgttctcggggcctccctgctgagctcgcggctcacgctgagagggacacgcagtgacgagcggccgaagcagctttgcggttttgtagtgcatccctgagcatgagcacagaatgaagcggcgtttggatgaccaggagtcaccggtgtatgcagcccagcagcgtcggatccctggcagcacagaggcttttcctcaccagcaccgggtgcttgcccctgcccctcctgtgtatgaagcagtgtctgagaccatgcagtcagctacgggaattcagtactctgtaacacccagctaccaggtttcagccatgccacagagctccggcagtcatgggcccgctatagcagcagttcatagcagccatcatcacccaacagcggtgcagccccacggaggccaggtggtccagagtcatgctcatccagccccaccagttgcaccagtgcagggacagcagcaatttcagaggctgaaggtggaggatgcgctatcttatcttgaccaggtgaagctgcagtttggtagtcagcctcaggtctacaatgatttccttgacatcatgaaggaatttaaatctcagagcatcgacaccccaggagtgattagtcgtgtgtcccagctattcaaaggccaccccgatctgataatgggattcaacaccttcttgccccctggctacaaaattgaggtgcaaaccaatgacatggtgaatgtgacaactcctggccaggttcatcagattcccacccatggcatccagccacagcctcaaccaccaccccaacatccttcccagccttcagcccagtcagccccagctcctgcccagccagctcctcagcccccacctgccaaagtcagcaagccctcccaactgcaagcacatactccggccagtcagcagactcccccacttccaccgtatgcatccccacgttctccgccggtccagcctcacacaccagtgacaatctcgttgggaacggccccatccttgcagaacaatcaacctgtggagtttaatcatgccatcaactatgttaataagatcaagaacagatttcagggccaaccagacatctacaaagcattcctggagattttgcacacatatcagaaagagcagagaaatgccaaggaagctggaggaaactacactccagcattgacagagcaggaggtgtatgcccaggttgctcgtctctttaaaaaccaggaagatttgttgtcagagtttggacaattcctaccagatgccaacagctccgtgcttttaagcaaaacaactgctgagaaggttgattctgtgagaaatgatcatggaggcactgtcaagaagccccaactgaacaacaagccgcagaggcccagccagaatggctgccagatccgcagacatcctacaggaaccacccctccagttaagaagaaacccaaactgctcaatctgaaggattcttctatggcagatgccagcaaacatggtggtggaacagaatcgttattttttgataaggtccgaaaggctcttcggagtgcagaagcctacgaaaatttcctacgctgtcttgttatttttaaccaggaggtgatctctcgtgctgagcttgtgcaactagtctctcctttcctggggaaattccctgagttgtttaattggtttaaaaactttctgggctataaggagtctgtacatctggaaacttatccaaaggagcgagccacagagggcattgctatggagatagattatgcttcttgtaaacgattgggctccagctatcgagccttaccaaagagttaccagcagcccaagtgtacaggacggactcctctctgtaaagaggttttaaatgatacctgggtttccttcccttcgtggtctgaggactctacctttgtgagttccaagaagactcaatatgaagaacatatttatcgttgtgaagatgaacgctttgagcttgatgtagttttagagaccaatctggcaacaatccgggttctggaagcaatacagaagaagctttcccgcttgtctgctgaagaacaagccaaatttcgcttggacaacacccttgggggcacatcagaagtcatccatagaaaagcactccagaggatatatgctgataaagcagctgacatcattgatggtctgagaaagaatccctccattgctgttccaattgtccttaaaaggttgaagatgaaagaggaagaatggcgagaagctcagagaggctttaacaaagtatggcgagaacaaaatgagaaatactacttgaagtctctggaccaccaggggatcaactttaaacagaatgacaccaaggtcctgaggtctaagagcttactcaatgagattgagagtatctatgatgagaggcaagagcaggctacggaggagaatgctggtgtacctgttggcccacacctctcacttgcgtatgaagacaaacaaatactggaagatgctgctgctctgattatccaccatgtgaagaggcagacaggcattcagaaggaggacaaatataagataaaacaaatcatgcatcattttattccagatttgctctttgcccaaagaggtgatctctcagatgtggaggaagaggaagaagaagagatggatgtagatgaagccacaggggcagttaagaagcacaatggtgttgggggcagtccccctaagtccaagttactgtttagtaacacagcagctcaaaaattaagaggaatggatgaagtatacaacctcttctatgtcaacaacaactggtatatttttatgcgactgcaccagattctctgcctgaggctgctacggatttgttcccaagccgaacggcaaattgaagaagaaaaccgagagagagaatgggaacgggaagtgctgggcataaagcgagacaagagtgacagccctgccattcagctacgtctcaaagaacctatggatgttgatgtagaagattattacccagctttcctggacatggtgcggagcctgctggatggcaacatagactcatcacagtatgaagattcactgagagagatgttcaccattcatgcctacattgcctttaccatggacaaactgatccagagcattgtcagacagctgcagcatatcgtgagtgatgagatctgtgtgcaggtgactgacctttacctggcagaaaataataatggggccaccggaggccagctgaacacacagaactcaaggagcctcctggagtcaacgtatcagcggaaagctgagcagctaatgtcagatgagaattgctttaagcttatgtttattcagagccaaggccaggtccagctgactattgagcttctggacacagaagaggagaattcggatgaccctgtggaagcagagcgctggtcagactacgtggagcgatacatgaattcagatactacctcgcctgagcttcgtgaacatctagcacagaaaccagtatttctccccaggaatctacggcggatccggaagtgtcaacgtggtcgagagcagcaggaaaaggaagggaaggaaggaaacagcaagaagaccatggagaatgtggatagtctggataagctggagtgtagattcaagctgaattcctacaagatggtgtatgtgatcaaatcagaggactatatgtatcggaggaccgccctgctccgggctcatcagtcccatgagcgtgtaagcaagcgtctacatcagagattccaggcctgggtagataaatggaccaaggagcatgtgccccgtgaaatggcagcagagaccagcaagtggctcatgggtgaggggctggagggcctggtgccctgtaccaccacctgtgatacagagaccctgcattttgtgagcattaacaagtatcgtgtcaaatacggcacagtattcaaagccccttaactgcaaagccagagcagataacttggggtgtgtgtggggatgtgtgtgtgggcctatgcactcacacactgaagaaacaaggaagatgcctttcaagcctcactgggcctctctgggacatggccacctgacctgtgtgtggctggtgcagcctggcaccaagtgggctacctgttaggaacatgaataccttacaaagctgaagctggaacttttcccaaagggttttgggtatagcctgccctggaggggaaggaagtccatgcaagcaaagacatgcagtttgcttgcacacaccagcagagctaagactggagtctcctgtggcctaactttcaatgagggaaccggatgctgttcacactttgactggatggagatgcatttacaaaacagactggagaaggacttaatactcagatggattggaactatcatggtcactgctcctctcccctccccacaaaaggaaaaaaaagctggatttgattttttttttctggtcactcgagcacatctaagatcacccattaggttttatctgggacctgcagtttggctttgggattgatcatcttgtggattttattcctgacgattcccttgctgcctacccttttctctcctctggttctcaacctcaacgagttcaaatcagttgtcctttttagctcccgtggaactgttttgtatctgcctctttactagtctaccttagtgccatccaccagctttactctctgacacacacacgcacacacacacacaattttaacttgtttttttgtacataatgtacatactgtcaattttttattaaaagaaatatgctttgatgtgctagcataactgctctagcttcttgtgtaccatagtactgtggcttcagatttagtacctatgaacagatgtacaagacatttattacactttttaccaaagggagttaccattgtagtacttttgtgtaaaacttgtcttcccctttgcccccaacttttttttttttttttttgtaaataaataaagcttggttcttacttaaggaataaactctcaacccacgtcccttgtcctcaccagaaaatactgtgaagcagggattttgacttcagttccttatccagggtagaaacaggattttgcttaaaatacttgttacttgtcccaaatcaaaatattccaaaatcttagaatacttaagtcttttagtacgtgtttttttcccttgttcaaataatctgaaaatattttatatttgggtaagttgtcaagctatgtagtttgtatttctatatattttttcttattcacattggtgatggatgggggtgagcaacttaaataccaaaccagtgtttgaaaaaaaagtgtgcataaggcatgtggtataccttataaatggagttgggagggagagaatttgaaatgggatacctatttttttaattacataaatttaaactagcagacatttaaacatgaatgattaggatttttctatgtggttaacctggactttctgaacaaagaccaactgagcccctcccagtactctggtggatttttcttcagcaaccattacgcaagtcttagttgtaaccagcaatgttctgtgtgttttatgtttgctttttagttaaaaatcaccaccaccaccaaaaagaaaaacaaaattttttggctcctggattttcaaaacacatggtagacctctctgattttaggcttttattgtttaaagacagtgtctcgctttatgacccacactggagtgcagtgccacgatcatagctcactgcaggcttgacctcccaggctcaagcagtcctcccacctcggcctcctgagtagctgcatgccaccacgcccagctaattttttaactttttgtagagacagggtcttgctatgctgcccaggttggtctcaaactcctggcctcaagctgtcctcccacctcggcctcgcaaagtgctgagattacaggtgtgagccaccctggcctgattttaggctttttttgtactggggagaagagactgtgagccaaagtgtagggtgccaaaaagagctttgtgggatgagattttagggcaaagctggggcagtgtctgacttggcggtggtcatgtgtactgatttaggggaaagatcttgaggttttctcaaataattcacctatccccgtgttccctcaagaaaggtcatgttgacctggaaccataggggaaattggtggggtgtgatcagggtcagccccagctgttgctgcccctgcagtgttttgtccagagcacttgcctgcaggtcaggataggatttcaaggccagttcaggagaaagtcccaacccaccagtgcaaccaacaaaagagtaagttttacctacagcctgggttttcacaagtagcatttttattcctcctgctgtctgacatctgagctccaagctctaaacccaacctgtattatatgcagcagcaggttatctttgttttaaatcacatttgttattctgtacttagtcacctttccgtgtgatctgcatttgaaatgttgtaaacttggtcagtatttccattaaaatatcagggctaa

SEQ ID NO: 181719 - DNA, 4930 bp, Homo sapiens
  Payload ID: 15789
  Gene Symbol: SIN3A
  Gene Name: SIN3 transcription regulator family member A
  Uniprot ID: Q96ST3
  ENST ID: ENST00000394949
  CDS Start-End: 260-4081
ccagtctgggcaccggagcctgtgaccgcttcgttagtggagaggtagctggcagtccgcttcggcgggcctgtgccccgcgccgttctcggggcctccctgctgagctcgcggctcacgctgagagggacacgcagtgacgagcggccgaagcagctttgcggtgagagcacgctgggccgggggccgggcgggagcctggtggcgggtaacgccggactcgagggttttgtagtgcatccctgagcatgagcacagaatgaagcggcgtttggatgaccaggagtcaccggtgtatgcagcccagcagcgtcggatccctggcagcacagaggcttttcctcaccagcaccgggtgcttgcccctgcccctcctgtgtatgaagcagtgtctgagaccatgcagtcagctacgggaattcagtactctgtaacacccagctaccaggtttcagccatgccacagagctccggcagtcatgggcccgctatagcagcagttcatagcagccatcatcacccaacagcggtgcagccccacggaggccaggtggtccagagtcatgctcatccagccccaccagttgcaccagtgcagggacagcagcaatttcagaggctgaaggtggaggatgcgctatcttatcttgaccaggtgaagctgcagtttggtagtcagcctcaggtctacaatgatttccttgacatcatgaaggaatttaaatctcagagcatcgacaccccaggagtgattagtcgtgtgtcccagctattcaaaggccaccccgatctgataatgggattcaacaccttcttgccccctggctacaaaattgaggtgcaaaccaatgacatggtgaatgtgacaactcctggccaggttcatcagattcccacccatggcatccagccacagcctcaaccaccaccccaacatccttcccagccttcagcccagtcagccccagctcctgcccagccagctcctcagcccccacctgccaaagtcagcaagccctcccaactgcaagcacatactccggccagtcagcagactcccccacttccaccgtatgcatccccacgttctccgccggtccagcctcacacaccagtgacaatctcgttgggaacggccccatccttgcagaacaatcaacctgtggagtttaatcatgccatcaactatgttaataagatcaagaacagatttcagggccaaccagacatctacaaagcattcctggagattttgcacacatatcagaaagagcagagaaatgccaaggaagctggaggaaactacactccagcattgacagagcaggaggtgtatgcccaggttgctcgtctctttaaaaaccaggaagatttgttgtcagagtttggacaattcctaccagatgccaacagctccgtgcttttaagcaaaacaactgctgagaaggttgattctgtgagaaatgatcatggaggcactgtcaagaagccccaactgaacaacaagccgcagaggcccagccagaatggctgccagatccgcagacatcctacaggaaccacccctccagttaagaagaaacccaaactgctcaatctgaaggattcttctatggcagatgccagcaaacatggtggtggaacagaatcgttattttttgataaggtccgaaaggctcttcggagtgcagaagcctacgaaaatttcctacgctgtcttgttatttttaaccaggaggtgatctctcgtgctgagcttgtgcaactagtctctcctttcctggggaaattccctgagttgtttaattggtttaaaaactttctgggctataaggagtctgtacatctggaaacttatccaaaggagcgagccacagagggcattgctatggagatagattatgcttcttgtaaacgattgggctccagctatcgagccttaccaaagagttaccagcagcccaagtgtacaggacggactcctctctgtaaagaggttttaaatgatacctgggtttccttcccttcgtggtctgaggactctacctttgtgagttccaagaagactcaatatgaagaacatatttatcgttgtgaagatgaacgctttgagcttgatgtagttttagagaccaatctggcaacaatccgggttctggaagcaatacagaagaagctttcccgcttgtctgctgaagaacaagccaaatttcgcttggacaacacccttgggggcacatcagaagtcatccatagaaaagcactccagaggatatatgctgataaagcagctgacatcattgatggtctgagaaagaatccctccattgctgttccaattgtccttaaaaggttgaagatgaaagaggaagaatggcgagaagctcagagaggctttaacaaagtatggcgagaacaaaatgagaaatactacttgaagtctctggaccaccaggggatcaactttaaacagaatgacaccaaggtcctgaggtctaagagcttactcaatgagattgagagtatctatgatgagaggcaagagcaggctacggaggagaatgctggtgtacctgttggcccacacctctcacttgcgtatgaagacaaacaaatactggaagatgctgctgctctgattatccaccatgtgaagaggcagacaggcattcagaaggaggacaaatataagataaaacaaatcatgcatcattttattccagatttgctctttgcccaaagaggtgatctctcagatgtggaggaagaggaagaagaagagatggatgtagatgaagccacaggggcagttaagaagcacaatggtgttgggggcagtccccctaagtccaagttactgtttagtaacacagcagctcaaaaattaagaggaatggatgaagtatacaacctcttctatgtcaacaacaactggtatatttttatgcgactgcaccagattctctgcctgaggctgctacggatttgttcccaagccgaacggcaaattgaagaagaaaaccgagagagagaatgggaacgggaagtgctgggcataaagcgagacaagagtgacagccctgccattcagctacgtctcaaagaacctatggatgttgatgtagaagattattacccagctttcctggacatggtgcggagcctgctggatggcaacatagactcatcacagtatgaagattcactgagagagatgttcaccattcatgcctacattgcctttaccatggacaaactgatccagagcattgtcagacagctgcagcatatcgtgagtgatgagatctgtgtgcaggtgactgacctttacctggcagaaaataataatggggccaccggaggccagctgaacacacagaactcaaggagcctcctggagtcaacgtatcagcggaaagctgagcagctaatgtcagatgagaattgctttaagcttatgtttattcagagccaaggccaggtccagctgactattgagcttctggacacagaagaggagaattcggatgaccctgtggaagcagagcgctggtcagactacgtggagcgatacatgaattcagatactacctcgcctgagcttcgtgaacatctagcacagaaaccagtatttctccccaggaatctacggcggatccggaagtgtcaacgtggtcgagagcagcaggaaaaggaagggaaggaaggaaacagcaagaagaccatggagaatgtggatagtctggataagctggagtgtagattcaagctgaattcctacaagatggtgtatgtgatcaaatcagaggactatatgtatcggaggaccgccctgctccgggctcatcagtcccatgagcgtgtaagcaagcgtctacatcagagattccaggcctgggtagataaatggaccaaggagcatgtgccccgtgaaatggcagcagagaccagcaagtggctcatgggtgaggggctggagggcctggtgccctgtaccaccacctgtgatacagagaccctgcattttgtgagcattaacaagtatcgtgtcaaatacggcacagtattcaaagccccttaactgcaaagccagagcagataacttggggtgtgtgtggggatgtgtgtgtgggcctatgcactcacacactgaagaaacaaggaagatgcctttcaagcctcactgggcctctctgggacatggccacctgacctgtgtgtggctggtgcagcctggcaccaagtgggctacctgttaggaacatgaataccttacaaagctgaagctggaacttttcccaaagggttttgggtatagcctgccctggaggggaaggaagtccatgcaagcaaagacatgcagtttgcttgcacacaccagcagagctaagactggagtctcctgtggcctaactttcaatgagggaaccggatgctgttcacactttgactggatggagatgcatttacaaaacagactggagaaggacttaatactcagatggattggaactatcatggtcactgctcctctcccctccccacaaaaggaaaaaaaagctggatttgattttttttttctggtcactcgagcacatctaagatcacccattaggttttatctgggacctgcagtttggctttgggattgatcatcttgtggattttattcctgacgattcccttgctgcctacccttttctctcctctggttctcaacctcaacgagttcaaatcagttgtcctttttagctcccgtggaactgttttgtatctgcctctttactagtctaccttagtgccatccaccagctttactctctgacacacacacgcacacacacacacaattttaacttgtttttttgtacataatgtacatactgtcaattttttattaaaagaaatatgctttgatgtgctagcataa

SEQ ID NO: 181720 - DNA, 510 bp, Homo sapiens
  Payload ID: 15789
  Gene Symbol: SIN3A
  Gene Name: SIN3 transcription regulator family member A
  ENST ID: ENST00000565264
  CDS Start-End: 456-510
agctgagtcttccctctgcggggcggggtcgggggagtgggcgggatttcccgggtaacagagaagcggccgcggcggtagaggcggcggagacggtttctccatcttcccccctccccttcccccctcggagtttccctccctccctccctccctccttcccagtctgggcaccggagcctgtgaccgcttcgttagtggagaggtagctggcagtccgcttcggcgggcctgtgccccgcgccgttctcggggcctccctgctgagctcgcggctcacgctgagagggacacgcagtgacgagcggccgaagcagctttgcggctcgagtgcagtagcgagatctcagctcacctcagcctctgtctcctggactcacatgatcctcccacgtcagcctcctaaatagctgggattacaggttttgtagtgcatccctgagcatgagcacagaatgaagcggcgtttggatgaccaggagtcaccggtgtatgcagcccagcagcgtc

SEQ ID NO: 181721 - DNA, 565 bp, Homo sapiens
  Payload ID: 15789
  Gene Symbol: SIN3A
  Gene Name: SIN3 transcription regulator family member A
  ENST ID: ENST00000568431
  CDS Start-End: 175-565
tcaggactcctcgcctggctcggaagggtctcactctgtcacccaggctggagtgcagtggcgcaatctcagttcactgcaaccttcgcctcccagactcaagcaatctcacctcagccctccaagtagctgggactacaggttttgtagtgcatccctgagcatgagcacagaatgaagcggcgtttggatgaccaggagtcaccggtgtatgcagcccagcagcgtcggatccctggcagcacagaggcttttcctcaccagcaccgggtgcttgcccctgcccctcctgtgtatgaagcagtgtctgagaccatgcagtcagctacgggaattcagtactctgtaacacccagctaccaggtttcagccatgccacagagctccggcagtcatgggcccgctatagcagcagttcatagcagccatcatcacccaacagcggtgcagccccacggaggccaggtggtccagagtcatgctcatccagccccaccagttgcaccagtgcagggacagcagcaatttcagaggctgaaggtggaggatgcgctatcttatcttg

SEQ ID NO: 181722 - DNA, 590 bp, Homo sapiens
  Payload ID: 15789
  Gene Symbol: SIN3A
  Gene Name: SIN3 transcription regulator family member A
  ENST ID: ENST00000562776
  CDS Start-End: 165-590
aaagagcccctgcgcctcgccgctagccctgcgagctgccgggtctccaaactccctggccgtggcggtcgagtcagcattcggtgccggaacccgtcaggccgcgacccagcaaggagctcgcatcggtggttttgtagtgcatccctgagcatgagcacagaatgaagcggcgtttggatgaccaggagtcaccggtgtatgcagcccagcagcgtcggatccctggcagcacagaggcttttcctcaccagcaccgggtgcttgcccctgcccctcctgtgtatgaagcagtgtctgagaccatgcagtcagctacgggaattcagtactctgtaacacccagctaccaggtttcagccatgccacagagctccggcagtcatgggcccgctatagcagcagttcatagcagccatcatcacccaacagcggtgcagccccacggaggccaggtggtccagagtcatgctcatccagccccaccagttgcaccagtgcagggacagcagcaatttcagaggctgaaggtggaggatgcgctatcttatcttgaccaggtgaagctgcagtttggtagtcagcctcag

SEQ ID NO: 181723 - DNA, 617 bp, Homo sapiens
  Payload ID: 15789
  Gene Symbol: SIN3A
  Gene Name: SIN3 transcription regulator family member A
  ENST ID: ENST00000564778
  CDS Start-End: 89-617
aatagcccgtggggggcgttcccccccattcaggactcctcgcctggctcggaaggttttgtagtgcatccctgagcatgagcacagaatgaagcggcgtttggatgaccaggagtcaccggtgtatgcagcccagcagcgtcggatccctggcagcacagaggcttttcctcaccagcaccgggtgcttgcccctgcccctcctgtgtatgaagcagtgtctgagaccatgcagtcagctacgggaattcagtactctgtaacacccagctaccaggtttcagccatgccacagagctccggcagtcatgggcccgctatagcagcagttcatagcagccatcatcacccaacagcggtgcagccccacggaggccaggtggtccagagtcatgctcatccagccccaccagttgcaccagtgcagggacagcagcaatttcagaggctgaaggtggaggatgcgctatcttatcttgaccaggtgaagctgcagtttggtagtcagcctcaggtctacaatgatttccttgacatcatgaaggaatttaaatctcagagcatcgacaccccaggagtgattagtcgtgtgtcccagctattcaaaggccaccccg

SEQ ID NO: 181724 - DNA, 549 bp, Homo sapiens
  Payload ID: 15789
  Gene Symbol: SIN3A
  Gene Name: SIN3 transcription regulator family member A
  ENST ID: ENST00000568309
  CDS Start-End: 229-549
attcaggactcctcgcctggctcggaagctacccagccttcatgctgttttggaacatgtcaagcacatgtgagccctcacaaagacatgagggtctttgcggttgctgtcccctctgcctagaaggcttcctccactaatttctgcatgactagctccctcacttcctttactcagaagttaccttatcagtaggttttgtagtgcatccctgagcatgagcacagaatgaagcggcgtttggatgaccaggagtcaccggtgtatgcagcccagcagcgtcggatccctggcagcacagaggcttttcctcaccagcaccgggtgcttgcccctgcccctcctgtgtatgaagcagtgtctgagaccatgcagtcagctacgggaattcagtactctgtaacacccagctaccaggtttcagccatgccacagagctccggcagtcatgggcccgctatagcagcagttcatagcagccatcatcacccaacagcggtgcagccccacggaggccaggtggtccagagtcatgctcatccagcccca

SEQ ID NO: 181725 - DNA, 554 bp, Homo sapiens
  Payload ID: 15789
  Gene Symbol: SIN3A
  Gene Name: SIN3 transcription regulator family member A
  ENST ID: ENST00000570115
  CDS Start-End: 185-554
tagcccgtggggggcgttcccccccattcaggactcctcgcctggctcggaaggctcgagtgcagtagcgagatctcagctcacctcagcctctgtctcctggactcacatgatcctcccacgtcagcctcctaaatagctgggattacaggttttgtagtgcatccctgagcatgagcacagaatgaagcggcgtttggatgaccaggagtcaccggtgtatgcagcccagcagcgtcggatccctggcagcacagaggcttttcctcaccagcaccgggtgcttgcccctgcccctcctgtgtatgaagcagtgtctgagaccatgcagtcagctacgggaattcagtactctgtaacacccagctaccaggtttcagccatgccacagagctccggcagtcatgggcccgctatagcagcagttcatagcagccatcatcacccaacagcggtgcagccccacggaggccaggtggtccagagtcatgctcatccagccccaccagttgcaccagtgcagggacagcagcaatttcagaggctgaaggtgg

SEQ ID NO: 181726 - DNA, 4078 bp, Homo sapiens
  Payload ID: 15789
  Gene Symbol: SIN3A
  Gene Name: SIN3 transcription regulator family member A
  ENST ID: ENST00000567289
  CDS Start-End: 276-746
ggcggcggagacggtttctccatcttcccccctccccttcccccctcggagtttccctccctccctccctccctccttcccagtctgggcaccggagcctgtgaccgcttcgttagtggagaggtagctggcagtccgcttcggcgggcctgtgccccgcgccgttctcggggcctccctgctgagctcgcggctcacgctgagagggacacgcagtgacgagcggccgaagcagctttgcggttttgtagtgcatccctgagcatgagcacagaatgaagcggcgtttggatgaccaggagtcaccggtgtatgcagcccagcagcgtcggatccctggcagcacagaggcttttcctcaccagcaccgggtgcttgcccctgcccctcctgtgtatgaagcagtgtctgagaccatgcagtcagctacgggaattcagtactctgtaacacccagctaccaggtttcagccatgccacagagctccggcagtcatgggcccgctatagcagcagttcatagcagccatcatcacccaacagcggtgcagccccacggaggccaggtggtccagagtcatgctcatccagccccaccagttgcaccagtgcagggacagcagcaatttcagaggctgaaggtggtattcagctctttttcttgggtcaaaaaatttatctttagcaggaaatactggttgcagcttgttggttgtggtggtacaacttctaacctgagatactagctgtcgaatcacaagttttaccgtttttgttttgtgaaatttgcttatgtttcctatcttggcatcagtgcctgatccagagaagaatatactcaaatgtttgtggactgtatgaatgcatgtcggtcaaatgttatcaggattgtggggccattttaatacaaaataaaccttaaaattcattttttggctgcttccttttgaactctctattgagcacatatatgattggctacaggttagtacagtaaattggcccagtaatatatcttacagttcaatctttttaaattcttaaaaatttttttttttagtttttagtttcagagatgggagtctcactgtgttccccaggctggtctcaaactgctggcctcaagtgattctcccatcttggccttcgaaagtgttgggattacaggtgcgagccactatgcccagctcatgcctgtaatgttcttattacctttatctttttattcctgtttatgaatagctgaattgactcacatcatcaagtccattcttagtaaaacacatgctcctttttggggggaatctttataaagttcagggaaaactgtaactgtgaatgaattatcagtgttttcatattttctgctgagtatgtgtggtacgttttcagtgctttgaaattcatgaggcatccctggagaagtgaagcttgtgttcccagctaaccttgtatctctgaccacttgaatgttacttttcaaaatatgtgattgttgcagcaagtgttcaggtttcaatttttctaattttacgtttatataaaattaagttcaggaaataataaatggaggaactctgaagagatgttaaatcttcatttggttattgcaacctacttatgttgcttgcaggcacgaatgagaaataaaccctctaaggacatatccatatgcagcaaatagttgtttcttctgttttccctgatacttactttagttcttcttgatccctgccctcgttggtgtggattcttgggaacttgtttaatattggcctaagagtattaaatgctacataaatattataaagtacagcaaagctatgtgatttagagtaattttgtaaaatttactctctatattggcttacatagtattgactaatgcatagccttttaaagagagtacaggttttttaggcctgaagcttcactctggattctgtctttgggaaaatgtgtataaggaatattgatgtttcctttaaaacattttcagtctgttgtagagtgatggctgtgtaccaaaatgtattattgctgcgggcttagcactttactaagtcctgaaaatattttttttaaaacttggttgtgcgtgatttaattctgtattaacactgtatattcagtagttatactttaatgttgcaaaatagcttataaacttgcttattaaactaacaaaaacatatgtatttctatagcctttttcaatcaaccctatcaaagcacaacaccagtttttacccaccttcctcacaggactctttggtataagtatatggattatgttttgtttgctttatggaaactggcaaggaaacaaggaaaggttttggatttggggttatagagtgagtcatagatagagttaggatttcttgttgtgttcttttagtcacaagctcttgactatattcctgcataaaataacttgttgaatttcctttctgatgaggagaggtaaaatgcttcttgtacctccatgtaatttaactcagtattcccacattgcctgtcatttttggatcagtcttaaaatgcattacaagcatttgaatcaacttcaataaatcatttatattctataataatgtaggccgggcatggtggcttacacctgtaatcccagcactttgggaggccgaggtgggtggatcacctgaggtcaggagttcaagaccagcctgacaaatgtgatgaaaccatgcctctactaaaaatacaaaatgagccaggcatggtggcgcatgcctgtaataatcccagctactcaggaggctgaggcaggagaatcgttggaacccaggaggcagagattgcagtaagccaagatcataccactgcactcgagtctgggcgacaagagtgaaactccgtctcagaaaaaacaaacaaaaaaaaagaaatgttcagtgagaatgcttacacattatttcaagcctcaacattgtcttttttttttgttttttgtctttggtagattggtggtgacaagaagggatttgaacgatttgaggcatgtttggtgttatttagttattgaatgtcagcagcagtgatatttggtacatatttagcaggttatctttacagttgcttgtgtttttctctcccaacaagattgtagacttcaggagattcggggccttaatagtaaatccctgttgaagtgagctaagaaactttatcagcagagtctaagggtctccccaagtgcttccttaaatctgtagcttctaaataactacatccaagttttttttttaagttgtgctacctagaactgtatacatgcatttatagagagtttatataagagttggactatgctttaggtgatgagagaatttcctcactatttttacatgtaggtgtcttatttattatgtgagtgtcatgcagagtttttaaagcataggattattctataacttttattttacttttttgtttttttgagacagagtctcactctgctgcccaggctgtagtgcagtggcgccatctcaactcactgcaccctcccctgcctgggttcaagtgattcttatgcctcagtctcccaaatagctgggattacaggcatgcaccaccaagcctaatttttgtatttttttttttttttactaggacggggtttttccatgttagccaggctgctctcaaactcctggcctcaagggatccaccctccttggcctcccagagtactaggattacaggcatgagccaccacacctggcctataactaatttttaaacagtggtttgcttggtttgctgtgactttcagtacctttttgtttcagacatatacatatcacacataattgctttcttttgggtttctgtactttttccgtctctgcagtagttaccttataccataccatgtcttattgataactgttcttttgttgtgtaatgatgcatgctattcttaaatatcttccaaagtcttggttccttttgcaaacttaatatattttgtgttcacttaagttggtcattaatgaaacattttagtatggaaagttcagaatatgaattaaaatagtccattgaatttcaa

SEQ ID NO: 181727 - DNA, 567 bp, Homo sapiens
  Payload ID: 15789
  Gene Symbol: SIN3A
  Gene Name: SIN3 transcription regulator family member A
  ENST ID: ENST00000568190
  CDS Start-End: 274-567
attcaggactcctcgcctggctcggaagacgaagtctcgctctgtcaccaggctggagtgcagtggcatgatcacagctcactgcagtgttgatcttctggacttaagcgaccctcctaccttagcctcccatgtagctgggactacagggctaggcttgctgacatatgggctattggaggatatgcaggtccacatcctttatttgcagttctgaaatgcaagagtttttgttttttggttttgtagtgcatccctgagcatgagcacagaatgaagcggcgtttggatgaccaggagtcaccggtgtatgcagcccagcagcgtcggatccctggcagcacagaggcttttcctcaccagcaccgggtgcttgcccctgcccctcctgtgtatgaagcagtgtctgagaccatgcagtcagctacgggaattcagtactctgtaacacccagctaccaggtttcagccatgccacagagctccggcagtcatgggcccgctatagcagcagttcatagcagccatcatcacccaacagcggtgcagccccacggaggccaggtg

SEQ ID NO: 181728 - DNA, 5037 bp, Homo sapiens
  Payload ID: 15790
  Gene Symbol: SIN3B
  Gene Name: SIN3 transcription regulator family member B
  Uniprot ID: O75182
  ENST ID: ENST00000248054
  CDS Start-End: 22-3414
ggcgcagctccgacttcggacatggcgcacgctggcggtggcagcggtggcagcggtgccggcggccccgcgggccgggggctgagcggcgcccgctggggtcgctcgggctccgcaggccacgagaagctgccggtgcacgtagaagacgccctcacctatctggaccaggtgaagatccgctttggcagcgaccctgccacctacaacggcttcctggagatcatgaaggagttcaaaagccagagcatcgatactcctggagtcatcagacgtgtctcgcagctcttccacgagcaccctgacctcattgttggattcaacgcttttcttcccctcggatatagaatagacattcccaagaatggcaagttaaacatacagtcgcctctgacaagccaggagaattcgcacaaccacggggacggtgcagaggacttcaagcagcaggtgccgtataaagaggacaaaccccaggtgcccctggagtccgattccgtggaattcaacaacgccatcagctatgtgaataagattaaaacccgcttcctagaccacccagaaatctacaggtcattcctggagatcctgcacacgtaccagaaggagcagctgaacacgaggggccggccattccgaggcatgtctgaagaggaggtgttcaccgaggtggccaacctcttccggggccaggaggacctgctctcagagtttggacagttcctgcccgaagccaagcggtctctgttcacaggaaacgggccgtgcgagatgcacagcgtgcagaagaacgagcacgacaagaccccggagcacagcaggaagcgctcccggccctcgctcctccgccccgtgtctgcacccgccaagaaaaaaatgaaacttcgtggtaccaaagacctgtccatcgctgcagtggggaagtacgggactctgcaggaattttctttctttgacaaggtccgccgggtgctgaagagccaggaggtgtatgaaaacttcctccgctgcatcgcactcttcaaccaggagctggtgtctggctctgagctcctgcagctcgtcagcccatttctggggaaatttccagaactctttgcacagttcaagtccttcctgggggtaaaagagctgtccttcgcgccacccatgagcgacagatccggggacgggataagccgggaaattgattatgcatcctgcaagcgcataggatccagctaccgggcactccccaaaacctaccagcagcccaagtgcagtgggaggacagccatctgcaaggaggtactgaacgacacctgggtctccttcccttcctggtctgaggactccacgttcgtcagctccaagaagacaccgtacgaggagcagcttcaccgctgtgaggacgagcgcttcgagttagacgttgtcctggagacgaacctggccacaatccgtgtgttggaaagtgtgcagaagaagctgtctcggatggcgccggaagaccaggagaagttccggctggacgactccctgggaggcacgtcggaggtgatccagcgccgtgccatttatcgcatctatggcgacaaggccccggagatcatcgagagcctcaagaagaaccctgtcaccgctgtccccgttgtcctgaaaagactgaaggccaaggaagaggagtggcgggaggcccagcagggcttcaacaagatctggcgggagcagtatgagaaggcgtacctcaagtcccttgaccaccaggctgtgaacttcaagcagaacgacaccaaggccctgcgctccaagagcttgctcaacgagatcgagagcgtctacgacgagcaccaggagcagcactcggagggccgcagtgccccctctagcgagccgcacctcatctttgtgtacgaggaccggcagatcctggaggacgcagcagcgctcatcagctactacgtgaagcggcagccggccatccagaaggaggaccagggcaccatccaccagctgctgcaccagttcgtgcccagcctcttcttctctcagcagctggacctgggcgcctccgaggagtcagctgatgaggaccgggacagcccccaggggcagaccacagaccccagtgagcggaagaagccggcgccaggaccccacagtagccccccagaggagaagggggccttcggggatgccccggccactgagcagccacccctgccgcccccagccccgcacaagcccctggacgatgtctacagcctattttttgccaacaacaactggtacttcttcctgcgcctgcaccagaccctgtgctccaggctgctgaagatctaccgccaggcgcagaagcagcttctggagtatcggaccgagaaggagcgggagaagctgctgtgtgagggccgcagggagaagggcagcgaccccgccatggagctgcggctgaagcagcccagtgaagtggagctggaggagtactacccggccttcctggacatggtgcggagcctgctggagggcagcatcgaccccacgcagtacgaggacaccctacgcgagatgttcaccatccatgcctacgtgggcttcaccatggacaagctggtgcagaacattgcgcggcagctgcaccacctcgtgagcgatgacgtctgcctgaaggtggtggagctctacctgaacgagaagaagcggggtgccgctggtgggaacctgtcctcccgctgcgtccgcgctgctagggagaccagctaccagtggaaggctgagcgctgcatggccgacgagaactgcttcaaggtgatgttcctgcagcgcaaagggcaggtgatcatgaccatcgagctcctggacaccgaggaggcccagacggaggaccctgtggaggtccagcacctggctcggtacgtggagcagtatgtggggaccgagggcgcgtccagctcgcccactgagggcttcctcctgaaacctgtgttcctgcagaggaacctcaagaagttccgccgccggtggcagagcgagcaggcgcgggccctgcgcggtgaggccaggagctcctggaagcggctggtgggcgtggagagcgcctgcgacgtggactgccgcttcaagctcagcactcacaagatggtgttcatcgtgaactccgaggactacatgtaccgtcgcgggaccctctgccgggccaagcaggtgcagcccctggtcctgctccgccaccaccagcactttgaggagtggcacagccgctggctggaggacaatgtgacggtggaggcggctagcctggtgcaggactggctgatgggtgaggaggacgaggacatggtaccctgcaagacgctgtgtgagacagtgcacgtgcacggcctgcccgtgacccgctaccgcgtgcagtacagccgccgcccggcctcgccctgacccgccctcatgggcaccgggcaggcgcctcacagagcacagacgtgccctcggccttggtcgtgtcggggccgttttcttgaacgacgtgagaggcatctcccagcccctctgctgccggacagcgcactccagggcaggacgccgcccccgtggctcccggtctcctgtgggcctgctgtgtgccaaacctgagctacctgcacccgagccctggggctcagccccaccacaggggcgggtggacgtgctggccgaggaacaagcaatcatgtttgcgtccccgtccgtcacatgtgccaaatccctggcaggcagatggctcctgccccatattcttgccgtgtcttggaaaagtcacaggtgacagccctcctgaggcccacactttggagggggtccatgtccaagagaccctgacaaggaaggagttgagccctgggtaggcttgcttgaaaagtgagtccttccagaatattctcagagctgccagaaacatcatctgagggtttgggcatcagctctgcctggctggtgttcaggccctcagtcactttggaagtgagaagaacccttcagccaaacctttgggatcccattttgaagtccagagctggagcaggcgggcagtgccctgggagaccccgctctggataagacacccaaccccaactccagcagctggactctgggcccacaaggggagggaccccagccagtattccctcagagccggcacgaccctgctgtggggcggcgggcccagtcgtgttcctgcagtgggcaccctaggcgtatgtgtatacacgcacagatatttattcctttcgcttttagtggttgttatttctgtagcagccaagtcctgcggctccctggggctgagatctccctttgtggaactccgagagccgccctgacagtcccagccgccacccaaggagccccatccgcccacccaccctgggacccacgcggccactccagggatcattgttgtccttttgtgaggggctgaggcgactgtcccatggaggcatccaaggctttctgtgccaagaatcccaagtgactggggctggggaccacttctccaggcctctctccccgaccatgagagcccctggccctggcccctgcacaccagtaggcccagaataaccgccacccttgccatcctgcaacagctggactcaagtttccaggaagtggagatgtgtttctagaagtttcctgtggaacctggaggctcctgatgcctttgactccaggctgggcgattccgatgctgacccgtcctcctgggctccccacccccgctccccaagtgtcacacaggcactttgtacacatcctggttttctaagaagggaacttgccatcaagattcctgtaccaggcccacggccgtctcgggcagagccacctgggccccgggtgcagccggagaccccgccgagcccctcctcccagtattcccatccccgcatgcttctagggagcgcctcttttccgttcttgaggaatttctgttctggggcttgtccttcctttgcagctgttttgaatgtagttttccttttctatttatttgcacattaaagttaataattgaatattgac

SEQ ID NO: 181729 - DNA, 5129 bp, Homo sapiens
  Payload ID: 15790
  Gene Symbol: SIN3B
  Gene Name: SIN3 transcription regulator family member B
  Uniprot ID: O75182
  ENST ID: ENST00000379803
  CDS Start-End: 15-3503
ctccgacttcggacatggcgcacgctggcggtggcagcggtggcagcggtgccggcggccccgcgggccgggggctgagcggcgcccgctggggtcgctcgggctccgcaggccacgagaagctgccggtgcacgtagaagacgccctcacctatctggaccaggtgaagatccgctttggcagcgaccctgccacctacaacggcttcctggagatcatgaaggagttcaaaagccagagcatcgatactcctggagtcatcagacgtgtctcgcagctcttccacgagcaccctgacctcattgttggattcaacgcttttcttcccctcggatatagaatagacattcccaagaatggcaagttaaacatacagtcgcctctgacaagccaggagaattcgcacaaccacggggacggtgcagaggacttcaagcagcaggtgccgtataaagaggacaaaccccaggtgcccctggagtccgattccgtggaattcaacaacgccatcagctatgtgaataagattaaaacccgcttcctagaccacccagaaatctacaggtcattcctggagatcctgcacacgtaccagaaggagcagctgaacacgaggggccggccattccgaggcatgtctgaagaggaggtgttcaccgaggtggccaacctcttccggggccaggaggacctgctctcagagtttggacagttcctgcccgaagccaagcggtctctgttcacaggaaacgggccgtgcgagatgcacagcgtgcagaagaacgagcacgacaagaccccggagcacagcaggaagcgctcccggccctcgctcctccgccccgtgtctgcacccgccaagaaaaaaatgaaacttcgtggtaccaaagacctgtccatcgctgcagtggggaagtacgggactctgcaggaattttctttctttgacaaggtccgccgggtgctgaagagccaggaggtgtatgaaaacttcctccgctgcatcgcactcttcaaccaggagctggtgtctggctctgagctcctgcagctcgtcagcccatttctggggaaatttccagaactctttgcacagttcaagtccttcctgggggtaaaagagctgtccttcgcgccacccatgagcgacagatccggggacgggataagccgggaaattgattatgcatcctgcaagcgcataggatccagctaccgggcactccccaaaacctaccagcagcccaagtgcagtgggaggacagccatctgcaaggagcttgaccattggacacttctccagggttcgtggacagacgattactgcatgtccaagttcaagaatacctgctggattccaggatatagtgcaggggtactgaacgacacctgggtctccttcccttcctggtctgaggactccacgttcgtcagctccaagaagacaccgtacgaggagcagcttcaccgctgtgaggacgagcgcttcgagttagacgttgtcctggagacgaacctggccacaatccgtgtgttggaaagtgtgcagaagaagctgtctcggatggcgccggaagaccaggagaagttccggctggacgactccctgggaggcacgtcggaggtgatccagcgccgtgccatttatcgcatctatggcgacaaggccccggagatcatcgagagcctcaagaagaaccctgtcaccgctgtccccgttgtcctgaaaagactgaaggccaaggaagaggagtggcgggaggcccagcagggcttcaacaagatctggcgggagcagtatgagaaggcgtacctcaagtcccttgaccaccaggctgtgaacttcaagcagaacgacaccaaggccctgcgctccaagagcttgctcaacgagatcgagagcgtctacgacgagcaccaggagcagcactcggagggccgcagtgccccctctagcgagccgcacctcatctttgtgtacgaggaccggcagatcctggaggacgcagcagcgctcatcagctactacgtgaagcggcagccggccatccagaaggaggaccagggcaccatccaccagctgctgcaccagttcgtgcccagcctcttcttctctcagcagctggacctgggcgcctccgaggagtcagctgatgaggaccgggacagcccccaggggcagaccacagaccccagtgagcggaagaagccggcgccaggaccccacagtagccccccagaggagaagggggccttcggggatgccccggccactgagcagccacccctgccgcccccagccccgcacaagcccctggacgatgtctacagcctattttttgccaacaacaactggtacttcttcctgcgcctgcaccagaccctgtgctccaggctgctgaagatctaccgccaggcgcagaagcagcttctggagtatcggaccgagaaggagcgggagaagctgctgtgtgagggccgcagggagaagggcagcgaccccgccatggagctgcggctgaagcagcccagtgaagtggagctggaggagtactacccggccttcctggacatggtgcggagcctgctggagggcagcatcgaccccacgcagtacgaggacaccctacgcgagatgttcaccatccatgcctacgtgggcttcaccatggacaagctggtgcagaacattgcgcggcagctgcaccacctcgtgagcgatgacgtctgcctgaaggtggtggagctctacctgaacgagaagaagcggggtgccgctggtgggaacctgtcctcccgctgcgtccgcgctgctagggagaccagctaccagtggaaggctgagcgctgcatggccgacgagaactgcttcaaggtgatgttcctgcagcgcaaagggcaggtgatcatgaccatcgagctcctggacaccgaggaggcccagacggaggaccctgtggaggtccagcacctggctcggtacgtggagcagtatgtggggaccgagggcgcgtccagctcgcccactgagggcttcctcctgaaacctgtgttcctgcagaggaacctcaagaagttccgccgccggtggcagagcgagcaggcgcgggccctgcgcggtgaggccaggagctcctggaagcggctggtgggcgtggagagcgcctgcgacgtggactgccgcttcaagctcagcactcacaagatggtgttcatcgtgaactccgaggactacatgtaccgtcgcgggaccctctgccgggccaagcaggtgcagcccctggtcctgctccgccaccaccagcactttgaggagtggcacagccgctggctggaggacaatgtgacggtggaggcggctagcctggtgcaggactggctgatgggtgaggaggacgaggacatggtaccctgcaagacgctgtgtgagacagtgcacgtgcacggcctgcccgtgacccgctaccgcgtgcagtacagccgccgcccggcctcgccctgacccgccctcatgggcaccgggcaggcgcctcacagagcacagacgtgccctcggccttggtcgtgtcggggccgttttcttgaacgacgtgagaggcatctcccagcccctctgctgccggacagcgcactccagggcaggacgccgcccccgtggctcccggtctcctgtgggcctgctgtgtgccaaacctgagctacctgcacccgagccctggggctcagccccaccacaggggcgggtggacgtgctggccgaggaacaagcaatcatgtttgcgtccccgtccgtcacatgtgccaaatccctggcaggcagatggctcctgccccatattcttgccgtgtcttggaaaagtcacaggtgacagccctcctgaggcccacactttggagggggtccatgtccaagagaccctgacaaggaaggagttgagccctgggtaggcttgcttgaaaagtgagtccttccagaatattctcagagctgccagaaacatcatctgagggtttgggcatcagctctgcctggctggtgttcaggccctcagtcactttggaagtgagaagaacccttcagccaaacctttgggatcccattttgaagtccagagctggagcaggcgggcagtgccctgggagaccccgctctggataagacacccaaccccaactccagcagctggactctgggcccacaaggggagggaccccagccagtattccctcagagccggcacgaccctgctgtggggcggcgggcccagtcgtgttcctgcagtgggcaccctaggcgtatgtgtatacacgcacagatatttattcctttcgcttttagtggttgttatttctgtagcagccaagtcctgcggctccctggggctgagatctccctttgtggaactccgagagccgccctgacagtcccagccgccacccaaggagccccatccgcccacccaccctgggacccacgcggccactccagggatcattgttgtccttttgtgaggggctgaggcgactgtcccatggaggcatccaaggctttctgtgccaagaatcccaagtgactggggctggggaccacttctccaggcctctctccccgaccatgagagcccctggccctggcccctgcacaccagtaggcccagaataaccgccacccttgccatcctgcaacagctggactcaagtttccaggaagtggagatgtgtttctagaagtttcctgtggaacctggaggctcctgatgcctttgactccaggctgggcgattccgatgctgacccgtcctcctgggctccccacccccgctccccaagtgtcacacaggcactttgtacacatcctggttttctaagaagggaacttgccatcaagattcctgtaccaggcccacggccgtctcgggcagagccacctgggccccgggtgcagccggagaccccgccgagcccctcctcccagtattcccatccccgcatgcttctagggagcgcctcttttccgttcttgaggaatttctgttctggggcttgtccttcctttgcagctgttttgaatgtagttttccttttctatttatttgcacattaaagttaataattgaatattgacatc

SEQ ID NO: 181730 - DNA, 2767 bp, Homo sapiens
  Payload ID: 15790
  Gene Symbol: SIN3B
  Gene Name: SIN3 transcription regulator family member B
  ENST ID: ENST00000595541
  CDS Start-End: 371-2533
ccaaaaaatgacaatacagcaataaagcgtaatccacattttaagaatgcagtgtaacaatgatctacacagcatttacattgcattaggtataagtattctagagatgattttgcataggatatatgcaaataggattccattggacatcagggacttgagtatctgtggatttgggtcttcaggggtggttctggaaccaatctcccaggataccaagggagtgtccacttgaccaaagtcatgtttttccttaaaaactttatgcaccttcccatttgtataaggcagttggtattatgtatcaggatggtattatgtatcttggtactttctacactggctaacagtaaatcttggctcctggggcatgcagcgtcattcacggcatttcctcttggtgcaggtactgaacgacacctgggtctccttcccttcctggtctgaggactccacgttcgtcagctccaagaagacaccgtacgaggagcagcttcaccgctgtgaggacgagcgcttcgagttagacgttgtcctggagacgaacctggccacaatccgtgtgttggaaagtgtgcagaagaagctgtctcggatggcgccggaagaccaggagaagttccggctggacgactccctgggaggcacgtcggaggtgatccagcgccgtgccatttatcgcatctatggcgacaaggccccggagatcatcgagagcctcaagaagaaccctgtcaccgctgtccccgttgtcctgaaaagactgaaggccaaggaagaggagtggcgggaggcccagcagggcttcaacaagatctggcgggagcagtatgagaaggcgtacctcaagtcccttgaccaccaggctgtgaacttcaagcagaacgacaccaaggccctgcgctccaagagcttgctcaacgagatcgagagcgtctacgacgagcaccaggagcagcactcggagggccgcagtgccccctctagcgagccgcacctcatctttgtgtacgaggaccggcagatcctggaggacgcagcagcgctcatcagctactacgtgaagcggcagccggccatccagaaggaggaccagggcaccatccaccagctgctgcaccagttcgtgcccagcctcttcttctctcagcagctggacctgggcgcctccgaggagtcagctgatgaggaccgggacagcccccaggggcagaccacagaccccagtgagcggaagaagccggcgccaggaccccacagtagccccccagaggagaagggggccttcggggatgccccggccactgagcagccacccctgccgcccccagccccgcacaagcccctggacgatgtctacagcctattttttgccaacaacaactggtacttcttcctgcgcctgcaccagaccctgtgctccaggctgctgaagatctaccgccaggcgcagaagcagcttctggagtatcggaccgagaaggagcgggagaagctgctgtgtgagggccgcagggagaagggcagcgaccccgccatggagctgcggctgaagcagcccagtgaagtggagctggaggagtactacccggccttcctggacatggtgcggagcctgctggagggcagcatcgaccccacgcagtacgaggacaccctacgcgagatgttcaccatccatgcctacgtgggcttcaccatggacaagctggtgcagaacattgcgcggcagctgcaccacctcgtgagcgatgacgtctgcctgaaggtggtggagctctacctgaacgagaagaagcggggtgccgctggtgggaacctgtcctcccgctgcgtccgcgctgctagggagaccagctaccagtggaaggctgagcgctgcatggccgacgagaactgcttcaaggtgatgttcctgcagcgcaaagggcaggtgatcatgaccatcgagctcctggacaccgaggaggcccagacggaggaccctgtggaggtccagcacctggctcggtacgtggagcagtatgtggggaccgagggcgcgtccagctcgcccactgagggcttcctcctgaaacctgtgttcctgcagaggaacctcaagaagttccgccgccggtggcagagcgagcaggcgcgggccctgcgcggtgaggccaggagctcctggaagcggctggtgggcgtggagagcgcctgcgacgtggactgccgcttcaagctcagcactcacaagatggtgttcatcgtgaactccgaggactacatgtaccgtcgcgggaccctctgccgggccaagcaggtgcagcccctggtcctgctccgccaccaccagcactttgaggagtggcacagccgctggctggaggacaatgtgacggtggaggcggctagcctggtgcaggactggctgatgggtgaggaggacgaggacatggtaccctgcaagacgctgtgtgagacagtgcacgtgcacggcctgcccgtgacccgctaccgcgtgcagtacagccgccgcccggcctcgccctgacccgccctcatgggcaccgggcaggcgcctcacagagcacagacgtgccctcggccttggtcgtgtcggggccgttttcttgaacgacgtgagaggcatctcccagcccctctgctgccggacagcgcactccagggcaggacgccgcccccgtggctcccggtctcctgtgggcctgctgtgtgccaaacctgagctacctgcacccgagccctggggctcagccccaccaca

SEQ ID NO: 181731 - DNA, 1104 bp, Homo sapiens
  Payload ID: 15790
  Gene Symbol: SIN3B
  Gene Name: SIN3 transcription regulator family member B
  ENST ID: ENST00000596638
  CDS Start-End: 1-929
tcctgcacacgtaccagaaggagcagctgaacacgaggggccggccattccgaggcatgtctgaagaggaggtgttcaccgaggtggccaacctcttccggggccaggaggacctgctctcagagtttggacagttcctgcccgaagccaagcggtctctgttcacaggaaacgggccgtgcgagatgcacagcgtgcagaagaacgagcacgacaagaccccggagcacagcaggaagcgctcccggccctcgctcctccgccccgtgtctgcacccgccaagaaaaaaatgaaacttcgtggtaccaaagacctgtccatcgctgcagtggggaagtacgggactctgcaggaattttctttctttgacaaggtccgccgggtgctgaagagccaggaggtgtatgaaaacttcctccgctgcatcgcactcttcaaccaggagctggtgtctggctctgagctcctgcagctcgtcagcccatttctggggaaatttccagaactctttgcacagttcaagtccttcctgggggtaaaagagctgtccttcgcgccacccatgagcgacagatccggggacgggataagccgggaaattgattatgcatcctgcaagcgcataggatccagctaccgggcactccccaaaacctaccagcagcccaagtgcagtgggaggacagccatctgcaaggagcttgaccattggacacttctccagggttcgtggacagacgattactgcatgtccaagttcaagaatacctgctggattccaggatatagtgcaggggtcagcaaactctggcccacgggccctggcccgctgcccgtgtttgtaaataaagttttactgtcacacagacacaaccattcctttacatattgcctgtggctgcttttctcaccacaaaggcagagttgagtattcatctgggatggcctgcaaaatctgagatggttgctgtctgaccctttgcagagagaatttaccaatgtctgaaatgaaatcggccctccggatctgcaagttcctcatctgtggtttcaactaaccatggattgaaaatacgtggggaaagagaaaccaaaaaatgaca

SEQ ID NO: 181732 - DNA, 2556 bp, Homo sapiens
  Payload ID: 15790
  Gene Symbol: SIN3B
  Gene Name: SIN3 transcription regulator family member B
  Uniprot ID: O75182
  ENST ID: ENST00000596802
  CDS Start-End: 15-1076
ctccgacttcggacatggcgcacgctggcggtggcagcggtggcagcggtgccggcggccccgcgggccgggggctgagcggcgcccgctggggtcgctcgggctccgcaggccacgagaagctgccggtgcacgtagaagacgccctcacctatctggaccaggtgaagatccgctttggcagcgaccctgccacctacaacggcttcctggagatcatgaaggagttcaaaagccagagcatcgatactcctggagtcatcagacgtgtctcgcagctcttccacgagcaccctgacctcattgttggattcaacgcttttcttcccctcggatatagaatagacattcccaagaatggcaagttaaacatacagtcgcctctgacaagccaggagaattcgcacaaccacggggacggtgcagaggacttcaagcagcaggtgccgtataaagaggacaaaccccaggtgcccctggagtccgattccgtggaattcaacaacgccatcagctatgtgaataagattaaaacccgcttcctagaccacccagaaatctacaggtcattcctggagatcctgcacacgtaccagaaggagcagctgaacacgaggggccggccattccgaggcatgtctgaagaggaggtgttcaccgaggtggccaacctcttccggggccaggaggacctgctctcagagtttggacagttcctgcccgaagccaagcggtctctgttcacaggaaacgggccgtgcgagatgcacagcgtgcagaagaacgagcacgacaagaccccggagcacagcaggaagcgctcccggccctcgctcctccgccccgtgtctgcacccgccaagaaaaaaatgaaacttcgtggtaccaaagacctgtccatcgctgcagtggggaagtacgggactctgcaggaattttctttctttgacaaggtccgccgggtgctgaagagccaggaggtgtatgaaaacttcctccgctgcatcgcactcttcaaccaggagctggtgtctggctctgagctcctgcagctcgtcagcccatttctggggtgagcagctgacttcccagggctccctaggggggttctgttcctgtcaactccatctacttggtttttagttactgtttttgagcaatgattgtgcttttctaaaatcctgtttattaattgacgtgattgatataattattgattcccatgcatttgtaaggagcaatacaccacctgggtaccctccagctggttcctttaccagtaacatctgtagtcagtatcctcaccagaatacagtgggtcctcgagtaatgccttttcatttaacactgttttaacaccgatgagaaaagaagacattcatttctggtctgagtggagtttgcacgttctccccatgtctgcgtggattttctcccacatcccaaagatgtgcatgttaggttaagtctaggttaagcggtgagtctccgtggtcccagcctgagtgagtgtggcggggtgagcgccctgcagtggggtggcgtcctgtccagggtgggtgccccactggtgctctgagctgctgggatagggtccggccacccaagatcctgaactggaataattgggtaaattgttattttacttgtttttactcatctttcttatctgtatgtgtggcttgcatttatttcagtgtttaatattagaagtgttttggtctctctttagaaatttggtgattgttttgtgaccaaaaatacgccgtaggaacgtcattcttgtttatgtgtcaattagcttgtggcaaaattggttttgttacacatcttttcaacttaaagacacagctttctaacacctgttgatgatgttgagtgaggacttactgtactgactctcacacaacccccgttctttccagactctccgtgttcctcatacacgtctggtgtgtgtgtttttatacagctttctcactgtggagggttgtgcgtccgccacagtgaagatactgaacggctccaggactgtcaagttctggccttgaccttttatctccatcccaaaaccctgcctcagccggagtctgttccaaacccctggcaactacttatctgttctctagacaatgttacagtaatggaactgtacaggaggaaccctctgggagaaaccttcccccccccccccccagcaaaattccctggagattcacctgataaatacttttaaaaattctaacacttgggccgggtgcggtggctcgtgtgtaatcccagcactttgggaggccgaggtgagcagattgcctgaggtcaggagttggagacaagcctggccaacatggtggaactccatctctactaaaaatacaaaaattagccgggcgtggtggcaggcgcctgtaatcccagctacttgggaggctgaggcaggagaatcgcttgaacccaggaggcggaggttgcagtgagctgagatcacgccattgtactccagcctgggtggcgacaagagcaagactttgtctcaaaaacaaaacaaaacaaaaa

SEQ ID NO: 181733 - DNA, 4140 bp, Homo sapiens
  Payload ID: 15791
  Gene Symbol: SAP130
  Gene Name: Sin3A-associated protein, 130kDa
  ENST ID: ENST00000259234
  CDS Start-End: 188-3358
aatagacgggaggctcgttacggcggcggaagcagcggcgctggagtgaggggtggggggcagagtgctagctccccggcggtggctgcgggtccggagcctggggacgtcggccccacagacggagagcgcgcgggagcgagctcaaggcggcgcggcggccactgggcgcagcacccaggtggaaatgagttctcaacagtttcctcggttaggagccccttctaccgggctgagccaggccccttctcagattgcaaacagtggttctgctggattgataaacccagctgctacagtcaatgatgaatctggtcgagattctgaagtcagtgccagggagcacatgagttccagcagctccctccagtcccgggaggagaagcaagagcctgttgtggtaaggccctatccacaggtgcagatgttgtcgacacaccatgctgtcgcatcagccacacctgttgcagtgacagccccgccagcacacctgacgccagcagtgccactttcattttcggagggacttatgaagccgcccccgaagcccaccatgcctagccgtcccattgctcctgctccaccttctaccctgtcacttccccccaaggttccagggcaggttaccgttaccatggagagtagcatccctcaagcttcagccattcctgtggcaacaatcagtggacaacagggccatcccagtaacctgcatcacatcatgactacaaatgtgcaaatgtctatcatccgcagcaatgctcctgggccccctcttcacattggagcttctcatttacctcgaggtgcagctgctgctgctgtgatgtccagttctaaagtaaccacagtcctgaggccgacctcacagctgccaaatgctgctactgctcagccagcagtacagcacatcattcaccaaccaatccagtctcggccacctgtgaccacctccaatgccatccctcctgctgtggtagcaactgtctcagccaccagagctcagtctccagtcatcactacgacagcggcgcatgctactgattcagcacttagtaggccaaccttgtctatccagcatcctccatctgcagcaatcagtattcagcgtcctgcccagtcacgagatgtcacaacaagaatcacactaccatctcaccctgcattagggacgccaaaacagcagcttcatacaatggctcagaaaacaatcttcagtactggcacgccagtggctgcagccacagtagcacctattttggcaaccaacaccattccttcagcgaccacagctggatctgtgtcacacacgcaagctcccacaagtaccattgttaccatgacagtaccctcccattcctcccatgctactgctgtgaccacctcaaacatcccagtcgccaaggtggtgccccagcagatcacgcacacttctcctcggatccagccagactaccctgccgagaggagtagcctgattcccatctccggacatcgggcctctcccaatcctgtggccatggaaacccgaagtgacaacagaccgtctgttcccgttcagttccaatattttttgccaacttaccccccttctgcatacccactggcggcacatacctacaccccaatcaccagttccgtgtccactatccgacagtatccagtttcagctcaggctccaaactctgccatcacagctcagactggtgttggggtagcgtctaccgtccacctaaaccccatgcagttgatgacagtggatgcatcgcatgctcgacatattcaagggatccagccagcacccatcagtacccagggtatccagccggcccccattgggaccccagggatacagcctgcaccacttggcacacagggaattcactcagcaaccccaatcaacacacaagggcttcagcctgcacctatgggtactcagcagcctcagcctgaaggaaagacttcagtggtgttggcagatggagccacaattgtggccaaccctattagcaatccattcagtgctgctccagcagcaacaaccgtggtgcagacccacagccagagtgctagcaccaacgctcccgcccagggctcatcgccacggccaagcatactccggaagaaacctgccacagatggaatggcagttcggaaaaccctcattcctcctcagcctcctgatgttgctagtcctcgagtggaaagctctatgcggagtacgtctgggtcacctaggcctgcaggtgccaaacccaagtctgaaatccacgtgtctatggccactccggtcactgtgtccatggagactgtatccaatcaaaataatgatcagcctaccattgccgtccctccaactgcccagcagcccccaccgaccattccaactatgattgcagcagccagtcccccgtcacaaccagccgttgccctttcaaccattcctggagcggtccccatcactccacccatcaccaccattgcagctgcaccacctccatcagtcactgtgggtggcagtctttcctccgtcttgggccctcccgttcctgaaattaaagtgaaagaagaagtagaaccaatggatatcatgaggccagtttctgcagttcctccactggctaccaacactgtgtctccatctcttgcattgctggcaaacaacttgtccatgcctacaagtgacctaccacctggtgcctccccaaggaaaaagcctcgaaagcaacagcatgtgatctcaacagaagaaggtgacatgatggagacaaacagcactgatgatgagaagtccactgccaagagtcttctggtgaaggctgagaagcgcaagtctcctcccaaggagtatattgatgaggaaggtgtgagatatgtcccagtgcgtccaagaccccccattactttgcttcgtcactatcggaacccctggaaagctgcttaccaccactttcagaggtacagtgacgtccgggtcaaagaggagaagaaagctatgctgcaggaaatagctaatcagaaaggagtatcctgtcgtgctcaaggctggaaagtccacctctgtgctgcccagttactacagctgacgaatctagaacatgatgtctatgaaagacttactaacctgcaggaagggattatcccaaagaaaaaagcagcaacagatgatgatctccaccgaataaacgaactgatacagggaaatatgcagaggtgtaaacttgtgatggatcaaatcagtgaagccagagactccatgcttaaggttttagatcataaagaccgtgtcctgaagctgcttaacaagaacgggactgtcaaaaaagtgtccaaattgaagcgaaaggaaaaagtctagacccagaacaatcaggagattggaagcaaatttatgaagaatgatggtgggggtggggggagggttttggttttttccaaagtggaacattgaaataaaggaagtgttccttagttcccgtgtgaaagcagaggaacccatgacatccaagggcgtgaaaggatcagagctgactggacatagtgagctgccttcttgcgttcgggtgcacccctgttaaacctgatctgtgtcataagtgactccggatgcatcagtgtccaccagttggaagcaatgacaaggatggctggctggtgtttttcagccttccggtttatagactgtatttatctagtggattcctgcaggccccatactgagcctggactgaaagtatccactcggaccatctgttatctctctacactgaaaataaaacctcttccacccaccccattcggttcttctgcctgaccttcaaatgcccatgttggccttttacagcagtgccacggcaccaagcgagctgccacatctcacactctaaagggtttgaactattagttcttgtcattttttaaaaaaaaccattcccaagtgaaattgttatatcgtctgtcttgcgtgtgtcagaactgggtttttgtggaggttcagagcaggcaacaccataagttgctctcagatccttgttctgaagtacattcttggttatctgtacttctgtagctggtgtgatgctgttaattgtatgtaccacacatctccagacgttaataaaggactcaaagaggtttttg

SEQ ID NO: 181734 - DNA, 4065 bp, Homo sapiens
  Payload ID: 15791
  Gene Symbol: SAP130
  Gene Name: Sin3A-associated protein, 130kDa
  Uniprot ID: Q9H0E3
  ENST ID: ENST00000259235
  CDS Start-End: 131-3277
gaggactgcgagcacagcggcggccgggtggcgggggtgagtggggccagcggggctggacagcagcgggccccgggcgccgccgccgcgatccctccccgcgcccgccgagcacatcgccgccgccgagatgggccctccgcggcacccccaggccggcgagatagaagcgggcggtgcgggcggcgggcggcggctacaggtggaaatgagttctcaacagtttcctcggttaggagccccttctaccgggctgagccaggccccttctcagattgcaaacagtggttctgctggattgataaacccagctgctacagtcaatgatgaatctggtcgagattctgaagtcagtgccagggagcacatgagttccagcagctccctccagtcccgggaggagaagcaagagcctgttgtggtaaggccctatccacaggtgcagatgttgtcgacacaccatgctgtcgcatcagccacacctgttgcagtgacagccccgccagcacacctgacgccagcagtgccactttcattttcggagggacttatgaagccgcccccgaagcccaccatgcctagccgtcccattgctcctgctccaccttctaccctgtcacttccccccaaggttccagggcaggttaccgttaccatggagagtagcatccctcaagcttcagccattcctgtggcaacaatcagtggacaacagggccatcccagtaacctgcatcacatcatgactacaaatgtgcaaatgtctatcatccgcagcaatgctcctgggccccctcttcacattggagcttctcatttacctcgaggtgcagctgctgctgctgtgatgtccagttctaaagtaaccacagtcctgaggccgacctcacagctgccaaatgctgctactgctcagccagcagtacagcacatcattcaccaaccaatccagtctcggccacctgtgaccacctccaatgccatccctcctgctgtggtagcaactgtctcagccaccagagctcagtctccagtcatcactacgacagcggcgcatgctactgattcagcacttagtaggccaaccttgtctatccagcatcctccatctgcagcaatcagtattcagcgtcctgcccagtcacgagatgtcacaacaagaatcacactaccatctcaccctgcattagggacgccaaaacagcagcttcatacaatggctcagaaaacaatcttcagtactggcacgccagtggctgcagccacagtagcacctattttggcaaccaacaccattccttcagcgaccacagctggatctgtgtcacacacgcaagctcccacaagtaccattgttaccatgacagtaccctcccattcctcccatgctactgctgtgaccacctcaaacatcccagtcgccaaggtggtgccccagcagatcacgcacacttctcctcggatccagccagactaccctgccgagaggagtagcctgattcccatctccggacatcgggcctctcccaatcctgtggccatggaaacccgaagtgacaacagaccgtctgttcccgttcagttccaatattttttgccaacttaccccccttctgcatacccactggcggcacatacctacaccccaatcaccagttccgtgtccactatccgacagtatccagtttcagctcaggctccaaactctgccatcacagctcagactggtgttggggtagcgtctaccgtccacctaaaccccatgcagttgatgacagtggatgcatcgcatgctcgacatattcaagggatccagccagcacccatcagtacccagggtatccagccggcccccattgggaccccagggatacagcctgcaccacttggcacacagggaattcactcagcaaccccaatcaacacacaagggcttcagcctgcacctatgggtactcagcagcctcagcctgaaggaaagacttcagcagtggtgttggcagatggagccacaattgtggccaaccctattagcaatccattcagtgctgctccagcagcaacaaccgtggtgcagacccacagccagagtgctagcaccaacgctcccgcccagggctcatcgccacggccaagcatactccggaagaaacctgccacagatggtgccaaacccaagtctgaaatccacgtgtctatggccactccggtcactgtgtccatggagactgtatccaatcaaaataatgatcagcctaccattgccgtccctccaactgcccagcagcccccaccgaccattccaactatgattgcagcagccagtcccccgtcacaaccagccgttgccctttcaaccattcctggagcggtccccatcactccacccatcaccaccattgcagctgcaccacctccatcagtcactgtgggtggcagtctttcctccgtcttgggccctcccgttcctgaaattaaagtgaaagaagaagtagaaccaatggatatcatgaggccagtttctgcagttcctccactggctaccaacactgtgtctccatctcttgcattgctggcaaacaacttgtccatgcctacaagtgacctaccacctggtgcctccccaaggaaaaagcctcgaaagcaacagcatgtgatctcaacagaagaaggtgacatgatggagacaaacagcactgatgatgagaagtccactgccaagagtcttctggtgaaggctgagaagcgcaagtctcctcccaaggagtatattgatgaggaaggtgtgagatatgtcccagtgcgtccaagaccccccattactttgcttcgtcactatcggaacccctggaaagctgcttaccaccactttcagaggtacagtgacgtccgggtcaaagaggagaagaaagctatgctgcaggaaatagctaatcagaaaggagtatcctgtcgtgctcaaggctggaaagtccacctctgtgctgcccagttactacagctgacgaatctagaacatgatgtctatgaaagacttactaacctgcaggaagggattatcccaaagaaaaaagcagcaacagatgatgatctccaccgaataaacgaactgatacagggaaatatgcagaggtgtaaacttgtgatggatcaaatcagtgaagccagagactccatgcttaaggttttagatcataaagaccgtgtcctgaagctgcttaacaagaacgggactgtcaaaaaagtgtccaaattgaagcgaaaggaaaaagtctagacccagaacaatcaggagattggaagcaaatttatgaagaatgatggtgggggtggggggagggttttggttttttccaaagtggaacattgaaataaaggaagtgttccttagttcccgtgtgaaagcagaggaacccatgacatccaagggcgtgaaaggatcagagctgactggacatagtgagctgccttcttgcgttcgggtgcacccctgttaaacctgatctgtgtcataagtgactccggatgcatcagtgtccaccagttggaagcaatgacaaggatggctggctggtgtttttcagccttccggtttatagactgtatttatctagtggattcctgcaggccccatactgagcctggactgaaagtatccactcggaccatctgttatctctctacactgaaaataaaacctcttccacccaccccattcggttcttctgcctgaccttcaaatgcccatgttggccttttacagcagtgccacggcaccaagcgagctgccacatctcacactctaaagggtttgaactattagttcttgtcattttttaaaaaaaaccattcccaagtgaaattgttatatcgtctgtcttgcgtgtgtcagaactgggtttttgtggaggttcagagcaggcaacaccataagttgctctcagatccttgttctgaagtacattcttggttatctgtacttctgtagctggtgtgatgctgttaattgtatgtaccacacatctccagacgttaataaaggactcaaagaggtttttgtacttg

SEQ ID NO: 181735 - DNA, 4173 bp, Homo sapiens
  Payload ID: 15791
  Gene Symbol: SAP130
  Gene Name: Sin3A-associated protein, 130kDa
  Uniprot ID: Q9H0E3
  ENST ID: ENST00000357702
  CDS Start-End: 133-3384
aagaggactgcgagcacagcggcggccgggtggcgggggtgagtggggccagcggggctggacagcagcgggccccgggcgccgccgccgcgatccctccccgcgcccgccgagcacatcgccgccgccgagatgggccctccgcggcacccccaggccggcgagatagaagcgggcggtgcgggcggcgggcggcggctacaggtggaaatgagttctcaacagtttcctcggttaggagccccttctaccgggctgagccaggccccttctcagattgcaaacagtggttctgctggattgataaacccagctgctacagtcaatgatgaatctggtcgagattctgaagtcagtgccagggagcacatgagttccagcagctccctccagtcccgggaggagaagcaagagcctgttgtggtaaggccctatccacaggtgcagatgttgtcgacacaccatgctgtcgcatcagccacacctgttgcagtgacagccccgccagcacacctgacgccagcagtgccactttcattttcggagggacttatgaagccgcccccgaagcccaccatgcctagccgtcccattgctcctgctccaccttctaccctgtcacttccccccaaggttccagggcaggttaccgttaccatggagagtagcatccctcaagcttcagccattcctgtggcaacaatcagtggacaacagggccatcccagtaacctgcatcacatcatgactacaaatgtgcaaatgtctatcatccgcagcaatgctcctgggccccctcttcacattggagcttctcatttacctcgaggtgcagctgctgctgctgtgatgtccagttctaaagtaaccacagtcctgaggccgacctcacagctgccaaatgctgctactgctcagccagcagtacagcacatcattcaccaaccaatccagtctcggccacctgtgaccacctccaatgccatccctcctgctgtggtagcaactgtctcagccaccagagctcagtctccagtcatcactacgacagcggcgcatgctactgattcagcacttagtaggccaaccttgtctatccagcatcctccatctgcagcaatcagtattcagcgtcctgcccagtcacgagatgtcacaacaagaatcacactaccatctcaccctgcattagggacgccaaaacagcagcttcatacaatggctcagaaaacaatcttcagtactggcacgccagtggctgcagccacagtagcacctattttggcaaccaacaccattccttcagcgaccacagctggatctgtgtcacacacgcaagctcccacaagtaccattgttaccatgacagtaccctcccattcctcccatgctactgctgtgaccacctcaaacatcccagtcgccaaggtggtgccccagcagatcacgcacacttctcctcggatccagccagactaccctgccgagaggagtagcctgattcccatctccggacatcgggcctctcccaatcctgtggccatggaaacccgaagtgacaacagaccgtctgttcccgttcagttccaatattttttgccaacttaccccccttctgcatacccactggcggcacatacctacaccccaatcaccagttccgtgtccactatccgacagtatccagtttcagctcaggctccaaactctgccatcacagctcagactggtgttggggtagcgtctaccgtccacctaaaccccatgcagttgatgacagtggatgcatcgcatgctcgacatattcaagggatccagccagcacccatcagtacccagggtatccagccggcccccattgggaccccagggatacagcctgcaccacttggcacacagggaattcactcagcaaccccaatcaacacacaagggcttcagcctgcacctatgggtactcagcagcctcagcctgaaggaaagacttcagcagtggtgttggcagatggagccacaattgtggccaaccctattagcaatccattcagtgctgctccagcagcaacaaccgtggtgcagacccacagccagagtgctagcaccaacgctcccgcccagggctcatcgccacggccaagcatactccggaagaaacctgccacagatggaatggcagttcggaaaaccctcattcctcctcagcctcctgatgttgctagtcctcgagtggaaagctctatgcggagtacgtctgggtcacctaggcctgcaggtgccaaacccaagtctgaaatccacgtgtctatggccactccggtcactgtgtccatggagactgtatccaatcaaaataatgatcagcctaccattgccgtccctccaactgcccagcagcccccaccgaccattccaactatgattgcagcagccagtcccccgtcacaaccagccgttgccctttcaaccattcctggagcggtccccatcactccacccatcaccaccattgcagctgcaccacctccatcagtcactgtgggtggcagtctttcctccgtcttgggccctcccgttcctgaaattaaagtgaaagaagaagtagaaccaatggatatcatgaggccagtttctgcagttcctccactggctaccaacactgtgtctccatctcttgcattgctggcaaacaacttgtccatgcctacaagtgacctaccacctggtgcctccccaaggaaaaagcctcgaaagcaacagcatgtgatctcaacagaagaaggtgacatgatggagacaaacagcactgatgatgagaagtccactgccaagagtcttctggtgaaggctgagaagcgcaagtctcctcccaaggagtatattgatgaggaaggtgtgagatatgtcccagtgcgtccaagaccccccattactttgcttcgtcactatcggaacccctggaaagctgcttaccaccactttcagaggtacagtgacgtccgggtcaaagaggagaagaaagctatgctgcaggaaatagctaatcagaaaggagtatcctgtcgtgctcaaggctggaaagtccacctctgtgctgcccagttactacagctgacgaatctagaacatgatgtctatgaaagacttactaacctgcaggaagggattatcccaaagaaaaaagcagcaacagatgatgatctccaccgaataaacgaactgatacagggaaatatgcagaggtgtaaacttgtgatggatcaaatcagtgaagccagagactccatgcttaaggttttagatcataaagaccgtgtcctgaagctgcttaacaagaacgggactgtcaaaaaagtgtccaaattgaagcgaaaggaaaaagtctagacccagaacaatcaggagattggaagcaaatttatgaagaatgatggtgggggtggggggagggttttggttttttccaaagtggaacattgaaataaaggaagtgttccttagttcccgtgtgaaagcagaggaacccatgacatccaagggcgtgaaaggatcagagctgactggacatagtgagctgccttcttgcgttcgggtgcacccctgttaaacctgatctgtgtcataagtgactccggatgcatcagtgtccaccagttggaagcaatgacaaggatggctggctggtgtttttcagccttccggtttatagactgtatttatctagtggattcctgcaggccccatactgagcctggactgaaagtatccactcggaccatctgttatctctctacactgaaaataaaacctcttccacccaccccattcggttcttctgcctgaccttcaaatgcccatgttggccttttacagcagtgccacggcaccaagcgagctgccacatctcacactctaaagggtttgaactattagttcttgtcattttttaaaaaaaaccattcccaagtgaaattgttatatcgtctgtcttgcgtgtgtcagaactgggtttttgtggaggttcagagcaggcaacaccataagttgctctcagatccttgttctgaagtacattcttggttatctgtacttctgtagctggtgtgatgctgttaattgtatgtaccacacatctccagacgttaataaaggactcaaagaggtttttgtacttgc

SEQ ID NO: 181736 - DNA, 849 bp, Homo sapiens
  Payload ID: 15791
  Gene Symbol: SAP130
  Gene Name: Sin3A-associated protein, 130kDa
  ENST ID: ENST00000424298
  CDS Start-End: 63-849
caggggcaggttcgggggaagaggactgcgagcacagcggcggccgggtggcgggggtggaaatgagttctcaacagtttcctcggttaggagccccttctaccgggctgagccaggccccttctcagattgcaaacagtggttctgctggattgataaacccagctgctacagtcaatgatgaatctggtcgagattctgaagtcagtgccagggagcacatgagttccagcagctccctccagtcccgggaggagaagcaagagcctgttgtggtaaggccctatccacaggtgcagatgttgtcgacacaccatgctgtcgcatcagccacacctgttgcagtgacagccccgccagcacacctgacgccagcagtgccactttcattttcggagggacttatgaagccgcccccgaagcccaccatgcctagccgtcccattgctcctgctccaccttctaccctgtcacttccccccaaggttccagggcaggttaccgttaccatggagagtagcatccctcaagcttcagccattcctgtggcaacaatcagtggacaacagggccatcccagtaacctgcatcacatcatgactacaaatgtgcaaatgtctatcatccgcagcaatgctcctgggccccctcttcacattggagcttctcatttacctcgaggtgcagctgctgctgctgtgatgtccagttctaaagtaaccacagtcctgaggccgacctcacagctgccaaatgctgctactgctcagccagcagtacagcacatcattcaccaaccaatccagtctcggccacctgtgaccacctccaatgccatccctcctgctg

SEQ ID NO: 181737 - DNA, 559 bp, Homo sapiens
  Payload ID: 15791
  Gene Symbol: SAP130
  Gene Name: Sin3A-associated protein, 130kDa
  ENST ID: ENST00000450957
  CDS Start-End: 127-559
agagtgctagctccccggcggtggctgcgggtccggagcctggggacgtcggccccacagacggagagcgcgcgggagcgagctcaaggcggcgcggcggccactgggcgcagcacccaggtggaaatgagttctcaacagtttcctcggttaggagccccttctaccgggctgagccaggccccttctcagattgcaaacagtggttctgctggattgataaacccagctgctacagtcaatgatgaatctggtcgagattctgaagtcagtgccagggagcacatgagttccagcagctccctccagtcccgggaggagaagcaagagcctgttgtggtaaggccctatccacaggtgcagatgttgtcgacacaccatgctgtcgcatcagccacacctgttgcagtgacagccccgccagcacacctgacgccagcagtgccactttcattttcggagggacttatgaaggttccagggcaggttaccgttaccatggagagtagcatccctcaagcttcagccattcctgtggcaacaatcagtggacaacagg

SEQ ID NO: 181738 - DNA, 2298 bp, Homo sapiens
  Payload ID: 15792
  Gene Symbol: SAP18
  Gene Name: Sin3A-associated protein, 18kDa
  ENST ID: ENST00000382533
  CDS Start-End: 40-558
taaagtgtcgagcttctcctcgcgagagacttagtgctcatgctcgctgcaggggtcggaggtcagggcgagcgtctcgcaggccgtaggaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcaaccttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgattattgccattaagcctttaaattctaaacaaattataatgcatcatctatttaggagttagatttggatgtgctattgtatgattacgaatagtctgtatgtttcaagcccttctgtaaaatatgaagaaaagtgctcttagcattctgtgtaaaactgtactgttaaatatatgtgtgtaatcagcctgagtgtgaaagttaatggaggcctgggaacagggtttatactaagtagtggaggagcgtatggttaagcccaaaggggcagaacaagaaagccacgggattgtatgaaatcaaacatgagtttgtggtgtagactgctgtatgcagttggaaaggacacgtgagagtgagctcaagtggcagcagaggcagtttggaataagctgcggcaagttgaagaagctgtgttggacgagattgccccgccttgatcagggtaccatgacataaaaggttaaagaacaggcaacacaatgagcacttaagtttttaacatgtggggaatagggcattttaaaggctggaaccagttcagaggaaacaagggtttgggtagaggtagaaaggtttaattaaccctggagatctgcaaatggagggaggggtgaaggaggaatcttaagaccgagggagaagagccaaggacaaggtcaggttgaatgagtaggaggtgttcacacatcctcttgtgtgctaggtagtggcgtgcatctgatctgagaggcagtaaagcagtgatgaagacagtgcagcagaacattgaagtcctgattgcagcagtgactctgcaaccttggataaattatttcaatctttattttgtaaaacggagataacggcctataggattgttaagactgaatattttaaaagagcttagaatggtgcctgacaaatgagaaacaataaatactgattattggccataaagtggtattaaaactggatctcttttcttccatggcactactctcattttgaagtttatgaacagtacgacagtgtattgtaaattccctttagtttgttacagtagccaattgaaaatgtatatcccaaaatttaaaaaaaaaagtaccagcagcaataaaattgcactagttttatctggtacatacaaaaacagccatttaaaatctgatgattctgtggaattggtgtccctgttagcaatggcagagaccagcctggagcctagatctggtgcttcttctgtgctgtggtttaccccaaacctttaggttgtttattcattcagattagatagactggagccataaagttaatttgcacctagctttttggagaatagccatgattaactgctattcgtggtgggggtgggggggaaccctatgatttactatgcagatgaagagggtaggaactaaataaaggactttgtaagccaaagtggttgggctgctttgtcaaattccaccctttgcttggttccaacatggaatttctcctttaaagatttcaatatcccatcaaaagtacagttagagaatacctagtgaatttattgaatataatgctaagaatcaaaagacttgtactagtttacctctggctttggtaagtgtggctttgagtaataactgagctgtttccccgcatataaaatagaaataaataagtagtcatcatgaca

SEQ ID NO: 181739 - DNA, 479 bp, Homo sapiens
  Payload ID: 15792
  Gene Symbol: SAP18
  Gene Name: Sin3A-associated protein, 18kDa
  ENST ID: ENST00000450573
  CDS Start-End: 50-479
gtttttggtctcggggaggctcggaggccgcaacgcctcgggaagagagatgagctccgggttcgcagctggtgtttttaacttctgcccttccgttttctctctccctcagacatgcccactgttgctacgggtcttcaccaccaataacggccgccaccaccgaatggacgagttctcccggggaaatgtaccgtccagcgagttgcagatctacacttggatggatgcaaccttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctcctt

SEQ ID NO: 181740 - DNA, 670 bp, Homo sapiens
  Payload ID: 15792
  Gene Symbol: SAP18
  Gene Name: Sin3A-associated protein, 18kDa
  ENST ID: ENST00000467636
  CDS Start-End: 1-237
acatgcccactgttgctacgggtcttcaccaccaataacggccgccaccaccgaatggacgagttctcccggggaaatgtaccgtccagcgagttgcagatctacacttggatggatgcaaccttgaaagaactgacaagcttagtaaaagaagtctacccagaagctagaaagaagggcactcacttcaattttgcaatcgtttttacagatgttaaaagacctggctatcgttgattttctttcttacagagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgattattgccattaagcctttaaattctaaacaaattataatgcatcatctatttaggagttagatttggatgtgctattgtatgattacgaatagtctgtatgtttcaagcccttctgtaaaatatgaagaaaagtgctcttagcattctgtgtaaaactgtactgttaaatatatgtgtgtaatcag

SEQ ID NO: 181741 - DNA, 405 bp, Homo sapiens
  Payload ID: 15792
  Gene Symbol: SAP18
  Gene Name: Sin3A-associated protein, 18kDa
  ENST ID: ENST00000492245
  CDS Start-End: 1-178
ggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttgagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccc

SEQ ID NO: 181742 - DNA, 2234 bp, Homo sapiens
  Payload ID: 15792
  Gene Symbol: SAP18
  Gene Name: Sin3A-associated protein, 18kDa
  Uniprot ID: O00422
  ENST ID: ENST00000607003
  CDS Start-End: 33-494
agggcgagcgtctcgcaggccgtaggaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcaaccttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgattattgccattaagcctttaaattctaaacaaattataatgcatcatctatttaggagttagatttggatgtgctattgtatgattacgaatagtctgtatgtttcaagcccttctgtaaaatatgaagaaaagtgctcttagcattctgtgtaaaactgtactgttaaatatatgtgtgtaatcagcctgagtgtgaaagttaatggaggcctgggaacagggtttatactaagtagtggaggagcgtatggttaagcccaaaggggcagaacaagaaagccacgggattgtatgaaatcaaacatgagtttgtggtgtagactgctgtatgcagttggaaaggacacgtgagagtgagctcaagtggcagcagaggcagtttggaataagctgcggcaagttgaagaagctgtgttggacgagattgccccgccttgatcagggtaccatgacataaaaggttaaagaacaggcaacacaatgagcacttaagtttttaacatgtggggaatagggcattttaaaggctggaaccagttcagaggaaacaagggtttgggtagaggtagaaaggtttaattaaccctggagatctgcaaatggagggaggggtgaaggaggaatcttaagaccgagggagaagagccaaggacaaggtcaggttgaatgagtaggaggtgttcacacatcctcttgtgtgctaggtagtggcgtgcatctgatctgagaggcagtaaagcagtgatgaagacagtgcagcagaacattgaagtcctgattgcagcagtgactctgcaaccttggataaattatttcaatctttattttgtaaaacggagataacggcctataggattgttaagactgaatattttaaaagagcttagaatggtgcctgacaaatgagaaacaataaatactgattattggccataaagtggtattaaaactggatctcttttcttccatggcactactctcattttgaagtttatgaacagtacgacagtgtattgtaaattccctttagtttgttacagtagccaattgaaaatgtatatcccaaaatttaaaaaaaaaagtaccagcagcaataaaattgcactagttttatctggtacatacaaaaacagccatttaaaatctgatgattctgtggaattggtgtccctgttagcaatggcagagaccagcctggagcctagatctggtgcttcttctgtgctgtggtttaccccaaacctttaggttgtttattcattcagattagatagactggagccataaagttaatttgcacctagctttttggagaatagccatgattaactgctattcgtggtgggggtgggggggaaccctatgatttactatgcagatgaagagggtaggaactaaataaaggactttgtaagccaaagtggttgggctgctttgtcaaattccaccctttgcttggttccaacatggaatttctcctttaaagatttcaatatcccatcaaaagtacagttagagaatacctagtgaatttattgaatataatgctaagaatcaaaagacttgtactagtttacctctggctttggtaagtgtggctttgagtaataactgagctgtttccccgcatataaaatagaaataaataagtagtcatcatgaca

SEQ ID NO: 181743 - DNA, 2300 bp, Homo sapiens
  Payload ID: 15792
  Gene Symbol: SAP18
  Gene Name: Sin3A-associated protein, 18kDa
  ENST ID: ENST00000621421
  CDS Start-End: 40-558
taaagtgtcgagcttctcctcgcgagagacttagtgctcatgctcgctgcaggggtcggaggtcagggcgagcgtctcgcaggccgtaggaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcaaccttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgattattgccattaagcctttaaattctaaacaaattataatgcatcatctatttaggagttagatttggatgtgctattgtatgattacgaatagtctgtatgtttcaagcccttctgtaaaatatgaagaaaagtgctcttagcattctgtgtaaaactgtactgttaaatatatgtgtgtaatcagcctgagtgtgaaagttaatggaggcctgggaacagggtttatactaagtagtggaggagcgtatggttaagcccaaaggggcagaacaagaaagccacgggattgtatgaaatcaaacatgagtttgtggtgtagactgctgtatgcagttggaaaggacacgtgagagtgagctcaagtggcagcagaggcagtttggaataagctgcggcaagttgaagaagctgtgttggacgagattgccccgccttgatcagggtaccatgacataaaaggttaaagaacaggcaacacaatgagcacttaagtttttaacatgtggggaatagggcattttaaaggctggaaccagttcagaggaaacaagggtttgggtagaggtagaaaggtttaattaaccctggagatctgcaaatggagggaggggtgaaggaggaatcttaagaccgagggagaagagccaaggacaaggtcaggttgaatgagtaggaggtgttcacacatcctcttgtgtgctaggtagtggcgtgcatctgatctgagaggcagtaaagcagtgatgaagacagtgcagcagaacattgaagtcctgattgcagcagtgactctgcaaccttggataaattatttcaatctttattttgtaaaacggagataacggcctataggattgttaagactgaatattttaaaagagcttagaatggtgcctgacaaatgagaaacaataaatactgattattggccataaagtggtattaaaactggatctcttttcttccatggcactactctcattttgaagtttatgaacagtacgacagtgtattgtaaattccctttagtttgttacagtagccaattgaaaatgtatatcccaaaatttaaaaaaaaaagtaccagcagcaataaaattgcactagttttatctggtacatacaaaaacagccatttaaaatctgatgattctgtggaattggtgtccctgttagcaatggcagagaccagcctggagcctagatctggtgcttcttctgtgctgtggtttaccccaaacctttaggttgtttattcattcagattagatagactggagccataaagttaatttgcacctagctttttggagaatagccatgattaactgctattcgtggtgggggtgggggggaaccctatgatttactatgcagatgaagagggtaggaactaaataaaggactttgtaagccaaagtggttgggctgctttgtcaaattccaccctttgcttggttccaacatggaatttctcctttaaagatttcaatatcccatcaaaagtacagttagagaatacctagtgaatttattgaatataatgctaagaatcaaaagacttgtactagtttacctctggctttggtaagtgtggctttgagtaataactgagctgtttccccgcatataaaatagaaataaataagtagtcatcatgacagc

SEQ ID NO: 181744 - DNA, 837 bp, Homo sapiens
  Payload ID: 15793
  Gene Symbol: SAP25
  Gene Name: Sin3A-associated protein, 25kDa
  Uniprot ID: Q8TEE9
  ENST ID: ENST00000538735
  CDS Start-End: 179-778
gagcgccggagcggacgcccccagggagctggggacacccccatgggacagcccttcctggatctggagagagcagctgctgctgccccaccacctgccaggcccggccactgagcagccccccggagccccagatccccgttccccccaggtggcctgggaggtggccccctcgaggatgactccactagcgccctgggaccccaagtatgaagccaaagcaggacctcggccggtgtggggggccaactgtagctcaggagcctcgttctcaggccggacgctgtgtcacccctcattctggccgctgtatgaagcagcctcgggcaggggtctcaggcccgtggcccctgccacagggcactggaatggacagcaggcgcccccagatgcagggttcccggtggtgtgctgtgaagatgtcttcctctcggaccctctgctgccccgggggcagcgtgttcccctgtacctgtccaaggccccccagcagatgatgggctccctgaaactgctgccgccgccccccatcatgtctgccagggtgctcccccgcccatcaccctcccggggcccctccactgcctggctcagcgggccggagctgatcgctctcactggcctgctgcagatgagccagggggagcctaggcccagctcctccgcggttggccccccagaccatacctctgacccacccagcccctgtggtagccccagcagttctcagggtgctgacctctctctcccacagaccccagacacccattgtccatagccttctcagggcagagtgggctggttgtgttgacaataaaacagtgttggtttgcaaaa

SEQ ID NO: 181745 - DNA, 987 bp, Homo sapiens
  Payload ID: 15793
  Gene Symbol: SAP25
  Gene Name: Sin3A-associated protein, 25kDa
  Uniprot ID: Q8TEE9
  ENST ID: ENST00000614631
  CDS Start-End: 357-956
cccatgggacaggtgaggggctcggacggagccgtggggggacagcgactgggggcctccatgccttcaccacgcgctctacggaggcttctccattgtccctgctggagattgggtccctcggtctcccttgcaccaggcacccttgggctccaggggagggtgcgtgggggcggtgtggctgcagcctcagtccctgcccctccagcccacagcccccatcccgtagcccttcctggatctggagagagcagctgctgctgccccaccacctgccaggcccggccactgagcagccccccggagccccagatccccgttccccccaggtggcctgggaggtggccccctcgaggatgactccactagcgccctgggaccccaagtatgaagccaaagcaggacctcggccggtgtggggggccaactgtagctcaggagcctcgttctcaggccggacgctgtgtcacccctcattctggccgctgtatgaagcagcctcgggcaggggtctcaggcccgtggcccctgccacagggcactggaatggacagcaggcgcccccagatgcagggttcccggtggtgtgctgtgaagatgtcttcctctcggaccctctgctgccccgggggcagcgtgttcccctgtacctgtccaaggccccccagcagatgatgggctccctgaaactgctgccgccgccccccatcatgtctgccagggtgctcccccgcccatcaccctcccggggcccctccactgcctggctcagcgggccggagctgatcgctctcactggcctgctgcagatgagccagggggagcctaggcccagctcctccgcggttggccccccagaccatacctctgacccacccagcccctgtggtagccccagcagttctcagggtgctgacctctctctcccacagaccccagacacccattgtccatagccttctcagggcagagtgggctggttgtgtt

SEQ ID NO: 181746 - DNA, 1031 bp, Homo sapiens
  Payload ID: 15793
  Gene Symbol: SAP25
  Gene Name: Sin3A-associated protein, 25kDa
  ENST ID: ENST00000622764
  CDS Start-End: 79-972
gcgccgcggagggaggctgagagggccgggccgggcggcggggacacggcggtaccgtcctgcgctcgggaacgcggaatgttgccctggtcgccgccgcggtggggcgcgggcccggaggaggcgcccgagggaccaggccttccggcgggcaaggaccagggcgagccctggagcgccggagcggacgcccccagggagctggggacacccccatgggacagcccacagcccccatcccgtagcccttcctggatctggagagagcagctgctgctgccccaccacctgccaggcccggccactgagcagccccccggagccccagatccccgttccccccaggtggcctgggaggtggccccctcgaggatgactccactagcgccctgggaccccaagtatgaagccaaagcaggacctcggccggtgtggggggccaactgtagctcaggagcctcgttctcaggccggacgctgtgtcacccctcattctggccgctgtatgaagcagcctcgggcaggggtctcaggcccgtggcccctgccacagggcactggaatggacagcaggcgcccccagatgcagggttcccggtggtgtgctgtgaagatgtcttcctctcggaccctctgctgccccgggggcagcgtgttcccctgtacctgtccaaggccccccagcagatgatgggctccctgaaactgctgccgccgccccccatcatgtctgccagggtgctcccccgcccatcaccctcccggggcccctccactgcctggctcagcgggccggagctgatcgctctcactggcctgctgcagatgagccagggggagcctaggcccagctcctccgcggttggccccccagaccatacctctgacccacccagcccctgtggtagccccagcagttctcagggtgctgacctctctctcccacagaccccagacacccattgtccatagccttctcagggcagagtgggctggttgtgttgacaataaaacagtgttggtttgcaaaa

SEQ ID NO: 181747 - DNA, 1108 bp, Homo sapiens
  Payload ID: 15794
  Gene Symbol: SAP30
  Gene Name: Sin3A-associated protein, 30kDa
  Uniprot ID: O75446
  ENST ID: ENST00000296504
  CDS Start-End: 241-903
ccccatgtgacagtgagcggggtccccgctccaggagacgctcgagtctgcgtcccggccctcagcactgtccactgtttcggtgccagcagagaccagcaggcccgggacagttggtgtttggccgtgccgctgtctaacttggtgtgcagagtgaattgccgctgccggagcggagagaggcggagcggccaggagagaggggatttctgtcagcgccggcctcgggagctcggagacatgaacggcttcacgcctgacgagatgagccgcggcggggatgcggccgccgcagtggccgcagtggtcgctgccgcggccgccgccgcctcggcggggaacgggaccggcgcgggcaccggggctgaggtgccgggcgcgggggcggtctcagcggctgggcccccgggggcggccgggccgggccccgggcaactgtgctgcctgcgggaggatggtgagcggtgcggccgggcggcaggcaacgccagcttcagcaagaggatccagaagagcatctcccagaagaaggtgaagatcgagctggataagagcgcaaggcatctttacatatgtgattatcataaaaacttaattcagagtgttcgaaacagaagaaagagaaaagggagtgatgatgatggaggtgattcacctgttcaagatattgataccccagaggttgatttataccaattacaagtaaatacacttaggagatacaaaagacacttcaagctaccaaccagaccaggacttaataaagcacaacttgttgagatagttggttgccactttaggtctattccagtgaatgaaaaagacaccttaacatatttcatctactcagtgaagaatgacaagaacaaatcagatctcaaggttgatagtggtgttcactaggagacgtggaattgagactaataacttggatgttaacactgtttactgttttttcacatgtagaaatgttctttgtgtattttttctacagaggattttctctgattttattttctttgtttctgactctaataattagttggaaactcatataaaatgagctttcctaaattaaatctattttaaataaaggttattactatta

SEQ ID NO: 181748 - DNA, 5245 bp, Homo sapiens
  Payload ID: 15795
  Gene Symbol: SOBP
  Gene Name: sine oculis binding protein homolog
  Uniprot ID: A7XYQ1
  ENST ID: ENST00000317357
  CDS Start-End: 660-3281
agccacgcccgctcgagagccggggggctgtcctcgccccccccacctttcccctccctccgaccccctcccggccgcgctccctcccctcctcccgcgccggcccccggcccgcccccggctcggctcgcgggaggcgctgggcgccggggctggcgcgctctcccgggctcacacacagccgcgcacgcacgcccggggccgctctccgcgccggcccttgctccccgcgcccatgcggacggaccgagcgacggaagatggctgacgactccacggggccccgaggatgcggcccggcggcggcggcggcgggagcggcagcggcagcgagggcggcaggggcagcggcagcagcggcggcgttggctgcggcggcggcggcggcggcagcaggagccggagcgacggcggcggcatccccgagactctccgcactatccttacccgtgacagccactgacgtcctccgccgctagaagagaccccgcttctcggcgcctgccctccccctcgcggctcggtccggccccgccagcaccgctacctccgccagcctcgccaccatcagcaccacctccaccgccgccgccgccgccaccaccaccgccggcggcggcagcagccatttcatctccacagaaaccagacacaaaaacatggcagaaatggagaaagaagggagacctcccgaaaataaacggagcaggaagccggctcacccagtgaaaagggagatcaatgaggagatgaagaactttgcagaaaacaccatgaatgaactccttggctggtatggctatgataaggttgaattaaaagatggtgaggatattgaattcaggagctaccctacagatggggagagccggcagcacatttctgttctcaaagaaaattctttgccaaaaccaaaattacccgaggacagtgttatttcaccatacaatataagcacaggctattcagggcttgccactggaaatggactcagtgactcacctgcagggtcaaaggatcatggcagtgtgcccattattgtacctttaattccaccacctttcataaagccaccagcagaagatgatgtgtcaaatgtacaaataatgtgtgcctggtgccagaaagtgggaatcaagcgctattccctgagtatgggaagtgaggtgaaaagcttctgcagcgagaagtgctttgcggcctgccgacgagcctacttcaagagaaataaggctagagatgaagatggacatgctgaaaattttccccagcagcactatgctaaggaaactccaaggcttgccttcaagaataactgcgaactacttgtatgtgactggtgtaagcacataagacacacaaaagaatacctggattttggggacggggaaagaaggcttcagttctgcagtgcaaaatgtctcaatcaatacaaaatggacattttctacaaagagacccaggccaatcttccagctgggctgtgcagcacattacaccctcccatggaaaataaagcagaaggcaccggggtgcagctgctcactccagactcttggaatatcccgctaacagatgctcggaggaaggccccctccccggtggctacagctggccaaagccagggccctggcccgtcggcgtccaccaccgtctctccatctgacactgccaactgctctgtcactaaaatccccacgccagtgcccaagtccatccccatcagcgagactccaaatatccctcctgtctccgtccagccacctgctagcatcgggcctccccttggcgtcccgcctcggagccctcccatggtgatgaccaaccgcggcccggtgccgctgcccatcttcatggagcagcagatcatgcagcagatccgcccgcccttcatccgcgggcctccgcaccatgcctccaaccccaacagccccctgtccaaccccatgcttcccggcatcgggcccccgcccggtggccccagaaacctgggccccacttccagccccatgcaccggcccatgctatcgccccacatccaccccccgagcacccccaccatgcccgggaaccccccaggcctgctgcccccgccgcctccgggcgccccgctgccgagtcttcccttcccgccagtgagcatgatgccaaatggcccgatgccggtgccccagatgatgaatttcgggctgccgtcgcttgccccgctggtgccgcccccgaccctgctcgtgccgtaccccgtgatcgtgcccctaccggtgcccatccccatccccatccctatccctcacgtcagcgactccaagccccccaacgggttctccagcaacggggagaacttcattccgaacgcccctggcgactccgcggcggcgggcggcaagccaagcggacactccctgtccccccgggactccaagcagggctcgtccaagtccgcggactcgccccccggctgctcgggccaggccctgagcctggcgcccacgcccgccgagcatggccggagcgaggtggtggacctgacgcggcgcgccggcagccccccgggccccccgggcgcgggcggccagctcggcttcccaggcgtgctgcagggcccgcaggacggcgtcatcgacctgaccgtgggccaccgagcccggctgcacaacgtgatccaccgcgcgctgcacgcgcacgtcaaggcggagcgcgagccgagcgccgcggagcgcaggacctgcggcggctgcagggacggccactgcagcccgcccgccgccggcgacccaggcccgggcgccccggcgggccccgaggcggccgcggcctgcaacgtcatcgtgaacggcacgcgcggcgccgccgccgagggcgctaagagcgcggagccgcctcccgagcagccgccgccgccgccgccgcccgcgccccccaagaagctgctgtcgcctgaggaaccggcggtgagcgagctagagtcggtcaaggagaataactgtgcttccaactgccacctggacggggaggcggccaaaaagctgatgggcgaggaggccctggcggggggcgacaagtcagacccgaaccttaataaccccgcggacgaggaccatgcctatgctctgcggatgctgcccaagaccggctgcgtgatccagcctgtgccaaaacccgcggagaaggctgccatggcaccgtgcatcatctcctcgcccatgctcagcgccgggcctgaggacctggagccgccgctcaaaaggaggtgcctccgaattagaaatcagaataagtaaaaggaacgttcactcacagggtacgctcatggagagagggcgcagagcaaaccatgtcacgccatccaatgacaccagctggtcagctcaccaccccctctggctaaaactcaagcaaataaagccgcttcctgtcattaagcatctcagaggaagcagccctccctcgatggcctctagcccagagaagcccgcgcatcttggacccaccaagcaggcccagccttcctgctgccaccatctctgcttctccccagaggaacttagggatttcacccctggcttttaaaaaaaacgaaataccgacaagccacaaggaccaatgtaggtattctccccgccccatcttcaaggctcagcgactgaggctggaagatgatatggattggaacacaaaaaatctttttttaatctttttaaaaactgctgtggttttgctgctacactaagaattgtgatttgcattgtacggttttggacctatattgttcacgttttgatggcggagaggggtggtcctggaggcccaatgcttcagagtcatctctgtcctgcccgggatgcacttttaaatgaagagttagaatattttattggctaatatacttttcttgttatttttacaaaggccacctttatcctttttgatgccatattttcagtgttacacttttatggcttttaattttcgatttgacagatgtaagaagcagcatgaatagtttatactgtggtttttcagagactgaatgccaagagaactcggtaaatgtttattcttctcagctttctctttaaattcccctaaatagcgccccatttgggaacagagcaagagtgttgaactgaagaccaaaatgccctcaaggtgtaaaataatccgagggggaatatttgctgggcgtcaggaaagactcagatgaaatttcaaccctgatggttttcggtgatccaggaagtcagtgagacaatctctctatatgcagagccctttcatgataattagaatggtatggacaaaccaatgaaaacaagagggaaagtgagaaagatcacccatgattctgtttcactgtttgctttctcctgtcatggttaagagaaatgtgcaattcgatcctcaatcagtgggtggaggataacagggtagattcacttgtgtgcacttgtacagttgtagctgcgagtccagaagtcctctagagcatgtgtactggcactgagttggtgagacagttgtggagtatcccattctgatgagtacagaaaaaaaaagaaaaagaaaagaagagaaaaaattaagaaaaaaatcaaaaaaggaagaaaactaaaaaaaaaaaaaatcaaatcaccttgtgattcagtgtatctgtttactaactcaaataaagcaattgttccctctggaggggtccaggtgcccccgccccacaaggccgcggagcctcagcaggaggggtggcgagttgcgggtgggcagggccaggacggtgtggcgccagccttgaagcaccacggcccaaggatgcggtgtacatactgtatttctagattctcctttgtacagagtcacttcacaagtcaagctactgttttacaggtgctccttatttattagagctgtgagagcttgggggacacacctggcgagcaagctcgctttttaaaaatgaaatttgggggcaggggaaggggaggcgggagggaggggaagctcgcaagcccggggagagatttataaaagtaaacaaaagaaaaccttccagcaacaaattaaaaaataataacaaatcaaccccagcaccaaacccacccaggcaggaagaagccgcccctcctctggggccatatttttctgctgggtcacaacattctcctctccctgactggtgtcagattcatcaaacaaaaaataaatctcgaagaaaaaaaatgcacttacatgtgcttatttggcttttctc

SEQ ID NO: 181749 - DNA, 1550 bp, Homo sapiens
  Payload ID: 15795
  Gene Symbol: SOBP
  Gene Name: sine oculis binding protein homolog
  ENST ID: ENST00000618129
  CDS Start-End: 14-463
cagacacaaaaacatggcagaaatggagaaagaagggagacctcccgaaaataaacggagcaggaagccggctcacccagtgaaaagggagatcaatgaggagatgaagaactttgcagaaaacaccatgaatgaactccttggctggtatggctatgataaggttgaattaaaagatggtgaggatattgaattcaggagctaccctacagatggggagagccggcagcacatttctgttctcaaagaaaattctttgccaaaaccaaaattacccgaggacagtgttatttcaccatacaatataagcacaggctattcagggcttgccactggaaatggactcagtgactcacctgcagggtcaaaggatcatggcagtgtgcccattattgtacctttaattccaccacctttcataaagccaccagcagatgagaaaactgaggcccagaaaagttgagcaacttgcctgaggttacacagatactgagtggcagagctgatatttgaacctatacattatgtctccttagcctatatccttaaccactggattatccaaaacactatggcagtatttcagtcagttaagtatttactgaatgttccttacattgtgctagacaatacagatgtatgtcatcatccttgactaccaagaacttaatagtactgttggcatatgatcaaaacatcattctagttttaccttggaatgtatgatataattttagttgcatatggaaggtgcatggtaggactacaagggcaattaaagtggagtagcaaaaagtctataggcagataatcaagaactgttatatttatacagttgaggggaaatggcacctgaaacttaatataggctagaagatagcaattgaaaactcaaattcaaagtgataaaaaaagatccaaaatgaaacctgaaaatgttagatactatgatatgggtcctgctttattgttctctttacaattaagggttcttaaaaatgtgtaaggcacattttagtgtgttctatcatttttaatgccagatgaaatgtataatttgaatggtagcatgaggtggtgaagactgccagagcaagaaccaggagacctgggttgctaatgccagctctgccatttattggccatgtaatcttgaataaggtagtttctctaagccttagtttccttgtctgcaaaatgatgtggttagcttacatgatctgttatttccctatatttataaaatccttattttgtgacttgtatggttagttgctctcctgattttatgatttgagagggtatgttttaatgtgctttaacaggtacttgttaattgaacagatataaagcaaactgcatatatgtatagttataacagccagaagtctgatgaaagatttatactgcttgggacaagttttaatgattgttaatttttactttgaacaaatagtgaatgaaataatagatttgacattttttaagataacaagtgctaggaaatatgaaatgtgagtaaataaaaaggttcatatgttattagaact

SEQ ID NO: 181750 - DNA, 1639 bp, Homo sapiens
  Payload ID: 15796
  Gene Symbol: SIGIRR
  Gene Name: single immunoglobulin and toll-interleukin 1 receptor (TIR) domain
  Uniprot ID: Q6IA17
  ENST ID: ENST00000332725
  CDS Start-End: 227-1459
gttgccgctgcgcacctggctcaggtgagctgccccgcccccgcccggcgcgagccccaggtcctggcagcagcctctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagccatgccaggtgtctgtgatagggcccctgacttcctctccccgtctgaagaccaggtgctgaggcctgccttgggcagctcagtggctctgaactgcacggcttgggtagtctctgggccccactgctccctgccttcagtccagtggctgaaagacgggcttccattgggaattgggggccactacagcctccacgagtactcctgggtcaaggccaacctgtcagaggtgcttgtgtccagtgtcctgggggtcaacgtgaccagcactgaagtctatggggccttcacctgctccatccagaacatcagcttctcctccttcactcttcagagagctggccctacaagccacgtggctgcggtgctggcctccctcctggtcctgctggccctgctgctggccgccctgctctatgtcaagtgccgtctcaacgtgctgctctggtaccaggacgcgtatggggaggtggagataaacgacgggaagctctacgacgcctacgtctcctacagcgactgccccgaggaccgcaagttcgtgaacttcatcctaaagccgcagctggagcggcgtcggggctacaagctcttcctggacgaccgcgacctcctgccgcgcgctgagccctccgccgacctcttggtgaacctgagccgctgccgacgcctcatcgtggtgctttcggacgccttcctgagccgggcctggtgcagccacagcttccgggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtgactccttcctccgatttttggaaagaagtgcagctggcgctgccgcggaaggtgcagtacaggcctgtggaaggagacccccagacgcagctgcaggacgacaaggaccccatgctgattcttcgaggccgagtccctgagggccgggccctggactcagaggtggacccggaccctgagggcgacctgggtgtccgggggcctgtctttggagagccatcagctccaccgcacaccagtggggtctcgctgggagagagccggagcagcgaagtggacgtctcggatctcggctcgcgaaactacagtgcccgcacagacttctactgcctggtgtccaaggatgatatgtagctcccaccccagagtgcaggatcatagggacagcgggggccagggcagcggcgtcgctcctctgctcaacaggaccacaacccctgccagcagccctgggaccctgccagcagccctgggaaaaggctgtggcctcagggcgcctcccagtgccagaaaataaagtccttttggattctg

SEQ ID NO: 181751 - DNA, 1598 bp, Homo sapiens
  Payload ID: 15796
  Gene Symbol: SIGIRR
  Gene Name: single immunoglobulin and toll-interleukin 1 receptor (TIR) domain
  Uniprot ID: Q6IA17
  ENST ID: ENST00000397632
  CDS Start-End: 186-1418
ggtgagtggcggtcgccatcagacccgcgaagcctctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagccatgccaggtgtctgtgatagggcccctgacttcctctccccgtctgaagaccaggtgctgaggcctgccttgggcagctcagtggctctgaactgcacggcttgggtagtctctgggccccactgctccctgccttcagtccagtggctgaaagacgggcttccattgggaattgggggccactacagcctccacgagtactcctgggtcaaggccaacctgtcagaggtgcttgtgtccagtgtcctgggggtcaacgtgaccagcactgaagtctatggggccttcacctgctccatccagaacatcagcttctcctccttcactcttcagagagctggccctacaagccacgtggctgcggtgctggcctccctcctggtcctgctggccctgctgctggccgccctgctctatgtcaagtgccgtctcaacgtgctgctctggtaccaggacgcgtatggggaggtggagataaacgacgggaagctctacgacgcctacgtctcctacagcgactgccccgaggaccgcaagttcgtgaacttcatcctaaagccgcagctggagcggcgtcggggctacaagctcttcctggacgaccgcgacctcctgccgcgcgctgagccctccgccgacctcttggtgaacctgagccgctgccgacgcctcatcgtggtgctttcggacgccttcctgagccgggcctggtgcagccacagcttccgggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtgactccttcctccgatttttggaaagaagtgcagctggcgctgccgcggaaggtgcagtacaggcctgtggaaggagacccccagacgcagctgcaggacgacaaggaccccatgctgattcttcgaggccgagtccctgagggccgggccctggactcagaggtggacccggaccctgagggcgacctgggtgtccgggggcctgtctttggagagccatcagctccaccgcacaccagtggggtctcgctgggagagagccggagcagcgaagtggacgtctcggatctcggctcgcgaaactacagtgcccgcacagacttctactgcctggtgtccaaggatgatatgtagctcccaccccagagtgcaggatcatagggacagcgggggccagggcagcggcgtcgctcctctgctcaacaggaccacaacccctgccagcagccctgggaccctgccagcagccctgggaaaaggctgtggcctcagggcgcctcccagtgccagaaaataaagtccttttggattctg

SEQ ID NO: 181752 - DNA, 1720 bp, Homo sapiens
  Payload ID: 15796
  Gene Symbol: SIGIRR
  Gene Name: single immunoglobulin and toll-interleukin 1 receptor (TIR) domain
  Uniprot ID: Q6IA17
  ENST ID: ENST00000431843
  CDS Start-End: 308-1540
aagacacaagccaggtccccaccgcgcttggcgatgcatccatagcagccttggtgctgtggacactccctggggcccagcgaaggggagagtttgctcccaaaggcgcaccaatgaccaacatttgccccccggaggaaagaactggaaccagcctctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagccatgccaggtgtctgtgatagggcccctgacttcctctccccgtctgaagaccaggtgctgaggcctgccttgggcagctcagtggctctgaactgcacggcttgggtagtctctgggccccactgctccctgccttcagtccagtggctgaaagacgggcttccattgggaattgggggccactacagcctccacgagtactcctgggtcaaggccaacctgtcagaggtgcttgtgtccagtgtcctgggggtcaacgtgaccagcactgaagtctatggggccttcacctgctccatccagaacatcagcttctcctccttcactcttcagagagctggccctacaagccacgtggctgcggtgctggcctccctcctggtcctgctggccctgctgctggccgccctgctctatgtcaagtgccgtctcaacgtgctgctctggtaccaggacgcgtatggggaggtggagataaacgacgggaagctctacgacgcctacgtctcctacagcgactgccccgaggaccgcaagttcgtgaacttcatcctaaagccgcagctggagcggcgtcggggctacaagctcttcctggacgaccgcgacctcctgccgcgcgctgagccctccgccgacctcttggtgaacctgagccgctgccgacgcctcatcgtggtgctttcggacgccttcctgagccgggcctggtgcagccacagcttccgggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtgactccttcctccgatttttggaaagaagtgcagctggcgctgccgcggaaggtgcagtacaggcctgtggaaggagacccccagacgcagctgcaggacgacaaggaccccatgctgattcttcgaggccgagtccctgagggccgggccctggactcagaggtggacccggaccctgagggcgacctgggtgtccgggggcctgtctttggagagccatcagctccaccgcacaccagtggggtctcgctgggagagagccggagcagcgaagtggacgtctcggatctcggctcgcgaaactacagtgcccgcacagacttctactgcctggtgtccaaggatgatatgtagctcccaccccagagtgcaggatcatagggacagcgggggccagggcagcggcgtcgctcctctgctcaacaggaccacaacccctgccagcagccctgggaccctgccagcagccctgggaaaaggctgtggcctcagggcgcctcccagtgccagaaaataaagtccttttggattctg

SEQ ID NO: 181753 - DNA, 557 bp, Homo sapiens
  Payload ID: 15796
  Gene Symbol: SIGIRR
  Gene Name: single immunoglobulin and toll-interleukin 1 receptor (TIR) domain
  ENST ID: ENST00000528058
  CDS Start-End: 387-557
agttctgatcaaaatacacaaagacacaagccaggtccccaccgcgcttggcgatgcatccatagcagccttggtgctgtggacactccctggggcccagcgaaggggagagtttgctcccaaaggcgcaccaatgaccaacatttgccccccggaggaaagaactggaaccagcctctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagccatgccagattccccagcagaggcaggccaggctgaggggtgcagtgcccggcccctcctatgagacaggcatcatggtgtcaccaggggtgggcaacaggtgtctgtgatagggcccctgacttcctctccccgtctgaagaccaggtgctgaggcctgccttgggcagctcagtggctctgaactgcacggcttgggtagtctctgggccccactgctccctgccttca

SEQ ID NO: 181754 - DNA, 1649 bp, Homo sapiens
  Payload ID: 15796
  Gene Symbol: SIGIRR
  Gene Name: single immunoglobulin and toll-interleukin 1 receptor (TIR) domain
  ENST ID: ENST00000531205
  CDS Start-End: 104-1618
agtcctgcccagctcttggatcagtctgctggccgaggagcccggtggagccaggggtgaccctggagcccagcctgccccgaggaggccccggctcagagccatgccaggtgtctgtgatagggcccctgacttcctctccccgtctgaagaccaggtgctgaggcctgccttgggcagctcagtggctctgaactgcacggcttgggtagtctctgggccccactgctccctgccttcagtccagtggctgaaagacgggcttccattgggaattgggggccactacagcctccacgagtactcctgggtcaaggccaacctgtcagaggtgcttgtgtccagtgtcctgggggtcaacgtgaccagcactgaagtctatggggccttcacctgctccatccagaacatcagcttctcctccttcactcttcagagagctggccctacaagccacgtggctgcggtgctggcctccctcctggtcctgctggccctgctgctggccgccctgctctatgtcaagtgccgtctcaacgtgctgctctggtaccaggacgcgtatggggaggtggagataaacgacgggaagctctacgacgcctacgtctcctacagcgactgccccgaggaccgcaagttcgtgaacttcatcctaaagccgcagctggagcggcgtcggggctacaagctcttcctggacgaccgcgacctcctgccgcgcgctgagccctccgccgacctcttggtgaacctgagccgctgccgacgcctcatcgtggtgctttcggacgccttcctgagccgggcctggtgcagccacagcttccgggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtgactccttcctccgatttttggaaagaagtgcagctggcgctgccgcggaaggtgcagtacaggcctgtggaaggagacccccagacgcagctgcaggacgacaaggaccccatgctgattcttcgaggccgagtccctgagggccgggccctggactcagaggtggacccggaccctgagggcgacctgggtatgcccgcccagccccactccccaactggagaagctcagcacagggcggagtgggggcaggcacagggcacagggcctggaggggctccaggtgttgaggactcttcccggcaccgggagcccctgcacggcctctgccctggaggtgctcggccctcggtctgcctgggaacttcctgggcctcacaggccatcacagcagggggtgagcaggggcagcccctggcagtgggtctgggccaaggctgtgggtggccacctcaggcgtctcggtctccccaccccaggtgtccgggggcctgtctttggagagccatcagctccaccgcacaccagtggggtctcgctgggagagagccggagcagcgaagtggacgtctcggatctcggctcgcgaaactacagtgcccgcacagacttctactgcctggtgtccaaggatgatatgtagctcccaccccagagtgcaggatca

SEQ ID NO: 181755 - DNA, 608 bp, Homo sapiens
  Payload ID: 15796
  Gene Symbol: SIGIRR
  Gene Name: single immunoglobulin and toll-interleukin 1 receptor (TIR) domain
  ENST ID: ENST00000526395
  CDS Start-End: 1-428
agccgctgccgacgcctcatcgtggtgctttcggacgccttcctgagccgggcctggtgcagccacagcttccgactccttcctccgatttttggaaagaagtgcagctggcgctgccgcggaaggtgcagtacaggcctgtggaaggagacccccagacgcagctgcaggacgacaaggaccccatgctgattcttcgaggccgagtccctgagggccgggccctggactcagaggtggacccggaccctgagggcgacctgggtgtccgggggcctgtctttggagagccatcagctccaccgcacaccagtggggtctcgctgggagagagccggagcagcgaagtggacgtctcggatctcggctcgcgaaactacagtgcccgcacagacttctactgcctggtgtccaaggatgatatgtagctcccaccccagagtgcaggatcatagggacagcgggggccagggcagcggcgtcgctcctctgctcaacaggaccacaacccctgccagcagccctgggaccctgccagcagccctgggaaaaggctgtggcctcagggcgcctcccagtgccagaaaataaagtccttttggattctg

SEQ ID NO: 181756 - DNA, 709 bp, Homo sapiens
  Payload ID: 15796
  Gene Symbol: SIGIRR
  Gene Name: single immunoglobulin and toll-interleukin 1 receptor (TIR) domain
  ENST ID: ENST00000530494
  CDS Start-End: 280-709
tggcgatgcatccatagcagccttggtgctgtggacactccctggggcccagcgaaggggagagtttgctcccaaaggcgcaccaatgaccaacatttgccccccggaggaaagaactggaaccagcctctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagccatgccaggtgtctgtgatagggcccctgacttcctctccccgtctgaagaccaggtgctgaggcctgccttgggcagctcagtggctctgaactgcacggcttgggtagtctctgggccccactgctccctgccttcagtccagtggctgaaagacgggcttccattgggaattgggggccactacagcctccacgagtactcctggccctacaagccacgtggctgcggtgctggcctccctcctggtcctgctggccctgctgctggccgccctgctctatgtcaagtgccgtctcaacgtgctgctctggtaccaggacgcgtatggggaggtggagataaacgcgactgccccgaggaccgcaagttcgtgaacttcatcctaaagccgcagctggagcggcgtcggggctacaagctcttcctgg

SEQ ID NO: 181757 - DNA, 573 bp, Homo sapiens
  Payload ID: 15796
  Gene Symbol: SIGIRR
  Gene Name: single immunoglobulin and toll-interleukin 1 receptor (TIR) domain
  ENST ID: ENST00000528845
  CDS Start-End: 1-393
ccggaccctgagggcgacctgggtatgcccgcccagccccactccccaactggagaagctcagcacagggcggagtgggggcaggcacagggcacagggcctggaggggctccaggtgttgaggactcttcccggcaccgggagcccctgcacggcctctgccctggaggtgctcggccctcggtctgcctgggaacttcctgggcctcacaggccatcacagcagggggtgtccgggggcctgtctttggagagccatcagctccaccgcacaccagtggggtctcgctgggagagagccggagcagcgaagtggacgtctcggatctcggctcgcgaaactacagtgcccgcacagacttctactgcctggtgtccaaggatgatatgtagctcccaccccagagtgcaggatcatagggacagcgggggccagggcagcggcgtcgctcctctgctcaacaggaccacaacccctgccagcagccctgggaccctgccagcagccctgggaaaaggctgtggcctcagggcgcctcccagtgccagaaaataaagtccttttggattctg

SEQ ID NO: 181758 - DNA, 933 bp, Homo sapiens
  Payload ID: 15796
  Gene Symbol: SIGIRR
  Gene Name: single immunoglobulin and toll-interleukin 1 receptor (TIR) domain
  ENST ID: ENST00000528209
  CDS Start-End: 367-933
caccgcgcttggcgatgcatccatagcagccttggtgctgtggacactccctggggcccagcgaaggggagagtttgctcccaaaggcgcaccaatgaccaacatttgccccccggaggaaagaactggaaccagcctctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagccatgccagggtcaaggccaacctgtcagaggtgcttgtgtccagtgtcctgggggtcaacgtgaccagcactgaagtctatggggccttcacctgctccatccagaacatcagcttctcctccttcactcttcagagagctggccctacaagccacgtggctgcggtgctggcctccctcctggtcctgctggccctgctgctggccgccctgctctatgtcaagtgccgtctcaacgtgctgctctgacgggaagctctacgacgcctacgtctcctacagcgactgccccgaggaccgcaagttcgtgaacttcatcctaaagccgcagctggagcggcgtcggggctacaagctcttcctggacgaccgcgacctcctgccgcgcgctgagccctccgccgacctcttggtgaacctgagccgctgccgacgcctcatcgtggtgctttcggacgccttcctgagccgggcctggtgcagccacagcttccgggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtg

SEQ ID NO: 181759 - DNA, 1533 bp, Homo sapiens
  Payload ID: 15797
  Gene Symbol: SSBP3
  Gene Name: single stranded DNA binding protein 3
  Uniprot ID: Q9BWW4
  ENST ID: ENST00000357475
  CDS Start-End: 216-1322
ccgcggccggggctgacgctttgacagctggaaagagcgcggagccagcgcctgggggggagggaggggagcgcggcgaggagagcgccagcgagcgagagagcgagcgagcgccggggagggggccgggagcgaggggcagctcgggagagccggagcggtagcggcggcggcggcggcggcggcgaggctcggcgccctcttccctgcaaaccatgtttgccaaaggcaaaggctcggcggtgccctcggatgggcaggctcgggaaaagttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagggtcctccggggtcacagccctcgccgcacgcacagcctccacctcacaatcctagcagcatgatgggaccccacagtcagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaaccccctcccaccccatccacgccccctacctttcccaattttagtttcatgcaataaaaaggccaaactttttattccataaaacaa

SEQ ID NO: 181760 - DNA, 1578 bp, Homo sapiens
  Payload ID: 15797
  Gene Symbol: SSBP3
  Gene Name: single stranded DNA binding protein 3
  Uniprot ID: Q9BWW4
  ENST ID: ENST00000371319
  CDS Start-End: 1-1086
atgtttgccaaaggcaaaggctcggcggtgccctcggatgggcaggctcgggaaaagttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaaccccctcccaccccatccacgccccctacctttcccaattttagtttcatgcaataaaaaggccaaactttttattccataaaacaagaaggacaaaactctcaaaaatgtatttcaagtcagtgaccagaaaaatcccaccccttgccctttccccaaaggaccttttctgtacatgacacttttttgttgttttttgtttggggttttaccattgttgggatttttttatttgttttcaggggggttttttgggggaaaatttttttaaatggaagcttctagcaagccccccaccccaatcaacctctatgctttcttcttaaaaaaaaaaaaaaaggaaaaaggaaaaaaaaaaaaggaaaacc

SEQ ID NO: 181761 - DNA, 2077 bp, Homo sapiens
  Payload ID: 15797
  Gene Symbol: SSBP3
  Gene Name: single stranded DNA binding protein 3
  Uniprot ID: Q9BWW4
  ENST ID: ENST00000371320
  CDS Start-End: 412-1578
agccacgttcggttgagctccaagtagaccagcggcggcggcggcggcggcggcggcagcggtgctggaggcgcagagggcggcgcaggcggagccgggcgggcgcgcgagcgagcggagagcgggcggccgtgcgggcggcggcggcggcacccccaggccgagccggcgcggaaggagttccagggcgatggggccgcggccggggctgacgctttgacagctggaaagagcgcggagccagcgcctgggggggagggaggggagcgcggcgaggagagcgccagcgagcgagagagcgagcgagcgccggggagggggccgggagcgaggggcagctcgggagagccggagcggtagcggcggcggcggcggcggcggcgaggctcggcgccctcttccctgcaaaccatgtttgccaaaggcaaaggctcggcggtgccctcggatgggcaggctcgggaaaagttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagggtcctccggggtcacagccctcgccgcacgcacagcctccacctcacaatcctagcagcatgatgggaccccacagtcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaaccccctcccaccccatccacgccccctacctttcccaattttagtttcatgcaataaaaaggccaaactttttattccataaaacaagaaggacaaaactctcaaaaatgtatttcaagtcagtgaccagaaaaatcccaccccttgccctttccccaaaggaccttttctgtacatgacacttttttgttgttttttgtttggggttttaccattgttgggatttttttatttgttttcaggggggttttttgggggaaaatttttttaaatggaagcttctagcaagccccccaccccaatcaacctctatgctttcttcttaaaaaaaaaaaaaaaggaaaaaggaaaaaaaaaaaaggaaaaccagaagcc

SEQ ID NO: 181762 - DNA, 560 bp, Homo sapiens
  Payload ID: 15797
  Gene Symbol: SSBP3
  Gene Name: single stranded DNA binding protein 3
  ENST ID: ENST00000444533
  CDS Start-End: 1-471
cctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacgtaagtctgctttctaataatttacatatcagacaccataacaaatcataattaacttcatcagctgaggggaaagcaagtttaattgatttcagccatttgttaccaaagatgaataaaataaaccgtcagaaaagtga

SEQ ID NO: 181763 - DNA, 1666 bp, Homo sapiens
  Payload ID: 15797
  Gene Symbol: SSBP3
  Gene Name: single stranded DNA binding protein 3
  ENST ID: ENST00000417664
  CDS Start-End: 331-1167
gggggctttgttcggccgggagcgctctcccttccctgtcctcggcttcgtcaccggttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagggtcctccggggtcacagccctcgccgcacgcacagcctccacctcacaatcctagcagcatgatgggaccccacagtcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaaccccctcccaccccatccacgccccctacctttcccaattttagtttcatgcaataaaaaggccaaactttttattccataaaacaagaaggacaaaactctcaaaaatgtatttcaagtcagtgaccagaaaaatcccaccccttgccctttccccaaaggaccttttctgtacatgacacttttttgttgttttttgtttggggttttaccattgttgggatttttttatttgttttcaggggggttttttgggggaaaatttttttaaatggaagcttctagcaagccccccaccccaatcaacctctatgctttcttcttaaaaaaaaaaaaaaaggaaaaaggaaaaaaaaaaaaggaaaaccagaagcc

SEQ ID NO: 181764 - DNA, 701 bp, Homo sapiens
  Payload ID: 15797
  Gene Symbol: SSBP3
  Gene Name: single stranded DNA binding protein 3
  ENST ID: ENST00000525990
  CDS Start-End: 399-701
cttttactctggaaagaacatgacagacatcctctgcccttcagcctgtgccccagaatgagagacccatgggacagactcaagctgtaccctgaagcagagctgcccagttgactgcagacctgttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaac

SEQ ID NO: 181765 - DNA, 3168 bp, Homo sapiens
  Payload ID: 15797
  Gene Symbol: SSBP3
  Gene Name: single stranded DNA binding protein 3
  ENST ID: ENST00000610401
  CDS Start-End: 412-1494
tagaccagcggcggcggcggcggcggcggcggcagcggtgctggaggcgcagagggcggcgcaggcggagccgggcgggcgcgcgagcgagcggagagcgggcggccgtgcgggcggcggcggcggcacccccaggccgagccggcgcggaaggagttccagggcgatggggccgcggccggggctgacgctttgacagctggaaagagcgcggagccagcgcctgggggggagggaggggagcgcggcgaggagagcgccagcgagcgagagagcgagcgagcgccggggagggggccgggagcgaggggcagctcgggagagccggagcggtagcggcggcggcggcggcggcggcgaggctcggcgccctcttccctgcaaaccatgtttgccaaaggcaaaggctcggcggtgccctcggatgggcaggctcgggaaaagttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtccccccttctccgagacgctgagagagcaggcattgcaggcgggaagatgccagaaattatgcaagaagtgaggtgtcattatccaggagctggtggggagggcatctccctgctcccctcaaccccctcccaccccatccacgccccctacctttcccaattttagtttcatgcaataaaaaggccaaactttttattccataaaacaagaaggacaaaactctcaaaaatgtatttcaagtcagtgaccagaaaaatcccaccccttgccctttccccaaaggaccttttctgtacatgacacttttttgttgttttttgtttggggttttaccattgttgggatttttttatttgttttcaggggggttttttgggggaaaatttttttaaatggaagcttctagcaagccccccaccccaatcaacctctatgctttcttcttaaaaaaaaaaaaaaaggaaaaaggaaaaaaaaaaaaggaaaaccagaagccctgctgtctgtctgtgcccaagcccttccaccagaaaagctagtctaggtgtgagagcccacattgtctgtagccatcaaaaataataataataaactggacagtttacaatcgttggtttctttcaaaaggccttttttggaaagaagaaaaggcagtcaccgttttccacttggggttttggtttgtgcaacaggcaggggaggagtggggacgcgtttgttctagcttgatttccatggcaacagcagcggcacgcttggaccccagaacccagcaccctcatcctgtggccagaggggccggaccactgacccctttcaggattccaccacagcccagaccgtcaccgtgacccggtggcatgcactgttcccaggacaccctcctcctctcctggacctcccttccgtcctggcctccctgcctctccagcccctcctctgcccccaccccagtcttcccagtgagaatcctgccagctgggtggtggcctggcgcagagtgggagaggctgccactgacaggatggctatgacctgggacatggaaacagtgacctccgcgttctggtcccgagatcctcgcatcagcgtcatcgtgtgcaccggcttggggggctggagttccggttttctttgttttttctctttattcgtcctttctcaaagatgggatactgatcagaattgctctgtatatgcttgggactggatggaaagactttggagcagctgtggggggtggggggacaccgacaaccaaacagacgtgctggctccagtcctgtttttactttcaaaaaccaacaagcccgacagtggagcctgtcccctcccgggagggtgctcatggccccactcacctcatcaccccacggaaacctttgtgtcttgccctggaagacacccgaattctttgtacattgacatgcccttctccttcctccctcccctgtagctggtctttgttttactccctccctttctgatccatgtatatcatattatgtgagatatcatctgcctgaaaaaagactttgtgcggattattgggaacattgtagctgtttctgtgttttttcttaccttgtagtctggttctgaattaagagaggaaaaaaaagtaattatgatacattgtagtttgtgtacgatatatgttgataacgttttattaaagggacatcttttttccgc

SEQ ID NO: 181766 - DNA, 1721 bp, Homo sapiens
  Payload ID: 15798
  Gene Symbol: SSBP4
  Gene Name: single stranded DNA binding protein 4
  Uniprot ID: Q9BWG4
  ENST ID: ENST00000348495
  CDS Start-End: 314-1405
cgcccgcgggcggcgtagaggcagcgggcgggggcgcgcgcggcgggaggaggggagcgcgcgtttcccggaacagcccgcgcggaggaaagggaggaaaaaaagccaccctgcggccggggccggagctggagccgccgctgccgccgccgccgcggccgtctggagctcccccgcgcggacgatgcctgccgtgcccgcctggggctcggggcggtgaggcccggggcgcggggtagctatggcgacggcaagcgcggcccgcggcgccgcctgacaggtgtgggccccggcggcggcggcgtggagcagcatgtacgccaaggggggcaagggttcggccgtgccctccgacagccaggcccgcgagaagttggcgctgtacgtttatgagtacctgctgcacatcggtgcccagaagtcagcccagaccttcctgtctgagatccgatgggagaagaacatcacgctgggggagccccctgggttcctgcactcctggtggtgcgtcttctgggacctgtactgcgcggcgcctgacagaagagaggcctgcgagcactccggcgaggccaaggccttccaggactatagtgctgcagccgcccccagccccgttatggggagtatggccccaggtgacacaatggccgcaggctccatggcggctggcttcttccagcccttcatgtcaccgcgcttcccagggggcccccggcccaccctgcggatgccgagtcagcctcccgcaggcctccctggctcccagcccctcctccctggcgccatggagccctccccacgagcccaggggcatccgagcatgggcggcccaatgcagagggtgacgcctcctcgtggcatggccagcgtggggccccagagctatggaggtggcatgcgacccccacccaactccctcgccggcccaggcctgcctgccatgaacatgggcccaggagttcgtggcccgtgggccagccccagtggaaactcgatcccctactcctcctcatcccccggcagctacaccggacccccaggaggaggtgggccccctggaacacccatcatgcctagccctggagattccaccaactccagcgaaaacatgtacactatcatgaaccccatcgggcagggcgccggcagggctaatttcccgctcggccctggcccggagggccccatggccgccatgagcgcgatggagcctcaccacgtgaacggatccctgggctcgggcgacatggacgggttgccgaagagttcccccggcgccgtggccggcctgagcaacgccccgggcaccccgcgggacgacggcgagatggcggccgccgggaccttcctgcacccgttcccgagcgaaagctactcgccagggatgaccatgagcgtgtgatggggcggcagccccgggcctctctgcgggcctaggcttctgcccagcgcccctgctcagggcgaggggctgaggtcacacctcgggcacctggactcctggccaatcaaggcttgcccagctgggaggccccacacgaaagactcttaccattttattaaaaacgcaaggacctcagagacgttcttttctgtatggacccttcctgccatttgtattttgtcccagagagaaaggctctttggggggcccctctccccaggacgtcagggggtggggcccataaataaatggaagctggttttggtttttggta

SEQ ID NO: 181767 - DNA, 1768 bp, Homo sapiens
  Payload ID: 15798
  Gene Symbol: SSBP4
  Gene Name: single stranded DNA binding protein 4
  Uniprot ID: Q9BWG4
  ENST ID: ENST00000270061
  CDS Start-End: 295-1452
ggcagcgggcgggggcgcgcgcggcgggaggaggggagcgcgcgtttcccggaacagcccgcgcggaggaaagggaggaaaaaaagccaccctgcggccggggccggagctggagccgccgctgccgccgccgccgcggccgtctggagctcccccgcgcggacgatgcctgccgtgcccgcctggggctcggggcggtgaggcccggggcgcggggtagctatggcgacggcaagcgcggcccgcggcgccgcctgacaggtgtgggccccggcggcggcggcgtggagcagcatgtacgccaaggggggcaagggttcggccgtgccctccgacagccaggcccgcgagaagttggcgctgtacgtttatgagtacctgctgcacatcggtgcccagaagtcagcccagaccttcctgtctgagatccgatgggagaagaacatcacgctgggggagccccctgggttcctgcactcctggtggtgcgtcttctgggacctgtactgcgcggcgcctgacagaagagaggcctgcgagcactccggcgaggccaaggccttccaggactatagtgctgcagccgcccccagccccgttatggggagtatggccccaggtgacacaatggccgcaggctccatggcggctggcttcttccagggcccccccggctcccagccgtccccccacaaccccaacgcccccatgatggggcctcacggtcagcccttcatgtcaccgcgcttcccagggggcccccggcccaccctgcggatgccgagtcagcctcccgcaggcctccctggctcccagcccctcctccctggcgccatggagccctccccacgagcccaggggcatccgagcatgggcggcccaatgcagagggtgacgcctcctcgtggcatggccagcgtggggccccagagctatggaggtggcatgcgacccccacccaactccctcgccggcccaggcctgcctgccatgaacatgggcccaggagttcgtggcccgtgggccagccccagtggaaactcgatcccctactcctcctcatcccccggcagctacaccggacccccaggaggaggtgggccccctggaacacccatcatgcctagccctggagattccaccaactccagcgaaaacatgtacactatcatgaaccccatcgggcagggcgccggcagggctaatttcccgctcggccctggcccggagggccccatggccgccatgagcgcgatggagcctcaccacgtgaacggatccctgggctcgggcgacatggacgggttgccgaagagttcccccggcgccgtggccggcctgagcaacgccccgggcaccccgcgggacgacggcgagatggcggccgccgggaccttcctgcacccgttcccgagcgaaagctactcgccagggatgaccatgagcgtgtgatggggcggcagccccgggcctctctgcgggcctaggcttctgcccagcgcccctgctcagggcgaggggctgaggtcacacctcgggcacctggactcctggccaatcaaggcttgcccagctgggaggccccacacgaaagactcttaccattttattaaaaacgcaaggacctcagagacgttcttttctgtatggacccttcctgccatttgtattttgtcccagagagaaaggctctttggggggcccctctccccaggacgtcagggggtggggcccataaataaatggaagctggttttggtttttggta

SEQ ID NO: 181768 - DNA, 628 bp, Homo sapiens
  Payload ID: 15798
  Gene Symbol: SSBP4
  Gene Name: single stranded DNA binding protein 4
  ENST ID: ENST00000601614
  CDS Start-End: 26-187
cccggcggcggcggcgtggagcagcatgtacgccaaggggggcaagggttcggccgtgccctccgacagccaggcccgcgagaagtattgcctgtctctgtctctcccctcaagaacatggcctccaggacaggggccgggtgtgtgcactgcgcaaaaggcacttcatggatgctggaggaactaatgaagaagtgaatgaacgaaggaggggaggcaggatgagatttggggcaagggcagtgcccatgaggaccaggttggcgctgtacgtttatgagtacctgctgcacatcggtgcccagaagtcagcccagaccttcctgtctgagatccgatgggagaagaacatcacgctgggggagccccctgggttcctgcactcctggtggtgcgtcttctgggacctgtactgcgcggcgcctgacagaagagaggcctgcgagcactccggcgaggccaaggccttccaggactatagtgctgcagccgcccccagccccgttatggggagtatggccccaggtgacacaatggccgcaggctccatggcggctggcttcttccagcccttcatgtcaccgcgcttcccagggggcccccggcccaccctgcggatgccgagtca

SEQ ID NO: 181769 - DNA, 900 bp, Homo sapiens
  Payload ID: 15798
  Gene Symbol: SSBP4
  Gene Name: single stranded DNA binding protein 4
  ENST ID: ENST00000593641
  CDS Start-End: 1-619
gcctgccatgaacatgggcccaggagttcgtggcccgtgggccagccccagtggaaactcgatcccctactcctcctcatcccccggcagctacaccggacccccaggaggaggtgggccccctggaacacccatcatgcctagccctggagattccaccaactccagcgaaaacatgtacactatcatgaaccccatcgggcagggcgccggcagggctaatttcccgctcggccctggcccggagggccccatggccgccatgagcgcgatggagcctcaccacgtgaacggatccctgggctcgggcgacatggacgggttgccgaagagttcccccggcgccgtggccggcctgagcaacgccccgggcaccccgcgggacgacggcgagatggcggccgccgggaccttcctgcacccgttcccgagcgaaagcgtaagcgactgcgtcgactccccccccgcggcggcgtcgggccggaggggctggcgggcaggccccggcggggcggccggggggccagagcaagaccgtgaccgcggcgggccagtactcgccagggatgaccatgagcgtgtgatggggcggcagccccgggcctctctgcgggcctaggcttctgcccagcgcccctgctcagggcgaggggctgaggtcacacctcgggcacctggactcctggccaatcaaggcttgcccagctgggaggccccacacgaaagactcttaccattttattaaaaacgcaaggacctcagagacgttcttttctgtatggacccttcctgccatttgtattttgtcccagagagaaaggctctttggggggcccctctccccaggacgtcagggggtggggcccataaataaatggaagctggttttggtttttggta

SEQ ID NO: 181770 - DNA, 865 bp, Homo sapiens
  Payload ID: 15798
  Gene Symbol: SSBP4
  Gene Name: single stranded DNA binding protein 4
  ENST ID: ENST00000597724
  CDS Start-End: 162-865
gcggtggcctgtgtttagttgttccaggacggccactgtgagctgggtgtgtggcagtgtatgtgtgtcgctgggcgggctgtatgtgcggtggttcccacccttgctgagtgtgggtagctctgcggggtgagacacccaatgtcactgcctgaggctttatggggctatccgcagtcgttccagcagcggggtacacttttgctgtgtggagcgctatgttgagtgtcgctgcgaatgtgtgtggctgggtgtacaacaatgtgggtggccggctccatttgaggttggcgctgtacgtttatgagtacctgctgcacatcggtgcccagaagtcagcccagaccttcctgtctgagatccgatgggagaagaacatcacgctgggggagccccctgggttcctgcactcctggtggtgcgtcttctgggacctgtactgcgcggcgcctgacagaagagaggcctgcgagcactccggcgaggccaaggccttccaggactatagtgctgcagccgcccccagccccgttatggggagtatggccccaggtgacacaatggccgcaggctccatggcggctggcttcttccagcccttcatgtcaccgcgcttcccagggggcccccggcccaccctgcggatgccgagtcagcctcccgcaggcctccctggctcccagcccctcctccctggcgccatggagccctccccacgagcccaggggcatccgagcatgggcggcccaatgcagagggtgacgcctcctcgtggcatggccagcgtggggccccagagctatggaggtggcatgcgacccccacccaactccctcgccggcccaggcctgcctgccatgaacat

SEQ ID NO: 181771 - DNA, 606 bp, Homo sapiens
  Payload ID: 15798
  Gene Symbol: SSBP4
  Gene Name: single stranded DNA binding protein 4
  ENST ID: ENST00000601357
  CDS Start-End: 438-606
agggaggaaaaaaagccaccctgcggccggggccggagctggagccgccgctgccgccgccgccgcggccgtctggagctcccccgcgcggacgatgcctgccgtgcccgcctggggctcggggcggtgaggcccggggcgcggggtagctatggcgacggcaagcgcggcccgcggcgccgcctgacaggttggcgctgtacgtttatgagtacctgctgcacatcggtgcccagaagtcagcccagaccttcctgtctgagatccgatgggagaagaacatcacgctgggggagccccctgggttcctgcactcctggtggtgcgtcttctgggacctgtactgcgcggcgcctgacagaagagaggcctgcgagcactccggcgaggccaaggccttccaggactatagtgctgcagccgcccccagccccgttatggggagtatggccccaggtgacacaatggccgcaggctccatggcggctggcttcttccagcccttcatgtcaccgcgcttcccagggggcccccggcccaccctgcggatgccgagtcagcctcccgcaggcctccctggctcccagcccctcctccctggcgcca

SEQ ID NO: 181772 - DNA, 622 bp, Homo sapiens
  Payload ID: 15798
  Gene Symbol: SSBP4
  Gene Name: single stranded DNA binding protein 4
  ENST ID: ENST00000602088
  CDS Start-End: 270-622
ctgcggacgcatggggatcgaggttggcgctgtacgtttatgagtacctgctgcacatcggtgcccagaagtcagcccagaccttcctgtctgagatccgatgggagaagaacatcacgctgggggagccccctgggttcctgcactcctggtggtgcgtcttctgggacctgtactgcgcggcgcctgacagaagagaggcctgcgagcactccggcgaggccaaggccttccaggactatagtgctgcagccgcccccagccccgttatggggagtatggccccaggtgacacaatggccgcaggctccatggcggctggcttcttccagcccttcatgtcaccgcgcttcccagggggcccccggcccaccctgcggatgccgagtcagcctcccgcaggcctccctggctcccagcccctcctccctggcgccatggagccctccccacgagcccaggggcatccgagcatgggcggcccaatgcagagggtgacgcctcctcgtggcatggccagcgtggggccccagagctatggaggtggcatgcgacccccacccaactccctcgccggcccaggcctgcctgccatgaacatgggcccaggagttcgtggccc

SEQ ID NO: 181773 - DNA, 504 bp, Homo sapiens
  Payload ID: 15798
  Gene Symbol: SSBP4
  Gene Name: single stranded DNA binding protein 4
  ENST ID: ENST00000607020
  CDS Start-End: 44-208
cgcctgacaggtgtgggccccggcggcggcggcgtggagcagcatgtacgccaaggggggcaagggttcggccgtgccctccgacagccaggcccgcgagaagttggcgctgtacgtttatgagtacctgctgcacatcggtgcccagaagtcagcccagaccttcctgtctgagcgtcttctgggacctgtactgcgcggcgcctgacagaagagaggcctgcgagcactccggcgaggccaaggccttccaggactatagtgctgcagccgcccccagccccgttatggggagtatggccccaggtgacacaatggccgcaggctccatggcggctggcttcttccagcccttcatgtcaccgcgcttcccagggggcccccggcccaccctgcggatgccgagtcagcctcccgcaggcctccctggctcccagcccctcctccctggcgccatggagccctccccacgagcccaggggcatccgagcatgggcggcccaa

SEQ ID NO: 181774 - DNA, 793 bp, Homo sapiens
  Payload ID: 15798
  Gene Symbol: SSBP4
  Gene Name: single stranded DNA binding protein 4
  ENST ID: ENST00000599699
  CDS Start-End: 262-477
ttccccctgccgtcagcccgcctgccgggtggaggcgtctagtggcgtcctgagccccccgggggccgctcagtgacaggggctgccccgagctggagggggatccagcgaccaaaccagaggatgcactgaccgcccctcccccccaggcccaaccctccacctggcctcagtcccggggttcctggcgggctgtgcggggcgggggcgcgtcggcgggggcagcttgcgagggtcgttggcccctggaggccgaggggcatggcgccagcacgtctgagccggtgcccgtgtctgtccgtgtctgtaggctcgggcgacatggacgggttgccgaagagttcccccggcgccgtggccggcctgagcaacgccccgggcaccccgcgggacgacggcgagatggcggccgccgggaccttcctgcacccgttcccgagcgaaagctactcgccagggatgaccatgagcgtgtgatggggcggcagccccgggcctctctgcgggcctaggcttctgcccagcgcccctgctcagggcgaggggctgaggtcacacctcgggcacctggactcctggccaatcaaggcttgcccagctgggaggccccacacgaaagactcttaccattttattaaaaacgcaaggacctcagagacgttcttttctgtatggacccttcctgccatttgtattttgtcccagagagaaaggctctttggggggcccctctccccaggacgtcagggggtggggcccataaataaatggaagctggttttggtttttggta

SEQ ID NO: 181775 - DNA, 162 bp, Homo sapiens
  Payload ID: 15798
  Gene Symbol: SSBP4
  Gene Name: single stranded DNA binding protein 4
  ENST ID: ENST00000625926
  CDS Start-End: 1-162
atgtacgccaaggggggcaagggttcggccgtgccctccgacagccaggcccgcgagaagtattgcctgtctctgtctctcccctcaagaacatggcctccaggacaggggccgggtgtgtgcactgcgcaaaaggcacttcatggatgctggaggaactaa

SEQ ID NO: 181776 - DNA, 3999 bp, Homo sapiens
  Payload ID: 15799
  Gene Symbol: SIM1
  Gene Name: single-minded family bHLH transcription factor 1
  Uniprot ID: P81133
  ENST ID: ENST00000262901
  CDS Start-End: 210-2510
cccgaattttcaaagaacatattttccgttcacccccgctggtcttttactgccatcaatacactgttcttggtgcaaatacttcagcctctttattcaaagtatgttttatgtttttgccaaatatgatctctaattgaaagtttatttttggttttggatgaatctgcggagcttaagttgtgagaagaaagggggaacaagacacaatgaaagaaaagtccaaaaatgctgcgcggactaggagggagaaggaaaacagtgaattttatgaactggctaaattactgcctttgccctcggctatcacctcgcagctggacaaagcatccataatcagactcacgaccagctatctcaaaatgagagtggtgttcccagaagggctcggcgaggcgtggggccactcaagtcggaccagccccctggacaacgttggccgagaactgggctcccatctgctccagaccctggatggcttcatcttcgtggtagccccagatgggaagatcatgtacatctcagagacagcctcagtccacttgggtctttctcaggtagagctgaccggaaacagcatttatgaatacattcacccggcagaccacgacgagatgacggcggtgctcaccgcccatcaaccctaccactctcacttcgtgcaggagtatgagatcgagcgctccttcttcctgaggatgaagtgcgtcttggccaagcgtaacgccggcctcacctgtggcggctacaaggtcatccactgcagcggctacttgaagatccgccagtacagcctggacatgtcccccttcgacggctgctaccaaaacgtgggcctggtggccgtgggccactcgctgcctcccagcgccgtcacggagatcaagctacacagcaatatgtttatgttccgcgccagcctggacatgaagctcatctttctggactccagggtggcggagctgacggggtacgaacctcaggacctgattgagaagactctgtaccaccatgtgcacggctgcgacaccttccacctgcgctgcgcgcaccatttgctgctggtgaagggacaggtgaccaccaagtactacaggttcctggcgaaacacggcggctgggtatgggtgcagagctacgcgaccatcgtgcacaacagtcgctcctccaggccacactgtatcgtcagcgtcaactatgtcctcacagacacagaatacaaagggctgcagctctccctggatcagatctcagcctccaaaccagccttctcctataccagcagctccacccccaccatgactgacaacagaaagggggccaaatcccggctctccagctcaaagtcaaaatccaggacttccccataccctcagtattcgggatttcacacagaaagatcggaatctgatcatgacagccagtggggcggaagtcccttgaccgacacggcctctccgcagcttctggaccccgccgataggcctggctcccagcacgacgcatcgtgcgcctacagacagttttcggaccgcagctctctctgctatggctttgcgcttgaccactcgaggctggtggaagagaggcatttccatacccaggcctgtgaaggaggccgatgtgaggcaggcaggtacttcctgggaacgccgcaggccgggagggagccctggtggggctctcgcgcagccttgcccctgacaaaggcctccccagaaagcagagaagcctatgaaaacagcatgcctcacatcgcttcagtccacaggatccatgggcgaggtcattgggatgaagatagtgtggtcagttctccagaccctgggtcggccagtgaatcaggtgaccgatatcgtactgagcagtatcaaagtagcccacatgaacccagcaaaattgaaactcttataagagccactcagcaaatgattaaagaagaagagaacagattacagctaaggaaagccccctcagaccaactggcttccattaatggggctgggaaaaaacactccctgtgttttgcaaactaccaacagcccccaccaacaggtgaagtctgccatggctctgctcttgccaacacttcaccatgtgaccatatccagcagagagagggaaaaatgttgagcccccatgaaaatgactatgacaacagtcccaccgcactatctcggataagtagtcccaattcggatcgcatttcaaaatccagtttgatcctagctaaagactatctgcattcggatatatctcctcatcagacagcaggagaccaccctactgtctctccaaactgctttggctctcaccggcagtattttgacaagcatgcttacacattaactggatatgccctggagcacttatatgacagcgaaaccattagaaactattccttgggctgtaatggctcacactttgatgtaacttcccatctgaggatgcaaccagacccagcacaaggacacaagggaacatctgttataataaccaacggaagctgatgttttgctgaaatattttgttctttaaggatctctgaaacatatttatagtttaataccccattaccagcatttactatgccacagattgttagagagtataacttaagttactgggtatttgatacgtgttcctataaaatcaaagaaaacatagcactagcattcagggttatacacagaaaagggagctaaattgaatacacaaatttcccctctaattatatgggaaccagaatagataaattttgacttgaaaaatattcatgtagatcaagtgtgcatatatactacatgagaggactgatgaatgacaacattgcattgtgactatccagtgatcctcaaacacacaaactattacttacaaactgcggtatacattttacatatggaaatataggctatgtaatgtaaatacatcaaaaatgggtaattttctttgactctgtcacactaaacttcttaacgaaatttccattcccaaaataactgagaaagagagagatacatcttataaactgacttctttgtggtttcaaatcagccagctcatttggttcaggcataaattagagaaatggttctggatatggtgcaaaaatgagttttcacctggtatccattataaacaatcaggaagaggtaatttttcaccttgcttttcagttagacaaggaccaggattgcactgacatggcgctgagggtttttctaagtaagaacactgagatattgggacacacatcaaaaacctggagtgctcaattggaagtagttctatgaatatggaaaggccagaggcagagtgaaataaaatgctatctcaaagtttaacacaatttaagggctcagcataagtaaacaacatatttggggtttgcttgtaaaaccaactaaataaaaaattcaaaccaattcacccagaaaaaagaccaataggtgcaaaaataaaaggaaaaccagtgaagtgccacatgacagcagtgttaagtgtttgaaaacgtttcaaagcacatatgtgccaatgtgacaacatgtggaaagcctcaggagagagtctaagataaaagcttaggctgatagacaagtagttaagagctaagagcagtactctgaaggaataggcaaaatgtttattttccttattgtttgtaaacaacaaacttggtcttacatctgtgtggtatagtagaaaggccagctgactagatctctggattctaattttggccctacctgtaacttaattttgtgaccacagttgtaccattcaccgtgcctgggctctagtttcctggtttgtaaggcagccccagcgttcatgttctgtgatagagcagaactgaacttattacctaattaactctctgctatgagttgtcaagactgatcattctgttttttctgtacacagaagtttagatgctttgtgacttaagcaggtgtgtgggctcctttaggcaggttacagttaactttctagatt

SEQ ID NO: 181777 - DNA, 8430 bp, Homo sapiens
  Payload ID: 15799
  Gene Symbol: SIM1
  Gene Name: single-minded family bHLH transcription factor 1
  Uniprot ID: P81133
  ENST ID: ENST00000369208
  CDS Start-End: 784-3084
aaacccttaagctataaagaagttacggggggcagttttcggcttccaattaggaataatagtgaactggcttcgtagcaactacggaggaccaggattctaaaatcacctcactcgtcccaaagcttgcatcctcctctttctgccacgcacccctcctccaattcatgatccagaaaagggagccgggaatgctctgctcctctctgccggtgggaagcggagaggccggcggtgtcgctgggttggacggtaggcatgagaacagttaagagatgggcgcccccgaaacctctgccgcttgtggggactgaagggccttgaaagagttgtctggggttcctgctcttcccaaaggggctcggagataccttaaatgccgcgagactgaagagcaaacgtcagggattattatgtcgattttccgaggaccagggttcgcagctggcagtagaagaaaaggctggctcctcaggggtcccactggcatttgataccctgaacgaccctcaggattgcccaaattcggtggatcgcccaaattcggtggatcagcaactttcctatactgcatcccgaattttcaaagaacatattttccgttcacccccgctggtcttttactgccatcaatacactgttcttggtgcaaatacttcagcctctttattcaaagtatgttttatgtttttgccaaatatgatctctaattgaaagtttatttttggttttggatgaatctgcggagcttaagttgtgagaagaaagggggaacaagacacaatgaaagaaaagtccaaaaatgctgcgcggactaggagggagaaggaaaacagtgaattttatgaactggctaaattactgcctttgccctcggctatcacctcgcagctggacaaagcatccataatcagactcacgaccagctatctcaaaatgagagtggtgttcccagaagggctcggcgaggcgtggggccactcaagtcggaccagccccctggacaacgttggccgagaactgggctcccatctgctccagaccctggatggcttcatcttcgtggtagccccagatgggaagatcatgtacatctcagagacagcctcagtccacttgggtctttctcaggtagagctgaccggaaacagcatttatgaatacattcacccggcagaccacgacgagatgacggcggtgctcaccgcccatcaaccctaccactctcacttcgtgcaggagtatgagatcgagcgctccttcttcctgaggatgaagtgcgtcttggccaagcgtaacgccggcctcacctgtggcggctacaaggtcatccactgcagcggctacttgaagatccgccagtacagcctggacatgtcccccttcgacggctgctaccaaaacgtgggcctggtggccgtgggccactcgctgcctcccagcgccgtcacggagatcaagctacacagcaatatgtttatgttccgcgccagcctggacatgaagctcatctttctggactccagggtggcggagctgacggggtacgaacctcaggacctgattgagaagactctgtaccaccatgtgcacggctgcgacaccttccacctgcgctgcgcgcaccatttgctgctggtgaagggacaggtgaccaccaagtactacaggttcctggcgaaacacggcggctgggtatgggtgcagagctacgcgaccatcgtgcacaacagtcgctcctccaggccacactgtatcgtcagcgtcaactatgtcctcacagacacagaatacaaagggctgcagctctccctggatcagatctcagcctccaaaccagccttctcctataccagcagctccacccccaccatgactgacaacagaaagggggccaaatcccggctctccagctcaaagtcaaaatccaggacttccccataccctcagtattcgggatttcacacagaaagatcggaatctgatcatgacagccagtggggcggaagtcccttgaccgacacggcctctccgcagcttctggaccccgccgataggcctggctcccagcacgacgcatcgtgcgcctacagacagttttcggaccgcagctctctctgctatggctttgcgcttgaccactcgaggctggtggaagagaggcatttccatacccaggcctgtgaaggaggccgatgtgaggcaggcaggtacttcctgggaacgccgcaggccgggagggagccctggtggggctctcgcgcagccttgcccctgacaaaggcctccccagaaagcagagaagcctatgaaaacagcatgcctcacatcgcttcagtccacaggatccatgggcgaggtcattgggatgaagatagtgtggtcagttctccagaccctgggtcggccagtgaatcaggtgaccgatatcgtactgagcagtatcaaagtagcccacatgaacccagcaaaattgaaactcttataagagccactcagcaaatgattaaagaagaagagaacagattacagctaaggaaagccccctcagaccaactggcttccattaatggggctgggaaaaaacactccctgtgttttgcaaactaccaacagcccccaccaacaggtgaagtctgccatggctctgctcttgccaacacttcaccatgtgaccatatccagcagagagagggaaaaatgttgagcccccatgaaaatgactatgacaacagtcccaccgcactatctcggataagtagtcccaattcggatcgcatttcaaaatccagtttgatcctagctaaagactatctgcattcggatatatctcctcatcagacagcaggagaccaccctactgtctctccaaactgctttggctctcaccggcagtattttgacaagcatgcttacacattaactggatatgccctggagcacttatatgacagcgaaaccattagaaactattccttgggctgtaatggctcacactttgatgtaacttcccatctgaggatgcaaccagacccagcacaaggacacaagggaacatctgttataataaccaacggaagctgatgttttgctgaaatattttgttctttaaggatctctgaaacatatttatagtttaataccccattaccagcatttactatgccacagattgttagagagtataacttaagttactgggtatttgatacgtgttcctataaaatcaaagaaaacatagcactagcattcagggttatacacagaaaagggagctaaattgaatacacaaatttcccctctaattatatgggaaccagaatagataaattttgacttgaaaaatattcatgtagatcaagtgtgcatatatactacatgagaggactgatgaatgacaacattgcattgtgactatccagtgatcctcaaacacacaaactattacttacaaactgcggtatacattttacatatggaaatataggctatgtaatgtaaatacatcaaaaatgggtaattttctttgactctgtcacactaaacttcttaacgaaatttccattcccaaaataactgagaaagagagagatacatcttataaactgacttctttgtggtttcaaatcagccagctcatttggttcaggcataaattagagaaatggttctggatatggtgcaaaaatgagttttcacctggtatccattataaacaatcaggaagaggtaatttttcaccttgcttttcagttagacaaggaccaggattgcactgacatggcgctgagggtttttctaagtaagaacactgagatattgggacacacatcaaaaacctggagtgctcaattggaagtagttctatgaatatggaaaggccagaggcagagtgaaataaaatgctatctcaaagtttaacacaatttaagggctcagcataagtaaacaacatatttggggtttgcttgtaaaaccaactaaataaaaaattcaaaccaattcacccagaaaaaagaccaataggtgcaaaaataaaaggaaaaccagtgaagtgccacatgacagcagtgttaagtgtttgaaaacgtttcaaagcacatatgtgccaatgtgacaacatgtggaaagcctcaggagagagtctaagataaaagcttaggctgatagacaagtagttaagagctaagagcagtactctgaaggaataggcaaaatgtttattttccttattgtttgtaaacaacaaacttggtcttacatctgtgtggtatagtagaaaggccagctgactagatctctggattctaattttggccctacctgtaacttaattttgtgaccacagttgtaccattcaccgtgcctgggctctagtttcctggtttgtaaggcagccccagcgttcatgttctgtgatagagcagaactgaacttattacctaattaactctctgctatgagttgtcaagactgatcattctgttttttctgtacacagaagtttagatgctttgtgacttaagcaggtgtgtgggctcctttaggcaggttacagttaactttctagatttagccaaaatgtagttggtagaaatttatgacagagaagaaaaatagcaagatttatttaatgctctattctctagtaattaaagcaaaatgatataagtgattagagagatttcatagataatatttcctaggagtcccgtgcccaaaactcttgccatatttaaggaagggaatgtactggcagaacttgacttacaattttggaaacagaacatgaaattgaatactcagggattagtagtatattttcatcatttaacacagttatttcacagtccataggtaggtgacaatctgaacgataatatgaaagatgagtactgggttgtttgtatatgaaaggagaggctacataaaattaaataatgttaacatttgtgctgtaaatgcaaaaaagtgcaagtaagtgagaaagttagtggttatatatattttcaaaaaattcaaagtgcagttgacccttgaataacatgggtttgaactgtgcagattcacttatgtgtggttttttttccaatcaaatgcagataaaaaacccagtatttggagaaatgtgaaacctgagtatacagagggcgatgttttgtataagtgagcgccacagggccaacaggcaggacttgagtatgtgagaatttgattatatgggggtaatcctggaaccaactccctgtttataccaaggggtgaccatacaataaaaactaagttttgaattatacaaaaaagagtatttagtaattttgagaaaattatttatgagaaatcctggaatacataaaatggagttttgatcaatttgcaacatgaagtaatgtcttaagaatgctaaaggttttgtagaattctgtagattgatagatgtttggaagaaaaaatatttgatgaatatggtgtattttggaaaggtaattttcacagatgggtatttctggtggctatatattctaccaaatgtgccagggacagaagctaaaagaaatggaaacttaagaaccagggaaaatgaactgatattaaagaaaaggctgtcactaaaggaatttcagtggaatttttatatggaagatagttaactggtgagaagaagaaattatgaatttcacagatgagagtaatcagaaggaataatgctctttaaaatgacatgaccaatatttttaagagaatacagaattaactaaattatatattgattcaaaattttggtagattgacccagttttaagtacataaccattttaaaatttactgaatgtcaataattttatagtagcagttttattacattacataaaatgtcatattgactcactatattgtatagcttacattttttgcaatatggcatgattatcacaaaatgacccaaggtaagttaagacatttgatgacaatgtactttcttaatatacatgtgaatgtgttaaaatgtgtttataatctacattattttgttctgtgcagcaacatatttcctcataatgaagatgtcatctgtgtcttttaaaaatagtatataaaataactacgttcccgataatttaatcagttaaacttaatatggctttagttttaattcttgatttccataactttgccaaatgttgagaaacatgaaacttgattgaaatagatacagaagtatgattttcatatcaccttggggatacataaaaatgtgctctatccaattactggtataatatgtatcaattcattagatgatacatagctcatggttttgtagaattctggtttctagtgataataagtatctttattgcccatttcacctgccatacctactttaaaaatttggatgaccaaagaagtgaatgaagtttccccaatctttcttgggaaaattctgtttaaattgttattgggaatatatagatttgatgtgttattttgggatgtgtaatattaatgtcacaatcactacaggtcagatatttaggtgtgcttcggtccacaagtcttttgtcatattgtgctcgcttacctaaactgtaattgcctgataaaagataatatgacagtgctgaggtgacattcaaaatgagacgggatgcaataaatgattgccttcagtatttacacagaaaaaccacttgctctttcttggttatatttcatagggctagattgtttccatcgggcactattcttaattcactctataccgtgttgtcacatgctgcctctgggcagagaatcccacttaaaataagctttaggggatcttctagaaaagggtagtgtgctccaatttttatttctccttcttatgggggatgaggatcaattatagtacaagaccatttggaaaatatgcatatatattttaaaatgaaatacaagatttccgccctcaagatctaaaccaagtaagtttgatggatggcagcacagataaagaaatcttctgaatacacatttgatttttatagctctctctttcaagagtaggatattactaagatattcagtgcaatctatcagtcctagtagtatttagaagtgacagagtgaatgctgatatttggaaaattgagcatttgaccattttggggtcactcacctggcctagtggaatagcttacactttaatacaatcaaacacagtctttctgatataaaatgtttgaatgcccagatttggttccctagttcactcaaatcatagatgttgacatacatcctgttttcataatgattttaaaaagaatgtaaatcctatggtcctccaaataaatgattcaacgtttatgtaaatgtcaagtttttgtgaatagggatttatgtctaagacagaaaaatctactgaactagttcttactgtggaactaattgtggataaaacattcgttatcatctaaattttaaatgaatgacaacagttatggacacatgcaaaaggtatcagacatagaaaatattgttgggggaaatttctgtgtggtgctaatttcttgtaagggttgtacagatagtgcttaactcaaaaagtgagagtgtggtcattgccaaataggggtttgctcagagttccttctctaggactgtatgcagaaagcatacacacacacatacgcacacagaaaaatatgatttttatatcatattcatgaaaatgtgccatatccaattataacacacacacacacacacacacacacacacacacacacacataaataaataaatgatggttcacataagaaatcctaattgctaattttaaaccaaacatttgtagttttgtttattgcaactttgctgcatgggactttgctttcataaatctatatggggttggggttaatttgccctaatttgctgacctgggacacatgtaatcactgttaaacttacacccggtaaccctgatgtgtttacatttcaaaagaaatgaaattggcctggaaaaaaattttggaagtactgtaagtcttttttctttttttttccgaagggaaatatttcaaaaaaggaaacattatgagtagacacttcaaaaaagataaaatattttacatttgttttttgactaatgtgctataaaaaggattatatttgtgagaaaagatactgatcgccaatatttcaaataccgtcttgcaatgtatagtttttagtgacattgtagtataaagctgtaatttgaaattttactttggaatgtaaagtagaaaatattagctatgtcaatgatatcttgcaaagtgttcccatttataattatttatattgtaaatagctttctgaagtaaattcgaagttaatgtgcataaaatgtatttattatgtgaggaattttttggtttaaaatatagttaccaatatgca

SEQ ID NO: 181778 - DNA, 4442 bp, Homo sapiens
  Payload ID: 15800
  Gene Symbol: SIM2
  Gene Name: single-minded family bHLH transcription factor 2
  Uniprot ID: Q14190
  ENST ID: ENST00000290399
  CDS Start-End: 614-2617
ccgcacgtggacagcggaggtgctgcgcctagccacacatcgcgggctccggcgctgcgtctccaggcacagggagccgccaggaagggcaggagagcgcgcccgggccagggcccggccccagccgcctgcgactcgctcccctccgctgggctcccgctccatggctccgcggccaccgccgcccctgtcgccctccggtccggaggggccttgccgcagccggttcgagcactcgacgaaggagtaagcagcgcctccgcctccgcgccggccgcccccaccccccaggaaggccgaggcaggagaggcaggagggaggaaacaggagcgagcaggaacggggctccggttgctgcaggacggtccagcccggaggaggctgcgctccgggcagcggcgggcggcgccgccgggttgctcggagctcaggcccggcggctgcggggaggcgtctcggaaccccgggaggccccccgcacctgcccgcggcccactccgcggactcacctggctcccggctcccccttccccatccccgccgccgcagcccgagcggggctccgcgggcctggagcacggccgggtctaatatgcccggagccgaggcgcgatgaaggagaagtccaagaatgcggccaagaccaggagggagaaggaaaatggcgagttttacgagcttgccaagctgctcccgctgccgtcggccatcacttcgcagctggacaaagcgtccatcatccgcctcaccacgagctacctgaagatgcgcgccgtcttccccgaaggtttaggagacgcgtggggacagccgagccgcgccgggcccctggacggcgtcgccaaggagctgggatcgcacttgctgcagactttggatggatttgtttttgtggtagcatctgatggcaaaatcatgtatatatccgagaccgcttctgtccatttaggcttatcccaggtggagctcacgggcaacagtatttatgaatacatccatccttctgaccacgatgagatgaccgctgtcctcacggcccaccagccgctgcaccaccacctgctccaagagtatgagatagagaggtcgttctttcttcgaatgaaatgtgtcttggcgaaaaggaacgcgggcctgacctgcagcggatacaaggtcatccactgcagtggctacttgaagatcaggcagtatatgctggacatgtccctgtacgactcctgctaccagattgtggggctggtggccgtgggccagtcgctgccacccagtgccatcaccgagatcaagctgtacagtaacatgttcatgttcagggccagccttgacctgaagctgatattcctggattccagggtgaccgaggtgacggggtacgagccgcaggacctgatcgagaagaccctataccatcacgtgcacggctgcgacgtgttccacctccgctacgcacaccacctcctgttggtgaagggccaggtcaccaccaagtactaccggctgctgtccaagcggggcggctgggtgtgggtgcagagctacgccaccgtggtgcacaacagccgctcgtcccggccccactgcatcgtgagtgtcaattatgtactcacggagattgaatacaaggaacttcagctgtccctggagcaggtgtccactgccaagtcccaggactcctggaggaccgccttgtctacctcacaagaaactaggaaattagtgaaacccaaaaataccaagatgaagacaaagctgagaacaaacccttaccccccacagcaatacagctcgttccaaatggacaaactggaatgcggccagctcggaaactggagagccagtccccctgcaagcgctgctgctcctccagaactgcagccccactcagaaagcagtgaccttctgtacacgccatcctacagcctgcccttctcctaccattacggacacttccctctggactctcacgtcttcagcagcaaaaagccaatgttgccggccaagttcgggcagccccaaggatccccttgtgaggtggcacgctttttcctgagcacactgccagccagcggtgaatgccagtggcattatgccaaccccctagtgcctagcagctcgtctccagctaaaaatcctccagagccaccggcgaacactgctaggcacagcctggtgccaagctacgaagcgcccgccgccgccgtgcgcaggttcggcgaggacaccgcgcccccgagcttcccgagctgcggccactaccgcgaggagcccgcgctgggcccggccaaagccgcccgccaggccgcccgggacggggcgcggctggcgctggcccgcgcggcacccgagtgctgcgcgcccccgacccccgaggccccgggcgcgccggcgcagctgcccttcgtgctgctcaactaccaccgcgtgctggcccggcgcggaccgctggggggcgccgcacccgccgcctccggcctggcctgcgctcccggcggccccgaggcggcgaccggcgcgctgcggctccggcacccgagccccgccgccacctccccgcccggcgcgcccctgccgcactacctgggcgcctcggtcatcatcaccaacgggaggtgacccgctggccgcccgcgccaggagcctggacccggcctcccggggctgcggcgccaccgagcccggcaaatgcgcacgacctacattaatttatgcagagacagctgtttgaattggaccccgccgccgacttgcggatttccaccgcggaggccccgcgcgccggtgccgagggccgaggagcgcccgggtccgggcaggtgaccgcccgcctctgtcctgcgagggccggtgcgacccagttgctgggggcttggtttcctcaccttgaaatcgggcttcacgcgtcttgccttgtccccaacgttccacaacagtcccgctgggggattgaagcggtttcactccgcaaatatcctccactttcaggagggaaaacccaccctaccacagtccgctcttccaagtggacggcagacctgggaggggacgcctgtgtcacgagcccttttagatgcttaggtgaaggcagaagtgatgattgtaagtcccatgaatacacaactccactgtctttaaaagtcattcaagagtctcattatttttgtttttatttaaccctttcttcaatacaaaaagccaacaaaccaagactaagggggtgaccatgcaattccattttgtgtctgtgaacataggtgtgcttcccaaatacattaacaagctcttacttccccctaacccctatgaactcttgataacaccaagagtagcaccttcagaatatattgaataggcattaaatgcaaaaatatatatgtagccagacagtttatgagaatgaccctgtcaagcttcattattacgtggcaaaatccctctggcccacacagatctgtaattcactaggctcgtgtttgctacaaatagtgctaataaagttaaattgcacgtgcaatacggaacactgtcaatggactgcaccttgtgaaggaaaaacatgcttaagggggtgtaatgaaaatgatgtagacattttaagcattttctacacagcgagaaaacttcgtaagaacatgttacgtgtgcaacaggtaaacagaaatcctttcataaagcaccagcagtgtttaaaaaatgagcttccattaatttttactttttatgggttttgcttaaagatctcaacatggaaaaatcctgtcatggctctgaactgcacaatgcattgaaccgccgtccttcaattttcttcacactatcaacactgcagcattttgctgctttatcaaaatggtttattttaggaaactttttccacctttctgaatggaaagaggttttcacaaatgttttaaactcatcgttctaaaatcaagtgcacctacaccaactgctctcaaaatgtgaactgacttttttttttttttttttgccaaccctgtgtcacttagtgaggacctgacacaatccctacagggtgtctgtcagtgggcctcatggtaagagtcacaatttgcaaatttaggaccgtgggtcatgcagcgaaggggctggatggtaggaagggatgtgcccgcctctccacgcactcagctatacctcattcacagctccttgtgagtgtgtgcacaggaaataagccgagggtattatttttttatgttcatgagtcttgtaattaaaccgtgattcttgaaaggtgtaggtttgattactaggagataccaccgacatttttcaataaagtactgcaaaatgcttttgtgtctaccttgttattaacttttggggctgtatttagtaaaaataaatcaaggctatcggagcagttcaataacaaaggttactgttgagaaaaaagaccctatcatagatttacaag

SEQ ID NO: 181779 - DNA, 1465 bp, Homo sapiens
  Payload ID: 15800
  Gene Symbol: SIM2
  Gene Name: single-minded family bHLH transcription factor 2
  ENST ID: ENST00000431229
  CDS Start-End: 1-1441
gtggggacagccgagccgcgccgggcccctggacggcgtcgccaaggagctgggatcgcacttgctgcagactttggatggatttgtttttgtggtagcatctgatggcaaaatcatgtatatatccgagaccgcttctgtccatttaggcttatcccaggtggagctcacgggcaacagtatttatgaatacatccatccttctgaccacgatgagatgaccgctgtcctcacggcccaccagccgctgcaccaccacctgctccaagagtatgagatagagaggtcgttctttcttcgaatgaaatgtgtcttggcgaaaaggaacgcgggcctgacctgcagcggatacaaggtcatccactgcagtggctacttgaagatcaggcagtatatgctggacatgtccctgtacgactcctgctaccagattgtggggctggtggccgtgggccagtcgctgccacccagtgccatcaccgagatcaagctgtacagtaacatgttcatgttcagggccagccttgacctgaagctgatattcctggattccagggtgaccgaggtgacggggtacgagccgcaggacctgatcgagaagaccctataccatcacgtgcacggctgcgacgtgttccacctccgctacgcacaccacctcctgttggtgaagggccaggtcaccaccaagtactaccggctgctgtccaagcggggcggctgggtgtgggtgcagagctacgccaccgtggtgcacaacagccgctcgtcccggccccactgcatcgtgagtgtcaattatgtactcacggagattgaatacaaggaacttcagctgtccctggagcaggtgtccactgccaagtcccaggactcctggaggaccgccttgtctacctcacaagaaactaggaaattagtgaaacccaaaaataccaagatgaagacaaagctgagaacaaacccttaccccccacagcaatacagctcgttccaaatggacaaactggaatgcggccagctcggaaactggagagccagtccccctgcaagcgctgctgctcctccagaactgcagccccactcagaaagcagtgaccttctgtacacgccatcctacagcctgcccttctcctaccattacggacacttccctctggactctcacgtcttcagcagcaaaaagccaatgttgccggccaagttcgggcagccccaaggatccccttgtgaggtggcacgctttttcctgagcacactgccagccagcggtgaatgccagtggcattatgccaaccccctagtgcctagcagctcgtctccagctaaaaatcctccagagccaccggcgaacactgctaggcacagcctggtgccaagctacgaaggcaagcagatgtcctctgcggagataccgccagctccccaggacgcagactgactcctgtttgctcgctggaccaac

SEQ ID NO: 181780 - DNA, 824 bp, Homo sapiens
  Payload ID: 15800
  Gene Symbol: SIM2
  Gene Name: single-minded family bHLH transcription factor 2
  ENST ID: ENST00000483178
  CDS Start-End: 1-222
gatggcaaaatcatgtatatatccgagaccgcttctgtccatttaggcttatcccaggtggagctcacgggcaacagtatttatgaatacatccatccttctgaccacgatgagatgaccgctgtcctcacggcccaccagccgctgcaccaccacctgctccaaggtattccatccagagggaaaaaaaaaaacagactaaaagcaaggcgacattcttaaatggaactcagggctttgcttcccacatctgccaagtggctgggcatgactaggactgcccagcccaggtctctccaatacacacacagcacccaccacgtggggatttgcattgatacctgtgtcttttaagccaatattcatcaagctcctattgttggccagaacccgtgttgagtgctaggtagaggacaaaagtggtgcaagcctgctcccctcgtgctcttgggtcagaattccagggattacagcatcacgggtctagaccaagcttctccttaaccaagatgccgtgcctaaaactcgggggtcgggggtggtccatgacatttcatggggaaaattacatatgtgtttcctccagttgaaatttggcatttcctttgcttctgatgatagatgataaaccatcttggggtccctagtacctgtggctttgccaacaatagaaatcacagatgttttccatatcataggaaagttttgcaggtttaaacatatcgcttatgcccacatgcctacttcaaaatttcaggagttctaagacctgctactgaatcttcttatttatgtattaataaagcagcacatttatatccgta

SEQ ID NO: 181781 - DNA, 1567 bp, Homo sapiens
  Payload ID: 15801
  Gene Symbol: SMDT1
  Gene Name: single-pass membrane protein with aspartate-rich tail 1
  Uniprot ID: Q9H4I9
  ENST ID: ENST00000331479
  CDS Start-End: 75-398
gctttcttcccgagggcggcacgagggctgggcggtggggtgcgggtgcccgggtgaggggcggagctgggggcatggcgtccggagcggctcgctggctagtattggcacccgtcaggtccggggctctccggagcgggcctagcttgaggaaagatggcgatgtctccgccgcatggagcggctcaggccggagcctggtaccgtcgaggtcagtcatcgttacccgcagcggcgccattttgcccaaaccggtgaaaatgtccttcggccttctccgtgtgttctccattgtgatcccctttctctatgtcgggacactcattagcaagaactttgctgctctacttgaggaacatgacatttttgttccagaggatgatgatgatgatgactaacaggaattacagaaaggagaaagcactaactgaagaaatggtgatgctctcagtttctctgccttccctatcagcagaaaggctcggggaaggccctcagcctcccagtctggtgaagcttcctgtatggtccatgaccgtattccaccccaggctctgggaggctccctgagatgtgctgtccactaagcactgcacaaacaagcaatcaaattatgaataaacataataaatatcagccgtgcgtgactgagtgatggctgcagtttctcagtatccctaggttctagttggtgcagttgtctctgctgtcctttatttatgggagaaacataggcccaggctatccaggctgcagtggagcctggtgaactattctgggggccctgggaactattttcattgtttacaaaagcccaacagaaactgtgcattttcccttaagaaagcttcatgggctaactaaagcctcatgccattctgtgttcagtgccagtcatgacagctctgcttgttagcatactacttaaatataactagaatgattcaaaactcgggttctgtgatatgaggatatagataggttttcatctatttcctggcttataactcccaaaacccttgttttaggcttttgttataatgttgggcacttcgggcctcagaaaacagcaggctgtttctcagatcttctcctgacctcctttcacctgctgctttttctccccaaggcaggccatagaaactaaaagtataatcttcctttgcccgtcttccagttggccataaaaagaatcctctgacctaccttgtctgattttaggtcatgagacccccatttcagaagggattctgccccatacctgagaggaagaaatgtagacaggccttgttggacttccccactccatctgtattagattatgcctcttttgtccaatcccatttctccagtgttgtccatgcttcaatcatccctatccaatgaggtctccataaaaggcccaagaagacaggtttagagagctttcggagaacagaacacttggctttgcaaagtggcacgcctggagagaacttggaagctccacgccccttctatacctcaccctatgcatctcttcagctgtatcttttgtgatatcctttataataaaccagtaaacgga

SEQ ID NO: 181782 - DNA, 591 bp, Homo sapiens
  Payload ID: 15801
  Gene Symbol: SMDT1
  Gene Name: single-pass membrane protein with aspartate-rich tail 1
  ENST ID: ENST00000422252
  CDS Start-End: 79-252
ggcggctttcttcccgagggcggcacgagggctgggcggtggggtgcgggtgcccgggtgaggggcggagctgggggcatggcgtccggagcggctcgctggctagtattggcacccgtcaggtccggggctctccggagcgggcctagcttgaggaaagatggcgatgtctccgccgcatggagcggctcaggccggagcctggtaccgtcgagatgtccttcggccttctccgtgtgttctccattgtgatcccctttctctatgtcgggacactcattagcaagaactttgctgctctacttgaggaacatgacatttttgttccagaggatgatgatgatgatgactaacaggaattacagaaaggagaaagcactaactgaagaaatggtgatgctctcagtttctctgccttccctatcagcagaaaggctcggggaaggccctcagcctcccagtctggtgaagcttcctgtatggtccatgaccgtattccaccccaggctctgggaggctccctgagatgtgctgtccactaagcactgcacaaacaagcaatcaaattatgaataaacataataaatatca

SEQ ID NO: 181783 - DNA, 1567 bp, Homo sapiens; identical to SEQ ID NO: 181781
  Payload ID: 15801
  Gene Symbol: SMDT1
  Gene Name: single-pass membrane protein with aspartate-rich tail 1
  Uniprot ID: Q9H4I9
  ENST ID: ENST00000571525
  CDS Start-End: 75-398

SEQ ID NO: 181784 - DNA, 1567 bp, Homo sapiens; identical to SEQ ID NO: 181781
  Payload ID: 15801
  Gene Symbol: SMDT1
  Gene Name: single-pass membrane protein with aspartate-rich tail 1
  Uniprot ID: Q9H4I9
  ENST ID: ENST00000607293
  CDS Start-End: 75-398

SEQ ID NO: 181785 - DNA, 591 bp, Homo sapiens; identical to SEQ ID NO: 181782
  Payload ID: 15801
  Gene Symbol: SMDT1
  Gene Name: single-pass membrane protein with aspartate-rich tail 1
  ENST ID: ENST00000608773
  CDS Start-End: 79-252

SEQ ID NO: 181786 - DNA, 1567 bp, Homo sapiens; identical to SEQ ID NO: 181781
  Payload ID: 15801
  Gene Symbol: SMDT1
  Gene Name: single-pass membrane protein with aspartate-rich tail 1
  Uniprot ID: Q9H4I9
  ENST ID: ENST00000615504
  CDS Start-End: 75-398

SEQ ID NO: 181787 - DNA, 591 bp, Homo sapiens; identical to SEQ ID NO: 181782
  Payload ID: 15801
  Gene Symbol: SMDT1
  Gene Name: single-pass membrane protein with aspartate-rich tail 1
  ENST ID: ENST00000625945
  CDS Start-End: 79-252

SEQ ID NO: 181788 - DNA, 591 bp, Homo sapiens; identical to SEQ ID NO: 181782
  Payload ID: 15801
  Gene Symbol: SMDT1
  Gene Name: single-pass membrane protein with aspartate-rich tail 1
  ENST ID: ENST00000630819
  CDS Start-End: 79-252

SEQ ID NO: 181789 - DNA, 1812 bp, Homo sapiens
  Payload ID: 15802
  Gene Symbol: SMCO1
  Gene Name: single-pass membrane protein with coiled-coil domains 1
  Uniprot ID: Q147U7
  ENST ID: ENST00000397537
  CDS Start-End: 158-802
cttgtactgagtgacctttcaggcagaatgtagactgagcgctcctgctactgctgcctgttgctgagaggaagaccgcagaaaattctggattcaaacatttattgctttttttgttttgctttgtttttgttttctttccttttgccttcagaagatgaacaatgaaaccacaaccctgatatccttgaaggaggcaatgaaaagagtagaccacaaactccaagcgttagaaacacagttcaaagaactagacttcaccaaggataacctgatgcagaaattcgaacatcatagtaaggctttggcaagccaagcagcccaagatgagatgtggacagcagttcgggcactccagctcacttcaatggaattgaatattttatacagctacgtcattgaagtacttatctgcttgcatactcgtgtgcttgagaagctgccagacctggtgagaggtcttccaaccttagcctctgtactcagaagaaaagttaagaacaagcgcgttagagttgtatgggagtccatactggaggagtgtgggctgcaagaaggagacatcacagcactttgtaccttctttattgcacgtggtaacaaggcagaacactatactgctaaagtgaggcagatgtacatcagggatgtcacgttcctaattactaacatggtaaagaaccaggctctgcaggacagtttgctgagggctgtgcaggtaattgagaaggggaaagcagttaggacccctgaaaagcaaaagtcatccctcgaagagttgataccatctgtcaaaaactaacctgttaccctatgacccagtgattccacctacagtaatttatcttggaaacagcaaaaagtatgcacaatttattatagtcttatttttatagcaaagagtgagaggatgttaaataaattatgacaaattgatacaatagatactttctttgcagccatataaaagaatgaagaagctctttgtgtaatgatatgaagtgatcaccaaatgtattgttgttttcaaatgtttatttccaatatacattgctaagtggaaaaaaggtgacaaatatatatatataaatatatatataacacatattagtttacatatccataaacttcttctgcagagatacacaagacagtgataacattagttgtcaggaaagaaagctaagaggctaggggtcaaagacaagaggaagtcttttcactgttaatccattttttacattttcaattttgaaccatgtgaatgtattacctatttaaaaaataaacaaggccggacatggtggctcatgcctataatccaagcaccttaggaggccaaggtaggaggatcacttgagctcaggggtttcagaccagcctgggcaacacagtgatagcaataggaggcaggtaaattcctaggcagacagggaggggtccctggtgaaactcaaccttcaagccaaggacagtctaaagcctgaaaaccaagctatgagttctggataaatccatgagccagactgagagctcccattctcgtctggcaccctctctcctgattggtccttacccttcacctattttatacatacctacccttccgcgattggtcctctacactatcgtgcctatttctgaatggtgctttgtcaagcatagccacagaccaatcagcatgcacttgcccatttctagcccacaaaaacccatagactcaggctcgtggccagcaacccaccttcgggtcccctctcactgccaagagccgttctgtcactcaataaattctactttgccttactcact

SEQ ID NO: 181790 - DNA, 1846 bp, Homo sapiens
  Payload ID: 15802
  Gene Symbol: SMCO1
  Gene Name: single-pass membrane protein with coiled-coil domains 1
  ENST ID: ENST00000452776
  CDS Start-End: 138-248
aggcagaatgtagactgagcgctcctgctactgctgcctgttgctgagaggaagaccgcagaaaattctggattcaaacatttattgctttttttgttttgctttgtttttgttttctttccttttgccttcagaagatgaacaatgaaaccacaaccctgatatccttgaaggaggcaatgaaaaggttgctgagggctatagggagggagcaagcatgggtctgctattctgggaagatggagtagaccacaaactccaagcgttagaaacacagttcaaagaactagacttcaccaaggataacctgatgcagaaattcgaacatcatagtaaggctttggcaagccaagcagcccaagatgagatgtggacagcagttcgggcactccagctcacttcaatggaattgaatattttatacagctacgtcattgaagtacttatctgcttgcatactcgtgtgcttgagaagctgccagacctggtgagaggtcttccaaccttagcctctgtactcagaagaaaagttaagaacaagcgcgttagagttgtatgggagtccatactggaggagtgtgggctgcaagaaggagacatcacagcactttgtaccttctttattgcacgtggtaacaaggcagaacactatactgctaaagtgaggcagatgtacatcagggatgtcacgttcctaattactaacatggtaaagaaccaggctctgcaggacagtttgctgagggctgtgcaggtaattgagaaggggaaagcagttaggacccctgaaaagcaaaagtcatccctcgaagagttgataccatctgtcaaaaactaacctgttaccctatgacccagtgattccacctacagtaatttatcttggaaacagcaaaaagtatgcacaatttattatagtcttatttttatagcaaagagtgagaggatgttaaataaattatgacaaattgatacaatagatactttctttgcagccatataaaagaatgaagaagctctttgtgtaatgatatgaagtgatcaccaaatgtattgttgttttcaaatgtttatttccaatatacattgctaagtggaaaaaaggtgacaaatatatatatataaatatatatataacacatattagtttacatatccataaacttcttctgcagagatacacaagacagtgataacattagttgtcaggaaagaaagctaagaggctaggggtcaaagacaagaggaagtcttttcactgttaatccattttttacattttcaattttgaaccatgtgaatgtattacctatttaaaaaataaacaaggccggacatggtggctcatgcctataatccaagcaccttaggaggccaaggtaggaggatcacttgagctcaggggtttcagaccagcctgggcaacacagtgatagcaataggaggcaggtaaattcctaggcagacagggaggggtccctggtgaaactcaaccttcaagccaaggacagtctaaagcctgaaaaccaagctatgagttctggataaatccatgagccagactgagagctcccattctcgtctggcaccctctctcctgattggtccttacccttcacctattttatacatacctacccttccgcgattggtcctctacactatcgtgcctatttctgaatggtgctttgtcaagcatagccacagaccaatcagcatgcacttgcccatttctagcccacaaaaacccatagactcaggctcgtggccagcaacccaccttcgggtcccctctcactgccaagagccgttctgtcactcaataaattctactttgccttactca

SEQ ID NO: 181791 - DNA, 1122 bp, Homo sapiens
  Payload ID: 15803
  Gene Symbol: SMCO2
  Gene Name: single-pass membrane protein with coiled-coil domains 2
  ENST ID: ENST00000298876
  CDS Start-End: 177-1058
acctgccttggtgtttaccactcaaatggttcctctctgcctttggtgctgaggaaaggaggctctggcaccactggaacaggaaaacttgactgttgctagtctattccattgaacttacagatatttgggattaccaaattgggaagagcaaagctatctccagtgccgaagaaatggctctcacgcccacaaacctaaataacaaaatgtctctgcagatgaagatggactgccaggaacaacagctgactaagaaaaacaatggctttttccaaaagctcaatgtgactgaaggtgcaatgcaggatttgctaaaggaaattatcaaagtggaccacatcttagacagatcggatgatgaggatgacatttcctccgaaaaccctcaaactgacttccttcacaagggtatgttggagctagaggctgagcatgaccaggacctgagtaaacaggataagcaagaaacagatgttgatgaggaccctcaagcgtctacatctctgcagttttcaaagaagaacctccttgaactcttattaaaagacatgctgaccctgaagggtcaaattgaaaagctggaggaccggggccttgaccttgatcaagggacaagcactgaggtgaatacttgtaatgaagtttatgaattaaagaagaaagtcatagaaaggctggaggacctttgcaagaatgtggaactgctgagtgcaaagctaaggatgtatcaaatggaggcagaggacactgactctcacagttctgaggaaatagatacggaagagatggaggccctgcttcctcaggccccagcatcctttttagtgcagaagtctcctccccgcaatacagcatggaaacgtgcactgaggattttcatcatgtttgatgtcctcaccgtcactggacttttatgttacatactattttttggtgctacatttctctttgaaagggtgcttctgagaatgcttgggtgccgcaccacatgggacctacgggagatgagagagcctttcttgaatttggaagtggaagccttgttaccctcctaaagatacagaagttactgtcaccctactgactttctcaccagtaaacattgtggctgttcctgta

SEQ ID NO: 181792 - DNA, 1272 bp, Homo sapiens
  Payload ID: 15803
  Gene Symbol: SMCO2
  Gene Name: single-pass membrane protein with coiled-coil domains 2
  Uniprot ID: A6NFE2
  ENST ID: ENST00000416383
  CDS Start-End: 177-1208
acctgccttggtgtttaccactcaaatggttcctctctgcctttggtgctgaggaaaggaggctctggcaccactggaacaggaaaacttgactgttgctagtctattccattgaacttacagatatttgggattaccaaattgggaagagcaaagctatctccagtgccgaagaaatggctctcacgcccacaaacctaaataacaaaatgtctctgcagatgaagatggactgccaggaacaacagctgactaagaaaaacaatggctttttccaaaagctcaatgtgactgaaggtgcaatgcaggatttgctaaaggaaattatcaaagtggaccacatcttagacagatcggatgatgaggatgacatttcctccgaaaaccctcaaactgacttccttcacaagggtatgttggagctagaggctgagcatgaccaggacctgagtaaacaggataagcaagaaacagatgttgatgaggaccctcaagcgtctacatctctgcagttttcaaagaagaacctccttgaactgtgtctgaagggcatgttcctcaagctaaactactggaacacaaagataggtctccaggtgaaagaacttggagctgattacatagacggaacggagaaaattgacaatattattaaaaaaataaatgtaacagaaaacacagtgaagagcttattaaaagacatgctgaccctgaagggtcaaattgaaaagctggaggaccggggccttgaccttgatcaagggacaagcactgaggtgaatacttgtaatgaagtttatgaattaaagaagaaagtcatagaaaggctggaggacctttgcaagaatgtggaactgctgagtgcaaagctaaggatgtatcaaatggaggcagaggacactgactctcacagttctgaggaaatagatacggaagagatggaggccctgcttcctcaggccccagcatcctttttagtgcagaagtctcctccccgcaatacagcatggaaacgtgcactgaggattttcatcatgtttgatgtcctcaccgtcactggacttttatgttacatactattttttggtgctacatttctctttgaaagggtgcttctgagaatgcttgggtgccgcaccacatgggacctacgggagatgagagagcctttcttgaatttggaagtggaagccttgttaccctcctaaagatacagaagttactgtcaccctactgactttctcaccagtaaacattgtggctgttcctgta

SEQ ID NO: 181793 - DNA, 1096 bp, Homo sapiens
  Payload ID: 15803
  Gene Symbol: SMCO2
  Gene Name: single-pass membrane protein with coiled-coil domains 2
  Uniprot ID: A6NFE2
  ENST ID: ENST00000535986
  CDS Start-End: 1-1032
atggctctcacgcccacaaacctaaataacaaaatgtctctgcagatgaagatggactgccaggaacaacagctgactaagaaaaacaatggctttttccaaaagctcaatgtgactgaaggtgcaatgcaggatttgctaaaggaaattatcaaagtggaccacatcttagacagatcggatgatgaggatgacatttcctccgaaaaccctcaaactgacttccttcacaagggtatgttggagctagaggctgagcatgaccaggacctgagtaaacaggataagcaagaaacagatgttgatgaggaccctcaagcgtctacatctctgcagttttcaaagaagaacctccttgaactgtgtctgaagggcatgttcctcaagctaaactactggaacacaaagataggtctccaggtgaaagaacttggagctgattacatagacggaacggagaaaattgacaatattattaaaaaaataaatgtaacagaaaacacagtgaagagcttattaaaagacatgctgaccctgaagggtcaaattgaaaagctggaggaccggggccttgaccttgatcaagggacaagcactgaggtgaatacttgtaatgaagtttatgaattaaagaagaaagtcatagaaaggctggaggacctttgcaagaatgtggaactgctgagtgcaaagctaaggatgtatcaaatggaggcagaggacactgactctcacagttctgaggaaatagatacggaagagatggaggccctgcttcctcaggccccagcatcctttttagtgcagaagtctcctccccgcaatacagcatggaaacgtgcactgaggattttcatcatgtttgatgtcctcaccgtcactggacttttatgttacatactattttttggtgctacatttctctttgaaagggtgcttctgagaatgcttgggtgccgcaccacatgggacctacgggagatgagagagcctttcttgaatttggaagtggaagccttgttaccctcctaaagatacagaagttactgtcaccctactgactttctcaccagtaaacattgtggctgttcctgta

SEQ ID NO: 181794 - DNA, 2104 bp, Homo sapiens
  Payload ID: 15804
  Gene Symbol: SMCO3
  Gene Name: single-pass membrane protein with coiled-coil domains 3
  Uniprot ID: A2RU48
  ENST ID: ENST00000316048
  CDS Start-End: 74-751
actttaacaatactcctaaacaactgctaggaccacggaactcagaaacacagcaagcgatcatattggaaatatggcccaaagtgacttcctttacccagagaacccaaaaaggcgggaagaagtaaatcgtcttcaccagcagcttcttgattgcttatctgacagcttcgatgtcaccaataagctgactgaggttctaaatatgcacttggggtgcaggctggcctccattgagatgaaaagagatgggaccatcaaagaaaactgtgacctcatcatccaagccattatgaaaatccaaaaggaattgcagaaggttgatgaagcactaaaagataagctagagccaaccctctatagaaaacttcaggatattaaggaaaaggaaacagacaaaattgcaatagtgcaaaaggttatttcggtcatcctgggagaagctacatctgcagccagtgcagtcgctgttaaacttgtgggctcaaatgtcacaactggcataattaacaagttggtcactgtgttagctcaaattggtgcttctctccttggtagtattggagttgctgttcttggccttggcatagatatgattgtccgtgccatcctgggagcagtggaaaaaacacagcttcaagcagccatcaaaagttatgagaagcatctggtggagttcaaatcagcctcagaaaaatataatcatgccattactgaggtcatcaatacagtgaaacaccaaatgaaatgaacagccgttttatttgccactgaagtgtttttctgcttccttttcagtaacagtgtttgcttctttgattaggttcattttctataggcttccaatatggacttaaataagataaacaatttggagagggaaactggagatgccaagactagatgactagatgagttttgagtcaacaatgcctggatcagctgatgctagaccctgtgaggtaaaaaaattttctccctggatgttttcacaccctgctctaccagatcaacattggggtaaatgctatcgtagagtagcaagtataggggttacttttctcttttctaatttcagtaaaattcttaaatttcacattgaatgcagagactttcatttctaccaccagcttcaaacatcatttagttataaggggacatactcagtaacttctgcctagacacaaactctaggccttcgaatgagacagaaatactaccatatttttgaccatcagagtaaatctggttttctgtaaactagaagagactgaaaaatggtttgtaacaatgtgcttcaattaggacaggaagctgatctgtaaacgtctactgattacacaatgtaaaccggatggatttgaaaatggtaaaaatcaaaactaaaaacatcaaggtcctgtttcagtcactgcaatcaaccctgaccaactgtgataattaaatatcgctcaagtgaatgttcaaacactgaaacatttagaagacaagaaagcaaaacacagctacacatattgcatttaggatgcagaatagaaggtcactactcaaagcatttgtcatttaaaagaaagtcataatttattataagctttcagaaaaaagaatataatttcattttcaacactagcaaaaaggaggcagctgcctttgctacatgacgcattaggtgggccatttcactaattacctgattttagaaaacgccaaaggctatggaagcctattaatggttccgctgaatctctgcagatgtgtttgttttctaaatcctttgccaaccaataattcccatgaggactcttttagtctatactgacaaaattattaatatgctgttgatgccagactgtgtttgttatagttgattctcccatccaagtacaagaaatgtattgaaataaaaactgctcagcatatcttaaaaatagtagctacatataaaattttagctacatgaaagactttaatatttccaacatacactgttttctctttctcttcttgcattgtttttcaaaacgagttgcaaaactatgatcactaatgtgttaggaaagaaaaaaaactagttgcaaaacattacaacttagctcaccttcgc

SEQ ID NO: 181795 - DNA, 1104 bp, Homo sapiens
  Payload ID: 15805
  Gene Symbol: SMCO4
  Gene Name: single-pass membrane protein with coiled-coil domains 4
  Uniprot ID: Q9NRQ5
  ENST ID: ENST00000298966
  CDS Start-End: 387-566
ggggaagagggggcgggagccgaggcccgggcgggggcagccagcgagttagggttaggacgggaggattcggcttcccggcggcagagggcgcctggcgctgcggtctggcgcgccagagtcgcccgcgcgggcgccgagaggagaggcgaggcggggagcgcaagcggcggcggccactgccacgtattcccggcagtggtggcggcggcggcggcggcgcccgcgggcaggaataactcaagtcacctgtactggaaatcagtttgctgaaattaatcaacgattcttgaagttgaagaaaaggaggttccagccttggcaagaggagtgtggcccttcctggaatccctctggacacaccctcctagcatcctctaggaaagatgcggcagctcaaagggaagcccaagaaggagacctccaaggacaagaaggagcggaagcaagccatgcaggaggcccggcagcagatcactacagtggtgctgcccacgctggccgtggtcgtgctcttgatcgtggtgtttgtgtacgtggccacgcgccccaccatcaccgagtgagccccgcagccggctgcggaccccatcggcagggagaggaggcgcgggagggggacgcaaacaaaaaatggctttcatattcagagatgttcatgttgctgagctgtaagcaggagcaccctgtcttctctggtctttgacttgattaaagtatctccgctttcttgggagggaataggggatgttttatcagtgaatgtgccatacaccttatggtccacttcatgtgcctttcagacttcaaagcgcgcgcgcatgtgtgtgtgtgtgtgtgtgtgtgtgtgtgtgtgtgtgtgcttctttttctctcctaaaaatcgataagtagctccacctgaagagggatggaacctctgggtcaggaaacagctggaatccacactcacctcattcccattgtttggatcatgcttctttccaacacgtgttcacaatctccaaagggactgtatttcttctctgtgcttaatgtgatttgaaatatgttgaatcaaagtgaaatatttattttttgaataaaggagataatagccttaaa

SEQ ID NO: 181796 - DNA, 889 bp, Homo sapiens
  Payload ID: 15805
  Gene Symbol: SMCO4
  Gene Name: single-pass membrane protein with coiled-coil domains 4
  Uniprot ID: Q9NRQ5
  ENST ID: ENST00000525141
  CDS Start-End: 172-351
caggaataactcaagtcacctgtactggaaatcagtttgctgaaattaatcaacgattcttgaagttgaagaaaagttgttctctctacaggaggttccagccttggcaagaggagtgtggcccttcctggaatccctctggacacaccctcctagcatcctctaggaaagatgcggcagctcaaagggaagcccaagaaggagacctccaaggacaagaaggagcggaagcaagccatgcaggaggcccggcagcagatcactacagtggtgctgcccacgctggccgtggtcgtgctcttgatcgtggtgtttgtgtacgtggccacgcgccccaccatcaccgagtgagccccgcagccggctgcggaccccatcggcagggagaggaggcgcgggagggggacgcaaacaaaaaatggctttcatattcagagatgttcatgttgctgagctgtaagcaggagcaccctgtcttctctggtctttgacttgattaaagtatctccgctttcttgggagggaataggggatgttttatcagtgaatgtgccatacaccttatggtccacttcatgtgcctttcagacttcaaagcgcgcgcgcatgtgtgtgtgtgtgtgtgtgtgtgtgtgtgtgtgtgtgtgcttctttttctctcctaaaaatcgataagtagctccacctgaagagggatggaacctctgggtcaggaaacagctggaatccacactcacctcattcccattgtttggatcatgcttctttccaacacgtgttcacaatctccaaagggactgtatttcttctctgtgcttaatgtgatttgaaatatgttgaatcaaagtgaaatatttattttttgaataaaggagataatagccttaaa

SEQ ID NO: 181797 - DNA, 355 bp, Homo sapiens
  Payload ID: 15805
  Gene Symbol: SMCO4
  Gene Name: single-pass membrane protein with coiled-coil domains 4
  ENST ID: ENST00000529714
  CDS Start-End: 200-355
cctcttcaaagacctaatcagcgtctagtgggaataactcaagtcacctgtactggaaatcagtttgctgaaattaatcaacgattcttgaagttgaagaaaagttgttctctctacaggaggttccagccttggcaagaggagtgtggcccttcctggaatccctctggacacaccctcctagcatcctctaggaaagatgcggcagctcaaagggaagcccaagaaggagacctccaaggacaagaaggagcggaagcaagccatgcaggaggcccggcagcagatcactacagtggtgctgcccacgctggccgtggtcgtgctcttgatcgtggtgtttgtgtacgtggcc

SEQ ID NO: 181798 - DNA, 472 bp, Homo sapiens
  Payload ID: 15805
  Gene Symbol: SMCO4
  Gene Name: single-pass membrane protein with coiled-coil domains 4
  Uniprot ID: Q9NRQ5
  ENST ID: ENST00000527149
  CDS Start-End: 224-403
ggaggaagccaggttacctctgttggacctgcctgctcccagcatctccagcaacaagctgtctctgccggaataactcaagtcacctgtactggaaatcagtttgctgaaattaatcaacgattcttgaagttgaagaaaaggaggttccagccttggcaagaggagtgtggcccttcctggaatccctctggacacaccctcctagcatcctctaggaaagatgcggcagctcaaagggaagcccaagaaggagacctccaaggacaagaaggagcggaagcaagccatgcaggaggcccggcagcagatcactacagtggtgctgcccacgctggccgtggtcgtgctcttgatcgtggtgtttgtgtacgtggccacgcgccccaccatcaccgagtgagccccgcagccggctgcggaccccatcggcagggagaggaggcgcgggagggggacgcaaacaaaaaat

SEQ ID NO: 181799 - DNA, 374 bp, Homo sapiens
  Payload ID: 15805
  Gene Symbol: SMCO4
  Gene Name: single-pass membrane protein with coiled-coil domains 4
  ENST ID: ENST00000526869
  CDS Start-End: 234-374
gcggggagcgcaagcggcggcggccactgccacgtattcccggcagtggtggcggcggcggcggcggcgcccgcgggcaggaataactcaagtcacctgtactggaaatcagtttgctgaaattaatcaacgattcttgaagttgaagaaaaggaggttccagccttggcaagaggagtgtggcccttcctggaatccctctggacacaccctcctagcatcctctaggaaagatgcggcagctcaaagggaagcccaagaaggagacctccaaggacaagaaggagcggaagcaagccatgcaggaggcccggcagcagatcactacagtggtgctgcccacgctggccgtggtcgtgctcttgatcgtggtg

SEQ ID NO: 181800 - DNA, 180 bp, Homo sapiens
  Payload ID: 15805
  Gene Symbol: SMCO4
  Gene Name: single-pass membrane protein with coiled-coil domains 4
  Uniprot ID: Q9NRQ5
  ENST ID: ENST00000596676
  CDS Start-End: 1-180
atgcggcagctcaaagggaagcccaagaaggagacctccaaggacaagaaggagcggaagcaagccatgcaggaggcccggcagcagatcactacagtggtgctgcccacgctggccgtggtcgtgctcttgatcgtggtgtttgtgtacgtggccacgcgccccaccatcaccgagtga

SEQ ID NO: 181801 - DNA, 687 bp, Homo sapiens
  Payload ID: 15806
  Gene Symbol: SSBP1
  Gene Name: single-stranded DNA binding protein 1, mitochondrial
  Uniprot ID: Q04837
  ENST ID: ENST00000265304
  CDS Start-End: 134-580
ctgtttcctttttcctctggcgagctttgcgttccctgtgcgccggaagtgatcccctgcgtggctgggctgctcgggttagatcgtcaggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaa

SEQ ID NO: 181802 - DNA, 630 bp, Homo sapiens
  Payload ID: 15806
  Gene Symbol: SSBP1
  Gene Name: single-stranded DNA binding protein 1, mitochondrial
  ENST ID: ENST00000467681
  CDS Start-End: 224-630
gggttagatcgtcaggtgagggaggaagggatagccagcgcgaaggaagtgctggagtcgtgtgttttggctgcgcgtgatcctgcgtgggtcgggaggtgtttctgtgtaggtgtctggccctttcatcagtcgtgcggaggaccgcgtgatttccttccagttctcctcggttttcaggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataa

SEQ ID NO: 181803 - DNA, 470 bp, Homo sapiens
  Payload ID: 15806
  Gene Symbol: SSBP1
  Gene Name: single-stranded DNA binding protein 1, mitochondrial
  ENST ID: ENST00000473783
  CDS Start-End: 386-470
gtccacctctccctatggtgtggctggctagcccgggggtctctacgctgcttggtctttgttaacggagatgaaggcagtaatttttcagtaacaggtttcagatataagtcccttggtgatgctaatatttatggaggccttactatgcattaagaacttttttagaagtttagaaaatggcagtgaataaagcagatacaaatctctgctctaagggagcttgcatagtaatgaaatttgagaagacagtggattggaagtgggattaactcagaatcaaaattttgtcgatgggttggaggaagaggaagttatttgggaccaaaaagacatacaggtgaaaagcctaaagattagactgtaagaaaagaaaatagaagccatgtttcgaagacctgtattacaggtacttcgtcagtttgtaagacatgagtccgaaacaactaccagtttggttcttgaaagat

SEQ ID NO: 181804 - DNA, 676 bp, Homo sapiens
  Payload ID: 15806
  Gene Symbol: SSBP1
  Gene Name: single-stranded DNA binding protein 1, mitochondrial
  Uniprot ID: Q04837
  ENST ID: ENST00000484178
  CDS Start-End: 123-569
ggtgtccacctctccctatggtgtggctggctagcccgggggtctctacgctgcttggtctttgttaacggagatgaaggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaa

SEQ ID NO: 181805 - DNA, 636 bp, Homo sapiens
  Payload ID: 15806
  Gene Symbol: SSBP1
  Gene Name: single-stranded DNA binding protein 1, mitochondrial
  Uniprot ID: Q04837
  ENST ID: ENST00000498107
  CDS Start-End: 190-636
gtgcgccggaagtgatcccctgcgtggctgggctgctcgggttagatcgtcaggtgagggaggaagggatagccagcgcgaaggaagtgctggagtcgtgtgttttggctgcgcgtgatcctgcgtgggtcgggaggtgtttctgtgaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtag

SEQ ID NO: 181806 - DNA, 600 bp, Homo sapiens
  Payload ID: 15806
  Gene Symbol: SSBP1
  Gene Name: single-stranded DNA binding protein 1, mitochondrial
  ENST ID: ENST00000463093
  CDS Start-End: 237-600
agatcgtcaggtgagggaggaagggatagccagcgcgaaggaagtgctggagtcgtgtgttttggctgcgcgtgatcctgcgtgggtcgggaggtgtttctgtgtaggtgtctggccctttcatcagtcgtgcggaggaccgcgtgatttccttccagttctcctcggttttcaggtggtggcgccatcttcggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggata

SEQ ID NO: 181807 - DNA, 989 bp, Homo sapiens
  Payload ID: 15806
  Gene Symbol: SSBP1
  Gene Name: single-stranded DNA binding protein 1, mitochondrial
  Uniprot ID: Q04837
  ENST ID: ENST00000481508
  CDS Start-End: 436-882
acctctccctatggtgtggctggctagcccgggggtctctacgctgcttggtctttgttaacggagatgaaggcagtaatttttcagtaacaggtttcagatataagtcccttggtgatgctaatatttatggaggccttactatgcattaagaacttttttagaagtttagaaaatggcagtgaataaagcagatacaaatctctgctctaagggagcttgcatagtaatgaaatttgagaagacagtggattggaagtgggattaactcagaatcaaaattttgtcgatgggttggaggaagaggaagttatttgggaccaaaaagacatacaggtgtgagtttatttgggagggaggaaggaatcctcatcagatgtgcaggaatgttggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaa

SEQ ID NO: 181808 - DNA, 731 bp, Homo sapiens
  Payload ID: 15806
  Gene Symbol: SSBP1
  Gene Name: single-stranded DNA binding protein 1, mitochondrial
  Uniprot ID: Q04837
  ENST ID: ENST00000465582
  CDS Start-End: 55-501
tagatcgtcaggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttgggattctgacacagccagcagcagtacgtgttcatcagcactgaagcagggcacctcctgattcagcagagagaccctcccctccccagccatgttggcggctgccctaggattgctgatgcccattgcaggggctgaatttctcattggcctggttggaaatggagtccctgtggtctgcagttttagaggatgggtca

SEQ ID NO: 181809 - DNA, 470 bp, Homo sapiens; identical to SEQ ID NO: 181803
  Payload ID: 15806
  Gene Symbol: SSBP1
  Gene Name: single-stranded DNA binding protein 1, mitochondrial
  ENST ID: ENST00000573322
  CDS Start-End: 386-470

SEQ ID NO: 181810 - DNA, 457 bp, Homo sapiens
  Payload ID: 15806
  Gene Symbol: SSBP1
  Gene Name: single-stranded DNA binding protein 1, mitochondrial
  Uniprot ID: Q04837
  ENST ID: ENST00000575059
  CDS Start-End: 55-457
tagatcgtcaggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctg

SEQ ID NO: 181811 - DNA, 838 bp, Homo sapiens
  Payload ID: 15806
  Gene Symbol: SSBP1
  Gene Name: single-stranded DNA binding protein 1, mitochondrial
  Uniprot ID: Q04837
  ENST ID: ENST00000576834
  CDS Start-End: 436-838
acctctccctatggtgtggctggctagcccgggggtctctacgctgcttggtctttgttaacggagatgaaggcagtaatttttcagtaacaggtttcagatataagtcccttggtgatgctaatatttatggaggccttactatgcattaagaacttttttagaagtttagaaaatggcagtgaataaagcagatacaaatctctgctctaagggagcttgcatagtaatgaaatttgagaagacagtggattggaagtgggattaactcagaatcaaaattttgtcgatgggttggaggaagaggaagttatttgggaccaaaaagacatacaggtgtgagtttatttgggagggaggaaggaatcctcatcagatgtgcaggaatgttggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctg

SEQ ID NO: 181812 - DNA, 592 bp, Homo sapiens
  Payload ID: 15806
  Gene Symbol: SSBP1
  Gene Name: single-stranded DNA binding protein 1, mitochondrial
  Uniprot ID: Q04837
  ENST ID: ENST00000571430
  CDS Start-End: 190-592
gtgcgccggaagtgatcccctgcgtggctgggctgctcgggttagatcgtcaggtgagggaggaagggatagccagcgcgaaggaagtgctggagtcgtgtgttttggctgcgcgtgatcctgcgtgggtcgggaggtgtttctgtgaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctg

SEQ ID NO: 181813 - DNA, 536 bp, Homo sapiens
  Payload ID: 15806
  Gene Symbol: SSBP1
  Gene Name: single-stranded DNA binding protein 1, mitochondrial
  Uniprot ID: Q04837
  ENST ID: ENST00000570667
  CDS Start-End: 134-536
ctgtttcctttttcctctggcgagctttgcgttccctgtgcgccggaagtgatcccctgcgtggctgggctgctcgggttagatcgtcaggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctg

SEQ ID NO: 181814 - DNA, 626 bp, Homo sapiens
  Payload ID: 15806
  Gene Symbol: SSBP1
  Gene Name: single-stranded DNA binding protein 1, mitochondrial
  ENST ID: ENST00000576311
  CDS Start-End: 224-626
gggttagatcgtcaggtgagggaggaagggatagccagcgcgaaggaagtgctggagtcgtgtgttttggctgcgcgtgatcctgcgtgggtcgggaggtgtttctgtgtaggtgtctggccctttcatcagtcgtgcggaggaccgcgtgatttccttccagttctcctcggttttcaggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctg

SEQ ID NO: 181815 - DNA, 600 bp, Homo sapiens; identical to SEQ ID NO: 181806
  Payload ID: 15806
  Gene Symbol: SSBP1
  Gene Name: single-stranded DNA binding protein 1, mitochondrial
  ENST ID: ENST00000571709
  CDS Start-End: 237-600

SEQ ID NO: 181816 - DNA, 525 bp, Homo sapiens
  Payload ID: 15806
  Gene Symbol: SSBP1
  Gene Name: single-stranded DNA binding protein 1, mitochondrial
  Uniprot ID: Q04837
  ENST ID: ENST00000574199
  CDS Start-End: 123-525
ggtgtccacctctccctatggtgtggctggctagcccgggggtctctacgctgcttggtctttgttaacggagatgaaggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctg

SEQ ID NO: 181817 - DNA, 884 bp, Homo sapiens
  Payload ID: 15806
  Gene Symbol: SSBP1
  Gene Name: single-stranded DNA binding protein 1, mitochondrial
  Uniprot ID: Q04837
  ENST ID: ENST00000612337
  CDS Start-End: 304-750
cctctggcgagctttgcgttccctgtgcgccggaagtgatcccctgcgtggctgggctgctcgggttagatcgtcaggtgagggaggaagggatagccagcgcgaaggaagtgctggagtcgtgtgttttggctgcgcgtgatcctgcgtgggtcgggaggtgtttctgtgtaggtgtctggccctttcatcagtcgtgcggaggaccgcgtgatttccttccagttctcctcggttttcaggtggtggcgccatcttcggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaatgagtaataatcttttttctgactgtc

SEQ ID NO: 181818 - DNA, 8780 bp, Homo sapiens
  Payload ID: 15807
  Gene Symbol: SSBP2
  Gene Name: single-stranded DNA binding protein 2
  Uniprot ID: P81877
  ENST ID: ENST00000320672
  CDS Start-End: 212-1297
ggcttagccgccaccgcgcgcttcggaaggccagagggagggggaggcctgtcagtctcgcgcgttgcctgggcgaagggggcggagctttggcgtggggcggccaatagtgggggtggctgcgtgggtcgccatggggacggggctgttcccggggaggctgtgatgggttgacaggtgcgtgacagtgggagctgctctcggcacaagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacagtgctgcagcagctcccagtccagtgctaggaaacattcccccaggagatggcatgccagtaggtcctgtaccaccagggttctttcagccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacagaactatggaggtgcaatgagacccccactgaatgctttaggtggccctggaatgcctggaatgaacatgggtccaggtggtggtagaccttggccaaacccaacaaatgccaattcaataccatactcctcagcatctcctgggaattatgtaggtcctccaggaggtggagggccaccaggaacacccatcatgcctagtccagcagattcaaccaactctggtgataacatgtatactttaatgaatgcagtacctcctggacctaacagacctaattttccaatgggtcctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtaaatgtctgcaatcatggataggaataaaatcgcttatttgagagctttcattaaattgcgtctgatgcaagttatcctgtgaatcacaaagtgtactgtctcaaaaaatagaagaaaatgtgtcttcgtctttatgttgaatcaaacaatttctcagttaccttcagtgaaaagtatttttttaatttttatttgagaaaaacacttcaaatcagtaaaagcttaactggggcctcacacagtatatttctgcaataactgctttaaacggagttcttgatttgtttgtcttagatgatacagaaatcattaaatagcccaaatcatttagaccatagcaataaagtgaccggggttgtcatatatttagcaacatcttttctctttaacatgatgaagcccaaaagtgataacaaaagcatttgcttgaatttgtcacttctcaccaggagtactagaggtaaatttttaataacatactaatgtgaaatggtatctggtttttattcagactttttgtgagcatattcttatagacactagaaataaatacatagaaggagactttgagcacaagggagaagagagttattagcactcctgaggcctctggaatgctgcttttctatccaggtatcttgcttgctaccagcagaattgactggtattggttctcactggccagggagcctctgctctgttcctggaatataaggcttttattcaggagcaaatcattgatagtaactttgctttatctagccattgacttcagcaggctaaaactacattgtgtaactgactgttcaaaaaagaataagtaaattttttttaatctaattcccttatggaaagcaccttgctctatggcactttccagatcttttgggattttgtgcttaattatacatacatacaccaaaatcacaatagaaagatatgaagactttaattttagactctgaaagataactgggtgatcctttgtgttaaaattgtgatacaaacaaccattgataaataccaactatgaatccaaactctagagactttgaaaagcattgtttaattgcaggtaagaggaatcttctctttcctttaggcttatagtctctaaagtgaaaatttggcaggatatagtcatgcagctcataatgacattccaatcaaccacagactgcatatacagcagtggtcctataagattataataccatatttttagcatatcttttctatgcttagatacacaaataccattgtattacagttgcctttggtattcagtacagtaacatgctgtacaggtttgtagcctaggagcaatagtttatattatatagcctaggtgtgtaggagcctataccatctaggtttgtgtaagtacactctatgatgttcagacaaggacaatattgcctgacaatgcatttctcagaatgtatacttatcattaagtaacatatgactgtatgtactagttcctgatgacttacttctctcaaattcataatgatttagtccttgtaaaaataaagattttgcctgtgcctaaacagggatactaggcagaactgttgagaaaaaaaagctgaattaaatttatgttgcagatttaaactatcataaaatgagcctcagttaatcacacacagtattcaggtgcctaggagtgcacaccggagaacagcctcatgctgtcaagctgcagaaacctttcatgcaaattcagatgaaaaggtctttacctcaagccagggtaacctgaatgaaggtgatagtttgtccagacacctgactttaccaagaagaattttgactttcatattttatgacaatcatataaaaattgacagtcctttgattattaagcttaatcttataatgctagaattttcaaatattttgttgactcttctccattgttaccgatcttgaaattcttttcttcgccttctgagaaggtattatttcttatcacaaagaatgatgaatatgattttatctacccttattttgggggtaatacgagaatatgaattgcatcatgatccccattatttctaacctaaaagtaaaattcgttttttttttcaaggcagagcagtcaattgattataagtatttatttcttttttcttcttggagcccagattaaaaagagttattttagatttaaaaatttcctgaaatagttgaaaaattatttttgaggagaaaattgtatccaagaaacccagaatgtaaggatacttgatttttatatccagataattctttcatgcactgaatggaagacagtatatctgtatattaatttttgtttagattttgaatcatttaacccttatccttttttcttgtaataagactatttaatgtttttctcttgtgttttccatctttatcaatgcattcgtgttggtcttgatgtatactacctgttcctagtgttatttttacacgtcatctcacagtaataatatcagcaattcttgctgcattgaacatattaaatacacatgtaaaatgaaaaagtaagcagtaggtaaaatcttgttactctgctttgcattctgcctaactcactgcatttgaaaatacatgtcaaattctttctgagggtatgtatgattcttaactacgtgtcttacagcaaagttgcccatgggaacaaaggctgtagggtgtcattgatcttgtaatacaacacatatttgatgggtgaatcttattagcactcctttgaaaatgttccagtatggagtcagttgctgataaagaggaagttcacagctaggaatccgaagttaagatttctcaattgccgcctgggcactcatgcctgtaatcccagcacttgggaggccaaggtgggcagatcacctgaggtcgggagttcaagaccagcctggccaacctggtgaaacccccccatctctactaaaaatacaaaaattagccaggtatggtggtggctgcctgtaatcccagctactcaagaggctgaggcgggagaatcacttgaacccaggaggcggaggttgcagtgagccgagattgtgccactgcactccagcctgggtgacagagcaagactccatctcaaaaatagaaaagatttctcaattgccaaaaagattaacaagtaaatcaattctgctcccccagccatgaaaagtgcccaaaacagccctttccctccagaataaaataaaacttccatttctatttttatgattctctaagatatctgaactccattgcatttcatagggttattcagttagcacttctgtggtttaaaagacaacaaatgaaaataagtaagttcagtttggggcatgaagaagtcccacatctgtctatatcttttcttcatcatattgtccctaggaatgtatagcaaagcattcagaactgctcctttggctggggaagttttccaccgtccttaatactatgaagtcttgattacttcttccgtggctttatccttgcctccctcccaatccctgcatcttccaggagaaataaaataccaactgaacactgttaccttctcagcccttaccattttcatctgcatatagtgtatagtactaagagtagttttcccaggagaaataattgcaattttcatttcttgattatcactgctaattcgaaggagtgccacaaatcatagccacttgattttgattttggaatgcattttagtgttttgacactggttttccttttttttaaatttttttttcttttttttttttgagacagtcttgctctgtcacccaggctggagtgcagtggcacaatcttggctcactgccgtctccgcctcccaggttccagagattctcctgcctcagcctccagagtagctggattacaggcatgcgtcacaggctaatttttgtatttttagtagaggcagggtttcaccatgttggccaggctggtctggaactcctgacctcaagtgatctgcccgcctcagcctcccaaagtgctgggattacaggcatgagccactatgcttgatcaggttttcctcttttttttttttttttttgagtcagaatcttgctctgtcacccaggctggagtgcaatggtgtgatctcggctcactgcaaccttcacctcccgggttcatgcaattctcctgcctcagcctcccgagtggctgggactacaggtgctcaccaccatgcccagctaattttttgtatttttagtagagaccgggtttcaccgtgttagccaggatggtctcgatctcctgacctcgtgatccacccgccttggcctcccaaagtgttgggattacaggcatgagccaccgtacctggcccaggttttcctttttttttatgtcttctgtacaatagagttggccctccatatccacaggttccacatccctgattcaatcaactcctgataaaaaatattggaaaaaatttttataacaataaaaaccaataatacaacaataattacaaataatacattgtaacaatgatttccatggcatttataatacattgtattaggtattataagtaaacgagatgatttgaagtatattggaggatgtgcataggttatactatgccgttttatataaaggacttaagcgtctgtggattttggtatctgcagaggtcctggaaccggtctcccttggatacggagggacaactgtagttctctgtctttgaaaacattaatcgatacaagtggccagtgaatgtatagtatgggagggagtaatccagtatgggggacaaggttgccatatatttgccaaaagtagttgaatcttctttctgtttttccctcctggtggaataagtttattgtttgctatgaggagccagaggctgtgtttgtttaaagcaatggtacccaatcttaagcatgtgtaaaggtctccctgggtctgtgaaccataccttgagaaataactagaaaagtaaaagaatggtgaaccactattaataatacttccattttgcatactaaatatgttgcgtgtacctgtgtgtgtgtgttgggaatagtaatatgaagtttgctcacaaaacactcccactgtgattcacattattttatagcacaaccaataatgattaaacataattatttcctttgactacttttcatttcagtggtaaaacagctgatgaaagttatttgggatggaaagagtaatacaagacatacgcagatggagtctcctgtgcgtaggtttagcacacccatgttagcttgtccacattaggccttcttttgaaggtactgtatctaaagataagggcataagtgatcatttaattctcagccacttcactgatactacaaggtgttacacagtaattatagtggtttgatacagacatttgtttacaagaaactgaattggcattattaacttatttcacacaaaaaaagttagctttacccatgaactgtaattcagattgataaggtgacctacccatgaaaaagacacctgagacctgtttacttttttaaactatgaagtgaaatcctcagttcaataagtgtcccaaggagaatttcctctgttaaattttccctgttaacttagtataattggttttcttgaatagaagaataatgatttctgtaagatattttaatgtgaatatttttgctgtcttcatctttaaaaattaaatacagtactatatatagatattaaaattttaaagtgggactaggtgtttttatgtatacaattacagtttgtctcctctctttgcaaatttactggctattatcagaataaaggttggactcattttgcttatcccagtcattaaaatgttgtgatctgtttctaacatatttagcatttcatttttaaaatgagatgtgccattatcataacaaaggcaactattaatgttcctagaaaaaatgatgtaaaggacttactcctagtcaatattaacacttaatcccactttcttttttccaccaaatggcctcagtacattgccaagagagtgaaatttggattcctcacagtactcagaacacaatatgatatttgtcagctaactttccatcatgtcttggtaaaattgctcagttaaatataattggccatctacttattaaaaaacaattcaaataatctgtacagttaccataatttgacaacaaattactttaaatttagcaccatcttagaaatcttcttaatataaactactgattgaaatgtgtttatactttctatcatatttcaaactgttttactttccttgcattaagacaattaaaacacaaactacatgttagaatgaataatttaaaggacatgctgctgtttcagcataaaaaatggtaaagtctttataaatagaatacttatgatagccattaacgtattgaattgtttaattaacctagttgtgattttccgaatttaagacgttttcttactacatgtgttaaattgttacctataatatcttcctggaaaaatagaagtatttgtaaggtttttataaatgcacaatttatgtataaatataattggaatctgggatgactcttagtaatctactattcttaattcaacgatggccaccagctacctgacacattttgtaaatttagcatctgtgtatgtgtgttcgtgtatgtgtgtgtgcgtgcatgtgcacattactgcatttattctcaaatggatttataatttagtgtttttgtacaagtacttgagctattcatgtaatgggataagttgccataaagatgtacataaatgacccttaatttggcacgttttcacatttaattttttaaaatacagcttttcatatacagttcctaccctttcatttctagcctgtacttcattacttgttgaaaaagtcaagtttgtatgaagccagcataaacatcaaaatataactaatgtgga

SEQ ID NO: 181819 - DNA, 709 bp, Homo sapiens
  Payload ID: 15807
  Gene Symbol: SSBP2
  Gene Name: single-stranded DNA binding protein 2
  ENST ID: ENST00000509013
  CDS Start-End: 84-709
taacagcagcgccgtcccgtccgacagccaggcccgggagaaaattcatctgtgccttattccagttcactcttgtaagggtgatgcttgtgatcccctcagccctcatgtattcattcgtattatattggaggttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacagtgctgcagcagctcccagtccagtgctaggaaacattcccccaggagatggcatgccagtaggtcctgtaccaccagggttctttcagccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacagaactatggaggtgcaatgagacccccactgaatgctttaggtggccctggaatgcctggaatgaacat

SEQ ID NO: 181820 - DNA, 1534 bp, Homo sapiens
  Payload ID: 15807
  Gene Symbol: SSBP2
  Gene Name: single-stranded DNA binding protein 2
  Uniprot ID: P81877
  ENST ID: ENST00000509053
  CDS Start-End: 7-903
acaagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacagaactatggaggtgcaatgagacccccactgaatgctttaggtggccctggaatgcctggaatgaacatgggtccaggtggtggtagaccttggccaaacccaacaaatgccaattcaataccatactcctcagcatctcctgggaattatgtaggtcctccaggaggtggagggccaccaggaacacccatcatgcctagtccagcagattcaaccaactctggtgataacatgtatactttaatgaatgcagtacctcctggacctaacagacctaattttccaatgggtcctgggtcagatggtcccatgggtggattaggaggaatggagtcacatcacatgaatggctctttaggctcaggagatatggacagtatttccaagtactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtaaatgtctgcaatcatggataggaataaaatcgcttatttgagagctttcattaaattgcgtctgatgcaagttatcctgtgaatcacaaagtgtactgtctcaaaaaatagaag

SEQ ID NO: 181821 - DNA, 1521 bp, Homo sapiens
  Payload ID: 15807
  Gene Symbol: SSBP2
  Gene Name: single-stranded DNA binding protein 2
  Uniprot ID: P81877
  ENST ID: ENST00000505980
  CDS Start-End: 6-1031
caagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacagtgctgcagcagctcccagtccagtgctaggaaacattcccccaggagatggcatgccagtaggtcctgtaccaccagggttctttcaggcacttggaggtgtcccaggaagtcagccattactccccagtggaatggatccaactcgacaacaaggacatccaaatatgggtgggccaatgcagagaatgactcctccaagaggaatggtgcccttaggaccacagaactatggaggtgcaatgagacccccactgaatgctttaggtggccctggaatgcctggaatgaacatgggtccaggtggtggtagaccttggccaaacccaacaaatgccaattcaataccatactcctcagcatctcctgggaattatgtaggtcctccaggaggtggagggccaccaggaacacccatcatgcctagtccagcagattcaaccaactctggtgataacatgtatactttaatgaatgcagtacctcctggacctaacagacctaattttccaatgggtcctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaa

SEQ ID NO: 181822 - DNA, 1336 bp, Homo sapiens
  Payload ID: 15807
  Gene Symbol: SSBP2
  Gene Name: single-stranded DNA binding protein 2
  ENST ID: ENST00000512923
  CDS Start-End: 1-795
agtgctgcagcagctcccagtccagtgctaggaaacattcccccaggagatggcatgccagtaggtcctgtaccaccagggttctttcagccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacagaactatggaggtgcaatgagacccccactgaatgctttaggtggccctggaatgcctggaatgaacatgggtccaggtggtggtagaccttggccaaacccaacaaatgccaattcaataccatactcctcagcatctcctgggaattatgtaggtcctccaggaggtggagggccaccaggaacacccatcatgcctagtccagcagattcaaccaactctggtgataacatgtatactttaatgaatgcagtacctcctggacctaacagacctaattttccaatgggtcctgggtcagatggtcccatgggtggattaggaggaatggagtcacatcacatgaatggctctttaggtaaggcttttcaatttgataattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtaaatgtctgcaatcatggataggaa

SEQ ID NO: 181823 - DNA, 1398 bp, Homo sapiens
  Payload ID: 15807
  Gene Symbol: SSBP2
  Gene Name: single-stranded DNA binding protein 2
  Uniprot ID: P81877
  ENST ID: ENST00000515395
  CDS Start-End: 56-1075
gaggctgtgatgggttgacaggtgcgtgacagtgggagctgctctcggcacaagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacagtctgacccttggttatcattacagaactatggaggtgcaatgagacccccactgaatgctttaggtggccctggaatgcctggaatgaacatgggtccaggtggtggtagaccttggccaaacccaacaaatgccaattcaataccatactcctcagcatctcctgggaattatgtaggtcctccaggaggtggagggccaccaggaacacccatcatgcctagtccagcagattcaaccaactctggtgataacatgtatactttaatgaatgcagtacctcctggacctaacagacctaattttccaatgggtcctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccaca

SEQ ID NO: 181824 - DNA, 1396 bp, Homo sapiens
  Payload ID: 15807
  Gene Symbol: SSBP2
  Gene Name: single-stranded DNA binding protein 2
  ENST ID: ENST00000504985
  CDS Start-End: 1-828
agtgctgcagcagctcccagtccagtgctaggaaacattcccccaggagatggcatgccagtaggtcctgtaccaccagggttctttcagccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacagtctgacccttggttatcattacagaactatggaggtgcaatgagacccccactgaatgctttaggtggccctggaatgcctggaatgaacatgggtccaggtggtggtagaccttggccaaacccaacaaatgccaattcaataccatactcctcagcatctcctgggaattatgtaggtcctccaggaggtggagggccaccaggaacacccatcatgcctagtccagcagattcaaccaactctggtgataacatgtatactttaatgaatgcagtacctcctggacctaacagacctaattttccaatgggtcctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtaaatgtctgcaatcatggataggaataaaatcgcttatttgagagctttcat

SEQ ID NO: 181825 - DNA, 1790 bp, Homo sapiens
  Payload ID: 15807
  Gene Symbol: SSBP2
  Gene Name: single-stranded DNA binding protein 2
  Uniprot ID: P81877
  ENST ID: ENST00000514493
  CDS Start-End: 209-1204
ttagccgccaccgcgcgcttcggaaggccagagggagggggaggcctgtcagtctcgcgcgttgcctgggcgaagggggcggagctttggcgtggggcggccaatagtgggggtggctgcgtgggtcgccatggggacggggctgttcccggggaggctgtgatgggttgacaggtgcgtgacagtgggagctgctctcggcacaagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacagaactatggaggtgcaatgagacccccactgaatgctttaggtggccctggaatgcctggaatgaacatgggtccaggtggtggtagaccttggccaaacccaacaaatgccaattcaataccatactcctcagcatctcctgggaattatgtaggtcctccaggaggtggagggccaccaggaacacccatcatgcctagtccagcagattcaaccaactctggtgataacatgtatactttaatgaatgcagtacctcctggacctaacagacctaattttccaatgggtcctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtaaatgtctgcaatcatggataggaataaaatcgcttatttgagagctttcattaaattgcgtctgatgca

SEQ ID NO: 181826 - DNA, 4465 bp, Homo sapiens
  Payload ID: 15807
  Gene Symbol: SSBP2
  Gene Name: single-stranded DNA binding protein 2
  ENST ID: ENST00000615665
  CDS Start-End: 212-1321
ggcttagccgccaccgcgcgcttcggaaggccagagggagggggaggcctgtcagtctcgcgcgttgcctgggcgaagggggcggagctttggcgtggggcggccaatagtgggggtggctgcgtgggtcgccatggggacggggctgttcccggggaggctgtgatgggttgacaggtgcgtgacagtgggagctgctctcggcacaagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacagtgctgcagcagctcccagtccagtgctaggaaacattcccccaggagatggcatgccagtaggtcctgtaccaccagggttctttcagccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacagtctgacccttggttatcattacagaactatggaggtgcaatgagacccccactgaatgctttaggtggccctggaatgcctggaatgaacatgggtccaggtggtggtagaccttggccaaacccaacaaatgccaattcaataccatactcctcagcatctcctgggaattatgtaggtcctccaggaggtggagggccaccaggaacacccatcatgcctagtccagcagattcaaccaactctggtgataacatgtatactttaatgaatgcagtacctcctggacctaacagacctaattttccaatgggtcctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtaaatgtctgcaatcatggataggaataaaatcgcttatttgagagctttcattaaattgcgtctgatgcaagttatcctgtgaatcacaaagtgtactgtctcaaaaaatagaagaaaatgtgtcttcgtctttatgttgaatcaaacaatttctcagttaccttcagtgaaaagtatttttttaatttttatttgagaaaaacacttcaaatcagtaaaagcttaactggggcctcacacagtatatttctgcaataactgctttaaacggagttcttgatttgtttgtcttagatgatacagaaatcattaaatagcccaaatcatttagaccatagcaataaagtgaccggggttgtcatatatttagcaacatcttttctctttaacatgatgaagcccaaaagtgataacaaaagcatttgcttgaatttgtcacttctcaccaggagtactagaggtaaatttttaataacatactaatgtgaaatggtatctggtttttattcagactttttgtgagcatattcttatagacactagaaataaatacatagaaggagactttgagcacaagggagaagagagttattagcactcctgaggcctctggaatgctgcttttctatccaggtatcttgcttgctaccagcagaattgactggtattggttctcactggccagggagcctctgctctgttcctggaatataaggcttttattcaggagcaaatcattgatagtaactttgctttatctagccattgacttcagcaggctaaaactacattgtgtaactgactgttcaaaaaagaataagtaaattttttttaatctaattcccttatggaaagcaccttgctctatggcactttccagatcttttgggattttgtgcttaattatacatacatacaccaaaatcacaatagaaagatatgaagactttaattttagactctgaaagataactgggtgatcctttgtgttaaaattgtgatacaaacaaccattgataaataccaactatgaatccaaactctagagactttgaaaagcattgtttaattgcaggtaagaggaatcttctctttcctttaggcttatagtctctaaagtgaaaatttggcaggatatagtcatgcagctcataatgacattccaatcaaccacagactgcatatacagcagtggtcctataagattataataccatatttttagcatatcttttctatgcttagatacacaaataccattgtattacagttgcctttggtattcagtacagtaacatgctgtacaggtttgtagcctaggagcaatagtttatattatatagcctaggtgtgtaggagcctataccatctaggtttgtgtaagtacactctatgatgttcagacaaggacaatattgcctgacaatgcatttctcagaatgtatacttatcattaagtaacatatgactgtatgtactagttcctgatgacttacttctctcaaattcataatgatttagtccttgtaaaaataaagattttgcctgtgcctaaacagggatactaggcagaactgttgagaaaaaaaagctgaattaaatttatgttgcagatttaaactatcataaaatgagcctcagttaatcacacacagtattcaggtgcctaggagtgcacaccggagaacagcctcatgctgtcaagctgcagaaacctttcatgcaaattcagatgaaaaggtctttacctcaagccagggtaacctgaatgaaggtgatagtttgtccagacacctgactttaccaagaagaattttgactttcatattttatgacaatcatataaaaattgacagtcctttgattattaagcttaatcttataatgctagaattttcaaatattttgttgactcttctccattgttaccgatcttgaaattcttttcttcgccttctgagaaggtattatttcttatcacaaagaatgatgaatatgattttatctacccttattttgggggtaatacgagaatatgaattgcatcatgatccccattatttctaacctaaaagtaaaattcgttttttttttcaaggcagagcagtcaattgattataagtatttatttcttttttcttcttggagcccagattaaaaagagttattttagatttaaaaatttcctgaaatagttgaaaaattatttttgaggagaaaattgtatccaagaaacccagaatgtaaggatacttgatttttatatccagataattctttcatgcactgaatggaagacagtatatctgtatattaatttttgtttagattttgaatcatttaacccttatccttttttcttgtaataagactatttaatgtttttctcttgtgttttccatctttatcaatgcattcgtgttggtcttgatgtatactacctgttcctagtgttatttttacacgtcatctcacagtaataatatcagcaattcttgctgcattgaacatattaaatacacatgtaaaatgaaaaagtaagcagtaggtaaaatcttgttactctgctttgcattctgcctaactcactgcatttgaaaatacatgtcaaattctttctgagggta

SEQ ID NO: 181827 - DNA, 1698 bp, Homo sapiens
  Payload ID: 15807
  Gene Symbol: SSBP2
  Gene Name: single-stranded DNA binding protein 2
  ENST ID: ENST00000622130
  CDS Start-End: 185-1129
gggttgacaggtgcgtgacagtgggagctgctctcggcacaagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaacatcacattgggggaaccaccaggattcttacattcttggtggtgtgtattttgggatctctactgtgcagctccagagagacgtgaaacatgtgaacactcaagtgaagcaaaagccttccatgattacagtgctgcagcagctcccagtccagtgctaggaaacattcccccaggagatggcatgccagtaggtcctgtaccaccagggttctttcagccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacagaactatggaggtgcaatgagacccccactgaatgctttaggtggccctggaatgcctggaatgaacatgggtccaggtggtggtagaccttggccaaacccaacaaatgccaattcaataccatactcctcagcatctcctgggaattatgtaggtcctccaggaggtggagggccaccaggaacacccatcatgcctagtccagcagattcaaccaactctggtgataacatgtatactttaatgaatgcagtacctcctggacctaacagacctaattttccaatgggtcctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtaaatgtctgcaatcatggataggaataaaatcgcttatttgagagctttcatt

SEQ ID NO: 181828 - DNA, 627 bp, Homo sapiens
  Payload ID: 15808
  Gene Symbol: SMUG1
  Gene Name: single-strand-selective monofunctional uracil-DNA glycosylase 1
  Uniprot ID: Q53HV7
  ENST ID: ENST00000243112
  CDS Start-End: 46-579
ggaaacgggatggggagctggaccaggtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaaggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctca

SEQ ID NO: 181829 - DNA, 1571 bp, Homo sapiens
  Payload ID: 15808
  Gene Symbol: SMUG1
  Gene Name: single-strand-selective monofunctional uracil-DNA glycosylase 1
  Uniprot ID: Q53HV7
  ENST ID: ENST00000337581
  CDS Start-End: 131-943
aaacgggatggggagctggaccagcagattatgagcttacagaaagcctggcctacattttactctttttggatttcttcctcatcaagagactgctgcagtgcctgtcatgtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaagtgagtggtgcccgattctggggctttttccggaacctctgtggacagcctgaggtcttcttccatcactgttttgtccacaatctatgccctctgcttttcctggctcccagcgggcgcaaccttactcctgctgagctgcctgccaagcagcgagaacagcttcttgggatctgtgatgcagccctctgccggcaggtgcagctgctgggggtgcggctggtggtgggagttgggcgactggcagagcagcgggcacgacgggctctggcaggcctgatgccagaggtccaggtggaagggctcctgcatccctctccccgtaacccacaggccaacaagggctgggaggcagtggccaaggaaagattgaatgagctggggctgctgccactgctgttgaaatgagtgcccttggggccttgcatgggacacattcaagacctcgaagtcattcttggccaagcagatgacaacacatctcctggactggagcaaaaggtccttctgtgcaccctggtcgctgggaaacgtattctttgatctgttgaactgtcttccaacctgccatggcagttttgacactactcctgtttgccctcctgattcctgctttctttaccttttaacattgcccctttcaggggaccccactttgtagggaatctgcagaaggtgtgcttttgcacttgcagactgctctacctcagtgtttccttgggagactttattcagctgagagtgccctagacagtaacttctaaggtcacgtttactatttcagaggaaatatcttgccaggatacctacccatccttatagaacagttacctttagctgacccctttcctcacagggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggc

SEQ ID NO: 181830 - DNA, 1082 bp, Homo sapiens
  Payload ID: 15808
  Gene Symbol: SMUG1
  Gene Name: single-strand-selective monofunctional uracil-DNA glycosylase 1
  Uniprot ID: Q53HV7
  ENST ID: ENST00000401977
  CDS Start-End: 128-940
agacggaattttgctctgaattccaggctggagtgcaatggcgcgatctcagctcactgcagcctccgcctcccgggttcaagcgattcttctgcctcagcctcccgagtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaagtgagtggtgcccgattctggggctttttccggaacctctgtggacagcctgaggtcttcttccatcactgttttgtccacaatctatgccctctgcttttcctggctcccagcgggcgcaaccttactcctgctgagctgcctgccaagcagcgagaacagcttcttgggatctgtgatgcagccctctgccggcaggtgcagctgctgggggtgcggctggtggtgggagttgggcgactggcagagcagcgggcacgacgggctctggcaggcctgatgccagaggtccaggtggaagggctcctgcatccctctccccgtaacccacaggccaacaagggctgggaggcagtggccaaggaaagattgaatgagctggggctgctgccactgctgttgaaatgagtgcccttggggccttgcatgggacacattcaagacctcgaagtcattcttggccaagcagatgacaacacatctcctggactggagcaaaaggtccttctgtgcaccctggtcgctgggaaacgtattctttgatctgttg

SEQ ID NO: 181831 - DNA, 926 bp, Homo sapiens
  Payload ID: 15808
  Gene Symbol: SMUG1
  Gene Name: single-strand-selective monofunctional uracil-DNA glycosylase 1
  Uniprot ID: Q53HV7
  ENST ID: ENST00000514685
  CDS Start-End: 327-860
agggggctgggaatccgggactgtgggggcaagttgacggctcccagggtcgtcggggctgagccgagagggtggttagaatttctatattttggggtccctccctccgtatggggtaagactcagtgcagggagagcccagcctatgaaaccgcctgggaggtctgcaggatcaaggctttccagtcggccggagccagcgggcgcccccggaggttttcagattatgagcttacagaaagcctggcctacattttactctttttggatttcttcctcatcaagagactgctgcagtgcctgtcatgtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaaggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggctcctcatctgtaaaa

SEQ ID NO: 181832 - DNA, 712 bp, Homo sapiens
  Payload ID: 15808
  Gene Symbol: SMUG1
  Gene Name: single-strand-selective monofunctional uracil-DNA glycosylase 1
  Uniprot ID: Q53HV7
  ENST ID: ENST00000506595
  CDS Start-End: 113-646
ctgaattccaggctggagtgcaatggcgcgatctcagctcactgcagcctccgcctcccgggttcaagcgattcttctgcctcagcctcccgagtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaaggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggctcctcatctgtaaaa

SEQ ID NO: 181833 - DNA, 470 bp, Homo sapiens
  Payload ID: 15808
  Gene Symbol: SMUG1
  Gene Name: single-strand-selective monofunctional uracil-DNA glycosylase 1
  ENST ID: ENST00000504797
  CDS Start-End: 184-470
ggaagtagggggctgggaatccgggactgtgggggcaagttgacggctcccagggtcgtcggggctgagccgagagggtgattatgagcttacagaaagcctggcctacattttactctttttggatttcttcctcatcaagagactgctgcagtgcctgtcatgtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggt

SEQ ID NO: 181834 - DNA, 2607 bp, Homo sapiens
  Payload ID: 15808
  Gene Symbol: SMUG1
  Gene Name: single-strand-selective monofunctional uracil-DNA glycosylase 1
  ENST ID: ENST00000505128
  CDS Start-End: 124-504
acgggatggggagctggaccaggctggagtgcaatggcgcgatctcagctcactgcagcctccgcctcccgggttcaagcgattcttctgcctcagcctcccgagtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtaaagggtttggcttccccagtgggtggagtggggggttctaggtggatgcttggctgggtgtgctgtggagaaggagcatgtgcatggctgtagacatgtgtaggtcctcccgccccattctgtctcaacacatatactggctcctgtggtccgaggccctctcccagcgtctctgcccgtaattaaccaagcacattaatggtagtttcgttttccctgtgagctggccagtaattgcctctgagagcccttccttccgccagccccatccttactttactggatctcccctgtccctgaagtgtggttggggtcagaagagggactaggactgctgggtcctcagaagagactggttgacaggggtgggtatgtaagagatgcagggcgttctgggaacctgggttctgtttcctagctaaggcgaggttcaaaacagagcctggctccagtgcctgcccgcttttctttcagggctcaggatgagtgactgcccccagtgggggtgcttggcaggtgggggaggggaagaggcttcagggcagaaggctcaatcgcttttattgaccccaactgggtgatgaaaggtgatcaatgatgatcgatggaaatgacagcctgaggcttggggctgagagggcatccagacagcagtggtcagcccatccttgtgcctcctttaaccctggctgcctttctgtctcagaccatctgtctgtccccagtactaaccatcaaaccctgtgtagggctagatatctcaatgtagtccctgtacttagtcccaaaggctagttgggctagagggaaacaaattcttctggaccacggttcacaatgaagaactggaaaaagacagacaggctcaaaccatagggccaagaatccttgtctcaggcctttgggtgaaggtaggggtagggggtgcaggctggatcctcatgtaaggtataaagaagtcagttggtccagagcccgggcctcaggtctccagtttgaagcctttcatgtctctctccttcctcacaggtgccctttggggaagtaagcatggtccgggactggttgggcattgtggggcctgtgctgacccctccccaagagcatcctaaacgaccagtgctgggactggagtgcccacagtcagaagtgagtggtgcccgattctggggctttttccggaacctctgtggacagcctgaggtcttcttccatcactgttttgtccacaatctatgccctctgcttttcctggctcccagcgggcgcaaccttactcctgctgagctgcctgccaagcagcgagaacagcttcttgggatctgtgatgcagccctctgccggcaggtgcagctgctgggggtgcggctggtggtgggagttgggcgactggcagagcagcgggcacgacgggctctggcaggcctgatgccagaggtccaggtggaagggctcctgcatccctctccccgtaacccacaggccaacaagggctgggaggcagtggccaaggaaagattgaatgagctggggctgctgccactgctgttgaaatgagtgcccttggggccttgcatgggacacattcaagacctcgaagtcattcttggccaagcagatgacaacacatctcctggactggagcaaaaggtccttctgtgcaccctggtcgctgggaaacgtattctttgatctgttgaactgtcttccaacctgccatggcagttttgacactactcctgtttgccctcctgattcctgctttctttaccttttaacattgcccctttcaggggaccccactttgtagggaatctgcagaaggtgtgcttttgcacttgcagactgctctacctcagtgtttccttgggagactttattcagctgagagtgccctagacagtaacttctaaggtcacgtttactatttcagaggaaatatcttgccaggatacctacccatccttatagaacagttacctttagctgacccctttcctcacagggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggctcctcatctgt

SEQ ID NO: 181835 - DNA, 751 bp, Homo sapiens
  Payload ID: 15808
  Gene Symbol: SMUG1
  Gene Name: single-strand-selective monofunctional uracil-DNA glycosylase 1
  ENST ID: ENST00000504338
  CDS Start-End: 235-751
gggtggttagaatttctatattttggggtccctccctccgtatggggctggagtgcaatggcgcgatctcagctcactgcagcctccgcctcccgggttcaagcgattcttctgcctcagcctcccgacagattatgagcttacagaaagcctggcctacattttactctttttggatttcttcctcatcaagagactgctgcagtgcctgtcatgtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaagtgagtggtgcccgattctggggctttttccggaacctctgtggacagcctgaggtcttcttccatcactgttttgtccacaatctatgccctctgcttttcctggctccca

SEQ ID NO: 181836 - DNA, 465 bp, Homo sapiens
  Payload ID: 15808
  Gene Symbol: SMUG1
  Gene Name: single-strand-selective monofunctional uracil-DNA glycosylase 1
  ENST ID: ENST00000507904
  CDS Start-End: 142-465
gggggaaaggaaccggaaacgggatggggagctggaccaggctggagtgcaatggcgcgatctcagctcactgcagcctccgcctcccgggttcaagcgattcttctgcctcagcctcccgagtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttg

SEQ ID NO: 181837 - DNA, 2119 bp, Homo sapiens
  Payload ID: 15808
  Gene Symbol: SMUG1
  Gene Name: single-strand-selective monofunctional uracil-DNA glycosylase 1
  Uniprot ID: Q53HV7
  ENST ID: ENST00000513838
  CDS Start-End: 425-958
ggaccaggtgaggaagtagggggctgggaatccgggactgtgggggcaagttgacggctcccagggtcgtcggggctgagccgagagggtggttagaatttctatattttggggtccctccctccgtatggggtaagactcagtgcagggagagcccagcctatgaaaccgcctgggaggtctgcaggatcaaggctttccagtcggccggagccagcgggcgcccccggaggctggagtgcaatggcgcgatctcagctcactgcagcctccgcctcccgggttcaagcgattcttctgcctcagcctcccgagtagcagattatgagcttacagaaagcctggcctacattttactctttttggatttcttcctcatcaagagactgctgcagtgcctgtcatgtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaaggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggctcctcatctgtaaaacagggatgcctaccttatggggttggtgtgaggattaactgagatcacacttgaaagtgccttgcatgggcttggcatgtgggtgctcattacatagtcttcttgttttcttgcctctgggttgaggattcacagcactgcactacaagggtagcccctctccattctggataccttgctaggagagagtctgggcttccacctgcggccagggtgaagggaaaattcttgccatgtcagagatggatcaatgactatgaaaaaactagcctgtgattttttttcactctaagcattaagagctcctaaagccttttgtcttgttacttttttccccctcttgcatgctagaggtggaaggtagtcatttagatttcccccctcttccctcttcattgttggccaggggttctcttgggcagctgggggaaggatgtagtagatctctcttttttttttttttttgagatggagtctcatgctgttgcccaggctggagtgcagtggcatggtctcagttcactgcaacatctgctttcccggttcaagtgattctcctgcctcagcctcctgtatagctggaattacaggcatgtgccaccacgcctggctaatttttgtatttttattaaagacagtgtttcaccatgttggccaggctggtctcaaactcctgacttcaagtaatccacctgtcttggcctcccaaagtgctgctgcctggctggatgtagcagatctccaattgccttaccaaacctgcagggtctctgttaagtgtctgttaggggtcttatatgatactctggacaccgtgagaaacaggtgatggggcagatgggaacctggtatccaactcattttttatgtctgctgaatggttgactgggtgcccctttggtaagggctgggaaagtgaaccaagttgggagcagagcaggtcttgagaccaccttaatgaggaacacatggtctacttcctatctcctgggacacaggtcatttccagcttccagaattagtaagatttttcatataaatcctcccctacttcattgtataataaagaatttggcctttgtcttcagttcctga

SEQ ID NO: 181838 - DNA, 1697 bp, Homo sapiens
  Payload ID: 15808
  Gene Symbol: SMUG1
  Gene Name: single-strand-selective monofunctional uracil-DNA glycosylase 1
  Uniprot ID: Q53HV7
  ENST ID: ENST00000508394
  CDS Start-End: 64-876
gggtgggggaaaggaaccggaaacgggatggggagctggaccaggtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaagtgagtggtgcccgattctggggctttttccggaacctctgtggacagcctgaggtcttcttccatcactgttttgtccacaatctatgccctctgcttttcctggctcccagcgggcgcaaccttactcctgctgagctgcctgccaagcagcgagaacagcttcttgggatctgtgatgcagccctctgccggcaggtgcagctgctgggggtgcggctggtggtgggagttgggcgactggcagagcagcgggcacgacgggctctggcaggcctgatgccagaggtccaggtggaagggctcctgcatccctctccccgtaacccacaggccaacaagggctgggaggcagtggccaaggaaagattgaatgagctggggctgctgccactgctgttgaaatgagtgcccttggggccttgcatgggacacattcaagacctcgaagtcattcttggccaagcagatgacaacacatctcctggactggagcaaaaggtccttctgtgcaccctggtcgctgggaaacgtattctttgatctgttgaactgtcttccaacctgccatggcagttttgacactactcctgtttgccctcctgattcctgctttctttaccttttaacattgcccctttcaggggaccccactttgtagggaatctgcagaaggtgtgcttttgcacttgcagactgctctacctcagtgtttccttgggagactttattcagctgagagtgccctagacagtaacttctaaggtcacgtttactatttcagaggaaatatcttgccaggatacctacccatccttatagaacagttacctttagctgacccctttcctcacagggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggctcctcatctgtaaaacagggatgcctaccttatggggttggtgtgaggattaactgagatcacacttgaaagtgccttgcatgggcttggcatgtgggtgctcattacatagtcttcttgttttcttgcctctgggttgaggattcacagcactgcactacaagggtagcccctctccattctggataccttg

SEQ ID NO: 181839 - DNA, 541 bp, Homo sapiens
  Payload ID: 15808
  Gene Symbol: SMUG1
  Gene Name: single-strand-selective monofunctional uracil-DNA glycosylase 1
  ENST ID: ENST00000503306
  CDS Start-End: 296-541
aaacgggatggggagctggaccagcagattatgagcttacagaaagcctggcctacattttactctttttggatttcttcctcatcaagagactgctgcagtgcctgtcatatggggtctcattatgtcagccaggctggtcttgaactcctggcctcaagcaattcttctgccttggcctctcaaagtgctgggattacaggcatgagccactgtgcccagcacagaaggtagttttaaacaaaagtgaaaaagaagatggacattgctgagcaggtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctg

SEQ ID NO: 181840 - DNA, 553 bp, Homo sapiens
  Payload ID: 15808
  Gene Symbol: SMUG1
  Gene Name: single-strand-selective monofunctional uracil-DNA glycosylase 1
  ENST ID: ENST00000514196
  CDS Start-End: 50-529
aaccggaaacgggatggggagctggaccaggtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaagccaacaagggctgggaggcagtggccaaggaaagattgaatgagctggggctgctgccactgctgttgaaatgagtgcccttggggccttgcatggga

SEQ ID NO: 181841 - DNA, 621 bp, Homo sapiens
  Payload ID: 15808
  Gene Symbol: SMUG1
  Gene Name: single-strand-selective monofunctional uracil-DNA glycosylase 1
  ENST ID: ENST00000509864
  CDS Start-End: 1-431
aggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaaaaaattcttgctgctgtattgagaacagattgagaaaacaagggcagaagcagggagaccagtcaggagctgattgcagtatcaggctggtctggaactcctgggctgaagctatcctcttgccttggcctccctaaatgttggaattacagacatgggccactacacctggcgatctgtgtcttatacgccactgtcctgtcttcatgcggatgaaggggga

SEQ ID NO: 181842 - DNA, 572 bp, Homo sapiens
  Payload ID: 15808
  Gene Symbol: SMUG1
  Gene Name: single-strand-selective monofunctional uracil-DNA glycosylase 1
  ENST ID: ENST00000506169
  CDS Start-End: 302-572
aaaggaaccggaaacgggatggggagctggaccaggctggagtgcaatggcgcgatctcagctcactgcagcctccgcctcccgggttcaagcgattcttctgcctcagcctcccgaatggggtctcattatgtcagccaggctggtcttgaactcctggcctcaagcaattcttctgccttggcctctcaaagtgctgggattacaggcatgagccactgtgcccagcacagaaggtagttttaaacaaaagtgaaaaagaagatggacattgctgagcaggtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggca

SEQ ID NO: 181843 - DNA, 1115 bp, Homo sapiens
  Payload ID: 15808
  Gene Symbol: SMUG1
  Gene Name: single-strand-selective monofunctional uracil-DNA glycosylase 1
  ENST ID: ENST00000635546
  CDS Start-End: 165-650
gggggttgggtttggggtgggggaaaggaaccggaaacgggatggggagctggaccagcagattatgagcttacagaaagcctggcctacattttactctttttggatttcttcctcatcaagagactgctgcagtgcctgtcatgtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaagaggatatagggcagctgtttcctcttcttccctggtgccccagagaagtaaagaacttcaactggagcatgagacattgaggttagacacatggataaacttcccagctgtgaccatcaggcgccccaacatatggagctgcagtttagcagatgctacgtggcatacagatttccggaaaattcttgctgctgtattgagaacagattgagaaaacaagggcagaagcagggagaccagtcaggagctgattgcagtatcaggctggtctggaactcctgggctgaagctatcctcttgccttggcctccctaaatgttggaattacagacatgggccactacacctggcgatctgtgtcttatacgctgggcagatgtgcctgagacaggtttgaccaggcaactgaaaagacatccctaagggaagacaaagcaaaggtatgaaaggaacacacgtccctgactgactaggaggaacagagctgcctgctgtctggaaccgcttcctcccagactaagtgagaaataaacttctgttttcta

SEQ ID NO: 181844 - DNA, 4094 bp, Homo sapiens
  Payload ID: 15809
  Gene Symbol: SIRT1
  Gene Name: sirtuin 1
  Uniprot ID: Q96EB6
  ENST ID: ENST00000212015
  CDS Start-End: 54-2297
gtcgagcgggagcagaggaggcgagggaggagggccagagaggcagttggaagatggcggacgaggcggccctcgcccttcagcccggcggctccccctcggcggcgggggccgacagggaggccgcgtcgtcccccgccggggagccgctccgcaagaggccgcggagagatggtcccggcctcgagcggagcccgggcgagcccggtggggcggccccagagcgtgaggtgccggcggcggccaggggctgcccgggtgcggcggcggcggcgctgtggcgggaggcggaggcagaggcggcggcggcaggcggggagcaagaggcccaggcgactgcggcggctggggaaggagacaatgggccgggcctgcagggcccatctcgggagccaccgctggccgacaacttgtacgacgaagacgacgacgacgagggcgaggaggaggaagaggcggcggcggcggcgattgggtaccgagataaccttctgttcggtgatgaaattatcactaatggttttcattcctgtgaaagtgatgaggaggatagagcctcacatgcaagctctagtgactggactccaaggccacggataggtccatatacttttgttcagcaacatcttatgattggcacagatcctcgaacaattcttaaagatttattgccggaaacaatacctccacctgagttggatgatatgacactgtggcagattgttattaatatcctttcagaaccaccaaaaaggaaaaaaagaaaagatattaatacaattgaagatgctgtgaaattactgcaagagtgcaaaaaaattatagttctaactggagctggggtgtctgtttcatgtggaatacctgacttcaggtcaagggatggtatttatgctcgccttgctgtagacttcccagatcttccagatcctcaagcgatgtttgatattgaatatttcagaaaagatccaagaccattcttcaagtttgcaaaggaaatatatcctggacaattccagccatctctctgtcacaaattcatagccttgtcagataaggaaggaaaactacttcgcaactatacccagaacatagacacgctggaacaggttgcgggaatccaaaggataattcagtgtcatggttcctttgcaacagcatcttgcctgatttgtaaatacaaagttgactgtgaagctgtacgaggagatatttttaatcaggtagttcctcgatgtcctaggtgcccagctgatgaaccgcttgctatcatgaaaccagagattgtgttttttggtgaaaatttaccagaacagtttcatagagccatgaagtatgacaaagatgaagttgacctcctcattgttattgggtcttccctcaaagtaagaccagtagcactaattccaagttccataccccatgaagtgcctcagatattaattaatagagaacctttgcctcatctgcattttgatgtagagcttcttggagactgtgatgtcataattaatgaattgtgtcataggttaggtggtgaatatgccaaactttgctgtaaccctgtaaagctttcagaaattactgaaaaacctccacgaacacaaaaagaattggcttatttgtcagagttgccacccacacctcttcatgtttcagaagactcaagttcaccagaaagaacttcaccaccagattcttcagtgattgtcacacttttagaccaagcagctaagagtaatgatgatttagatgtgtctgaatcaaaaggttgtatggaagaaaaaccacaggaagtacaaacttctaggaatgttgaaagtattgctgaacagatggaaaatccggatttgaagaatgttggttctagtactggggagaaaaatgaaagaacttcagtggctggaacagtgagaaaatgctggcctaatagagtggcaaaggagcagattagtaggcggcttgatggtaatcagtatctgtttttgccaccaaatcgttacattttccatggcgctgaggtatattcagactctgaagatgacgtcttatcctctagttcttgtggcagtaacagtgatagtgggacatgccagagtccaagtttagaagaacccatggaggatgaaagtgaaattgaagaattctacaatggcttagaagatgagcctgatgttccagagagagctggaggagctggatttgggactgatggagatgatcaagaggcaattaatgaagctatatctgtgaaacaggaagtaacagacatgaactatccatcaaacaaatcatagtgtaataattgtgcaggtacaggaattgttccaccagcattaggaactttagcatgtcaaaatgaatgtttacttgtgaactcgatagagcaaggaaaccagaaaggtgtaatatttataggttggtaaaatagattgtttttcatggataatttttaacttcattatttctgtacttgtacaaactcaacactaacttttttttttttaaaaaaaaaaaggtactaagtatcttcaatcagctgttggtcaagactaactttcttttaaaggttcatttgtatgataaattcatatgtgtatatataattttttttgttttgtctagtgagtttcaacatttttaaagttttcaaaaagccatcggaatgttaaattaatgtaaagggaacagctaatctagaccaaagaatggtattttcacttttctttgtaacattgaatggtttgaagtactcaaaatctgttacgctaaacttttgattctttaacacaattatttttaaacactggcattttccaaaactgtggcagctaactttttaaaatctcaaatgacatgcagtgtgagtagaaggaagtcaacaatatgtggggagagcactcggttgtctttacttttaaaagtaatacttggtgctaagaatttcaggattattgtatttacgttcaaatgaagatggcttttgtacttcctgtggacatgtagcaatgtctatattggctcataaaactaacctgaaaaacaaataaatgctttggaaatgtttcagttgctttagaaacattagtgcctgcctggatccccttagttttgaaatatttgccattgttgtttaaatacctatcactgtggtagagcttgcattgatcttttccacaagtattaaactgccaaaatgtgaatatgcaaagcctttctgaatctataataatggtacttctactggggagagtgtaatattttggactgctgttttccattaatgaggagagcaacaggcccctgattatacagttccaaagtaataagatgttaattgtaattcagccagaaagtacatgtctcccattgggaggatttggtgttaaataccaaactgctagccctagtattatggagatgaacatgatgatgtaacttgtaatagcagaatagttaatgaatgaaactagttcttataatttatctttatttaaaagcttagcctgccttaaaactagagatcaactttctcagctgcaaaagcttctagtctttcaagaagttcatactttatgaaattgcacagtaagcatttatttttcagaccatttttgaacatcactcctaaattaataaagtattcctctgttgctttagtatttattacaataaaaagggtttgaaatatagctgttctttatgcataaaacacccagctaggaccattactgccagagaaaaaaatcgtattgaatggccatttccctacttataagatgtctcaatctgaatttatttggctacactaaagaatgcagtatatttagttttccatttgcatgatgtttgtgtgctatagatgatattttaaattgaaaagtttgttttaaattatttttacagtgaagactgttttcagctctttttatattgtacatagtcttttatgtaatttactggcatatgttttgtagactgtttaatgactggatatcttccttcaacttttgaaatacaaaaccagtgttttttacttgtacactgttttaaagtctattaaaattgtcatttgacttttttctgttaactta

SEQ ID NO: 181845 - DNA, 3333 bp, Homo sapiens
  Payload ID: 15809
  Gene Symbol: SIRT1
  Gene Name: sirtuin 1
  ENST ID: ENST00000403579
  CDS Start-End: 206-1540
cacttactaaatggaatttaataaaaacactgtcaaaagttgggaggaccaaaattgatactttttctctgatctttttgccatgtgtatatctgaattctttgtttttaaagaagaaacagcattgaagcattatttggggggaaaaacacacacacaaaatccagcaactcagcattcatgagcaactctatactataccagtatgtgcctgtgcagtggaaggaaaacaattttggaaatatatcctggacaattccagccatctctctgtcacaaattcatagccttgtcagataaggaaggaaaactacttcgcaactatacccagaacatagacacgctggaacaggttgcgggaatccaaaggataattcagtgtcatggttcctttgcaacagcatcttgcctgatttgtaaatacaaagttgactgtgaagctgtacgaggagatatttttaatcaggtagttcctcgatgtcctaggtgcccagctgatgaaccgcttgctatcatgaaaccagagattgtgttttttggtgaaaatttaccagaacagtttcatagagccatgaagtatgacaaagatgaagttgacctcctcattgttattgggtcttccctcaaagtaagaccagtagcactaattccaagttccataccccatgaagtgcctcagatattaattaatagagaacctttgcctcatctgcattttgatgtagagcttcttggagactgtgatgtcataattaatgaattgtgtcataggttaggtggtgaatatgccaaactttgctgtaaccctgtaaagctttcagaaattactgaaaaacctccacgaacacaaaaagaattggcttatttgtcagagttgccacccacacctcttcatgtttcagaagactcaagttcaccagaaagaacttcaccaccagattcttcagtgattgtcacacttttagaccaagcagctaagagtaatgatgatttagatgtgtctgaatcaaaaggttgtatggaagaaaaaccacaggaagtacaaacttctaggaatgttgaaagtattgctgaacagatggaaaatccggatttgaagaatgttggttctagtactggggagaaaaatgaaagaacttcagtggctggaacagtgagaaaatgctggcctaatagagtggcaaaggagcagattagtaggcggcttgatggtaatcagtatctgtttttgccaccaaatcgttacattttccatggcgctgaggtatattcagactctgaagatgacgtcttatcctctagttcttgtggcagtaacagtgatagtgggacatgccagagtccaagtttagaagaacccatggaggatgaaagtgaaattgaagaattctacaatggcttagaagatgagcctgatgttccagagagagctggaggagctggatttgggactgatggagatgatcaagaggcaattaatgaagctatatctgtgaaacaggaagtaacagacatgaactatccatcaaacaaatcatagtgtaataattgtgcaggtacaggaattgttccaccagcattaggaactttagcatgtcaaaatgaatgtttacttgtgaactcgatagagcaaggaaaccagaaaggtgtaatatttataggttggtaaaatagattgtttttcatggataatttttaacttcattatttctgtacttgtacaaactcaacactaacttttttttttttaaaaaaaaaaaggtactaagtatcttcaatcagctgttggtcaagactaactttcttttaaaggttcatttgtatgataaattcatatgtgtatatataattttttttgttttgtctagtgagtttcaacatttttaaagttttcaaaaagccatcggaatgttaaattaatgtaaagggaacagctaatctagaccaaagaatggtattttcacttttctttgtaacattgaatggtttgaagtactcaaaatctgttacgctaaacttttgattctttaacacaattatttttaaacactggcattttccaaaactgtggcagctaactttttaaaatctcaaatgacatgcagtgtgagtagaaggaagtcaacaatatgtggggagagcactcggttgtctttacttttaaaagtaatacttggtgctaagaatttcaggattattgtatttacgttcaaatgaagatggcttttgtacttcctgtggacatgtagcaatgtctatattggctcataaaactaacctgaaaaacaaataaatgctttggaaatgtttcagttgctttagaaacattagtgcctgcctggatccccttagttttgaaatatttgccattgttgtttaaatacctatcactgtggtagagcttgcattgatcttttccacaagtattaaactgccaaaatgtgaatatgcaaagcctttctgaatctataataatggtacttctactggggagagtgtaatattttggactgctgttttccattaatgaggagagcaacaggcccctgattatacagttccaaagtaataagatgttaattgtaattcagccagaaagtacatgtctcccattgggaggatttggtgttaaataccaaactgctagccctagtattatggagatgaacatgatgatgtaacttgtaatagcagaatagttaatgaatgaaactagttcttataatttatctttatttaaaagcttagcctgccttaaaactagagatcaactttctcagctgcaaaagcttctagtctttcaagaagttcatactttatgaaattgcacagtaagcatttatttttcagaccatttttgaacatcactcctaaattaataaagtattcctctgttgctttagtatttattacaataaaaagggtttgaaatatagctgttctttatgcataaaacacccagctaggaccattactgccagagaaaaaaatcgtattgaatggccatttccctacttataagatgtctcaatctgaatttatttggctacactaaagaatgcagtatatttagttttccatttgcatgatgtttgtgtgctatagatgatattttaaattgaaaagtttgttttaaattatttttacagtgaagactgttttcagctctttttatattgtacatagtcttttatgtaatttactggcatatgttttgtagactgtttaatgactggatatcttccttcaacttttgaaatacaaaaccagtgttttttacttgtacactgttttaaagtctattaaaattgtcatttgacttttttctgttaa

SEQ ID NO: 181846 - DNA, 3295 bp, Homo sapiens
  Payload ID: 15809
  Gene Symbol: SIRT1
  Gene Name: sirtuin 1
  ENST ID: ENST00000406900
  CDS Start-End: 164-1498
cagatcctcaagcgatgtttgatattgaatatttcagaaaagatccaagaccattcttcaagtttgcaaagaagaaacagcattgaagcattatttggggggaaaaacacacacacaaaatccagcaactcagcattcatgagcaactctatactataccagtatgtgcctgtgcagtggaaggaaaacaattttggaaatatatcctggacaattccagccatctctctgtcacaaattcatagccttgtcagataaggaaggaaaactacttcgcaactatacccagaacatagacacgctggaacaggttgcgggaatccaaaggataattcagtgtcatggttcctttgcaacagcatcttgcctgatttgtaaatacaaagttgactgtgaagctgtacgaggagatatttttaatcaggtagttcctcgatgtcctaggtgcccagctgatgaaccgcttgctatcatgaaaccagagattgtgttttttggtgaaaatttaccagaacagtttcatagagccatgaagtatgacaaagatgaagttgacctcctcattgttattgggtcttccctcaaagtaagaccagtagcactaattccaagttccataccccatgaagtgcctcagatattaattaatagagaacctttgcctcatctgcattttgatgtagagcttcttggagactgtgatgtcataattaatgaattgtgtcataggttaggtggtgaatatgccaaactttgctgtaaccctgtaaagctttcagaaattactgaaaaacctccacgaacacaaaaagaattggcttatttgtcagagttgccacccacacctcttcatgtttcagaagactcaagttcaccagaaagaacttcaccaccagattcttcagtgattgtcacacttttagaccaagcagctaagagtaatgatgatttagatgtgtctgaatcaaaaggttgtatggaagaaaaaccacaggaagtacaaacttctaggaatgttgaaagtattgctgaacagatggaaaatccggatttgaagaatgttggttctagtactggggagaaaaatgaaagaacttcagtggctggaacagtgagaaaatgctggcctaatagagtggcaaaggagcagattagtaggcggcttgatggtaatcagtatctgtttttgccaccaaatcgttacattttccatggcgctgaggtatattcagactctgaagatgacgtcttatcctctagttcttgtggcagtaacagtgatagtgggacatgccagagtccaagtttagaagaacccatggaggatgaaagtgaaattgaagaattctacaatggcttagaagatgagcctgatgttccagagagagctggaggagctggatttgggactgatggagatgatcaagaggcaattaatgaagctatatctgtgaaacaggaagtaacagacatgaactatccatcaaacaaatcatagtgtaataattgtgcaggtacaggaattgttccaccagcattaggaactttagcatgtcaaaatgaatgtttacttgtgaactcgatagagcaaggaaaccagaaaggtgtaatatttataggttggtaaaatagattgtttttcatggataatttttaacttcattatttctgtacttgtacaaactcaacactaacttttttttttttaaaaaaaaaaaggtactaagtatcttcaatcagctgttggtcaagactaactttcttttaaaggttcatttgtatgataaattcatatgtgtatatataattttttttgttttgtctagtgagtttcaacatttttaaagttttcaaaaagccatcggaatgttaaattaatgtaaagggaacagctaatctagaccaaagaatggtattttcacttttctttgtaacattgaatggtttgaagtactcaaaatctgttacgctaaacttttgattctttaacacaattatttttaaacactggcattttccaaaactgtggcagctaactttttaaaatctcaaatgacatgcagtgtgagtagaaggaagtcaacaatatgtggggagagcactcggttgtctttacttttaaaagtaatacttggtgctaagaatttcaggattattgtatttacgttcaaatgaagatggcttttgtacttcctgtggacatgtagcaatgtctatattggctcataaaactaacctgaaaaacaaataaatgctttggaaatgtttcagttgctttagaaacattagtgcctgcctggatccccttagttttgaaatatttgccattgttgtttaaatacctatcactgtggtagagcttgcattgatcttttccacaagtattaaactgccaaaatgtgaatatgcaaagcctttctgaatctataataatggtacttctactggggagagtgtaatattttggactgctgttttccattaatgaggagagcaacaggcccctgattatacagttccaaagtaataagatgttaattgtaattcagccagaaagtacatgtctcccattgggaggatttggtgttaaataccaaactgctagccctagtattatggagatgaacatgatgatgtaacttgtaatagcagaatagttaatgaatgaaactagttcttataatttatctttatttaaaagcttagcctgccttaaaactagagatcaactttctcagctgcaaaagcttctagtctttcaagaagttcatactttatgaaattgcacagtaagcatttatttttcagaccatttttgaacatcactcctaaattaataaagtattcctctgttgctttagtatttattacaataaaaagggtttgaaatatagctgttctttatgcataaaacacccagctaggaccattactgccagagaaaaaaatcgtattgaatggccatttccctacttataagatgtctcaatctgaatttatttggctacactaaagaatgcagtatatttagttttccatttgcatgatgtttgtgtgctatagatgatattttaaattgaaaagtttgttttaaattatttttacagtgaagactgttttcagctctttttatattgtacatagtcttttatgtaatttactggcatatgttttgtagactgtttaatgactggatatcttccttcaacttttgaaatacaaaaccagtgttttttacttgtacactgttttaaagtctattaaaattgtcatttgacttttttctgttaactta

SEQ ID NO: 181847 - DNA, 3587 bp, Homo sapiens
  Payload ID: 15809
  Gene Symbol: SIRT1
  Gene Name: sirtuin 1
  ENST ID: ENST00000432464
  CDS Start-End: 433-1791
gcatctcctcctccctctccccgggctcctactggcctgaggttgagggcggctgggggctcggggcaggctccgcggcgttcccctccccaccccggccctccgttcagccgcgctcctccggggctgcggttcctactgcgcgagctgccagtggattcgctcttttcctccgtccgtggcccgcctgggcggccttgttctttccgcagcagccagataaccttctgttcggtgatgaaattatcactaatggttttcattcctgtgaaagtgatgaggaggatagagcctcacatgcaagctctagtgactggactccaaggccacggataggtgtctgtttcatgtggaatacctgacttcaggtcaagggatggtatttatgctcgccttgctgtagacttcccagatcttccagatcctcaagcgatgtttgatattgaatatttcagaaaagatccaagaccattcttcaagtttgcaaaggaaatatatcctggacaattccagccatctctctgtcacaaattcatagccttgtcagataaggaaggaaaactacttcgcaactatacccagaacatagacacgctggaacaggttgcgggaatccaaaggataattcagtgtcatggttcctttgcaacagcatcttgcctgatttgtaaatacaaagttgactgtgaagctgtacgaggagatatttttaatcaggtagttcctcgatgtcctaggtgcccagctgatgaaccgcttgctatcatgaaaccagagattgtgttttttggtgaaaatttaccagaacagtttcatagagccatgaagtatgacaaagatgaagttgacctcctcattgttattgggtcttccctcaaagtaagaccagtagcactaattccaagttccataccccatgaagtgcctcagatattaattaatagagaacctttgcctcatctgcattttgatgtagagcttcttggagactgtgatgtcataattaatgaattgtgtcataggttaggtggtgaatatgccaaactttgctgtaaccctgtaaagctttcagaaattactgaaaaacctccacgaacacaaaaagaattggcttatttgtcagagttgccacccacacctcttcatgtttcagaagactcaagttcaccagaaagaacttcaccaccagattcttcagtgattgtcacacttttagaccaagcagctaagagtaatgatgatttagatgtgtctgaatcaaaaggttgtatggaagaaaaaccacaggaagtacaaacttctaggaatgttgaaagtattgctgaacagatggaaaatccggatttgaagaatgttggttctagtactggggagaaaaatgaaagaacttcagtggctggaacagtgagaaaatgctggcctaatagagtggcaaaggagcagattagtaggcggcttgatggtaatcagtatctgtttttgccaccaaatcgttacattttccatggcgctgaggtatattcagactctgaagatgacgtcttatcctctagttcttgtggcagtaacagtgatagtgggacatgccagagtccaagtttagaagaacccatggaggatgaaagtgaaattgaagaattctacaatggcttagaagatgagcctgatgttccagagagagctggaggagctggatttgggactgatggagatgatcaagaggcaattaatgaagctatatctgtgaaacaggaagtaacagacatgaactatccatcaaacaaatcatagtgtaataattgtgcaggtacaggaattgttccaccagcattaggaactttagcatgtcaaaatgaatgtttacttgtgaactcgatagagcaaggaaaccagaaaggtgtaatatttataggttggtaaaatagattgtttttcatggataatttttaacttcattatttctgtacttgtacaaactcaacactaacttttttttttttaaaaaaaaaaaggtactaagtatcttcaatcagctgttggtcaagactaactttcttttaaaggttcatttgtatgataaattcatatgtgtatatataattttttttgttttgtctagtgagtttcaacatttttaaagttttcaaaaagccatcggaatgttaaattaatgtaaagggaacagctaatctagaccaaagaatggtattttcacttttctttgtaacattgaatggtttgaagtactcaaaatctgttacgctaaacttttgattctttaacacaattatttttaaacactggcattttccaaaactgtggcagctaactttttaaaatctcaaatgacatgcagtgtgagtagaaggaagtcaacaatatgtggggagagcactcggttgtctttacttttaaaagtaatacttggtgctaagaatttcaggattattgtatttacgttcaaatgaagatggcttttgtacttcctgtggacatgtagcaatgtctatattggctcataaaactaacctgaaaaacaaataaatgctttggaaatgtttcagttgctttagaaacattagtgcctgcctggatccccttagttttgaaatatttgccattgttgtttaaatacctatcactgtggtagagcttgcattgatcttttccacaagtattaaactgccaaaatgtgaatatgcaaagcctttctgaatctataataatggtacttctactggggagagtgtaatattttggactgctgttttccattaatgaggagagcaacaggcccctgattatacagttccaaagtaataagatgttaattgtaattcagccagaaagtacatgtctcccattgggaggatttggtgttaaataccaaactgctagccctagtattatggagatgaacatgatgatgtaacttgtaatagcagaatagttaatgaatgaaactagttcttataatttatctttatttaaaagcttagcctgccttaaaactagagatcaactttctcagctgcaaaagcttctagtctttcaagaagttcatactttatgaaattgcacagtaagcatttatttttcagaccatttttgaacatcactcctaaattaataaagtattcctctgttgctttagtatttattacaataaaaagggtttgaaatatagctgttctttatgcataaaacacccagctaggaccattactgccagagaaaaaaatcgtattgaatggccatttccctacttataagatgtctcaatctgaatttatttggctacactaaagaatgcagtatatttagttttccatttgcatgatgtttgtgtgctatagatgatattttaaattgaaaagtttgttttaaattatttttacagtgaagactgttttcagctctttttatattgtacatagtcttttatgtaatttactggcatatgttttgtagactgtttaatgactggatatcttccttcaacttttgaaatacaaaaccagtgttttttacttgtacactgttttaaagtctattaaaattgtcatttgacttttttctgttaactt

SEQ ID NO: 181848 - DNA, 2070 bp, Homo sapiens
  Payload ID: 15810
  Gene Symbol: SIRT2
  Gene Name: sirtuin 2
  Uniprot ID: Q8IXJ6
  ENST ID: ENST00000249396
  CDS Start-End: 303-1472
cattttccgggcgccctttaccaacatggctgctgacgccacgccttctgggactcgtagtccggtcctcgcgcgctttcttacctaactggggcgctctgggtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagacccctctcaccctctggagacccaggcagggaaggtgcaggaggctcaggactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgcctggcccttgctgagctccttggatggaagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaatcc

SEQ ID NO: 181849 - DNA, 1912 bp, Homo sapiens
  Payload ID: 15810
  Gene Symbol: SIRT2
  Gene Name: sirtuin 2
  ENST ID: ENST00000358931
  CDS Start-End: 406-1110
agagtattcgggaggactacaactctctagccgttcccacattttccgggcgccctttaccaacatggctgctgacgccacgccttctgggactcgtagtccggtcctcgcgcgctttcttacctaactggggcgctctgggtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcagggacgtggcctggctgggtgaatgcgaccagggctgcctggcccttgctgagctccttggatggaagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaatccgg

SEQ ID NO: 181850 - DNA, 2062 bp, Homo sapiens
  Payload ID: 15810
  Gene Symbol: SIRT2
  Gene Name: sirtuin 2
  Uniprot ID: Q8IXJ6
  ENST ID: ENST00000392081
  CDS Start-End: 406-1464
agagtattcgggaggactacaactctctagccgttcccacattttccgggcgccctttaccaacatggctgctgacgccacgccttctgggactcgtagtccggtcctcgcgcgctttcttacctaactggggcgctctgggtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgcctggcccttgctgagctccttggatggaagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaatcc

SEQ ID NO: 181851 - DNA, 890 bp, Homo sapiens
  Payload ID: 15810
  Gene Symbol: SIRT2
  Gene Name: sirtuin 2
  ENST ID: ENST00000407552
  CDS Start-End: 383-890
acgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgtaggaggaggaggatcgcttgagcccaggaatttgaggctgcagtgagctatgatcgcactattgcactccaacctgggtgacatgagcgagaccctttctctaaaaagtaaaaaagaaagaaagactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaa

SEQ ID NO: 181852 - DNA, 555 bp, Homo sapiens
  Payload ID: 15810
  Gene Symbol: SIRT2
  Gene Name: sirtuin 2
  ENST ID: ENST00000437828
  CDS Start-End: 320-555
atttctggtgccgtcacgggacagagcagtcggtgacaggacagagcagtcggtgacgggacacagtggttggtgacgggacagagcggtcggtgacagcctcaagggcttcagcaccgcgcccatggcagagccagacctctctccaccaccccgcacttcctcaggccaccttcctgccacagccttttccccaaacctggtatcaccccctctcctccctccctaatcccacctctcgggcctggccactccaccccaccccttccaggactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccaga

SEQ ID NO: 181853 - DNA, 927 bp, Homo sapiens
  Payload ID: 15810
  Gene Symbol: SIRT2
  Gene Name: sirtuin 2
  ENST ID: ENST00000420440
  CDS Start-End: 222-557
gttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagtttcctcatctgtgatctggggatagcagtggtctctccccgacgcggctgctgtgacggttccctggggccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtca

SEQ ID NO: 181854 - DNA, 848 bp, Homo sapiens
  Payload ID: 15810
  Gene Symbol: SIRT2
  Gene Name: sirtuin 2
  ENST ID: ENST00000381766
  CDS Start-End: 459-848
aaacaaacaaaaaatgagcctggcatggtggcacgtgcctgtggtcccagctacttgggaggctgaggtgggaggatcccttgagcttgggaggttgaggctgcagcaagctgtgactgcaccagtgcactccagcctgggcaacagagcgagacactgtctcaaaaaagaaaagcaaagcaaagccactcacatgaggtcttgctcctggggacgggcatggccaggactccaaccccggcagcctgtcccagagccctggagctagccccagtgcagtctctccaccaccccgcacttcctcaggccaccttcctgccacagccttttccccaaacctggtatcaccccctctcctccctccctaatcccacctctcgggcctggccactccaccccaccccttccaggactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcag

SEQ ID NO: 181855 - DNA, 1251 bp, Homo sapiens
  Payload ID: 15810
  Gene Symbol: SIRT2
  Gene Name: sirtuin 2
  ENST ID: ENST00000414941
  CDS Start-End: 539-1251
cattttccgggcgccctttaccaacatggctgctgacgccacgccttctgggactcgtagtccggtcctcgcgcgctttcttacctaactggggcgctctgggtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgtaggaggaggaggatcgcttgagcccaggaatttgaggctgcagtgagctatgatcgcactattgcactccaacctgggtgacatgagcgagaccctttctctaaaaagtaaaaaagaaagaaacctctcaccctctggagacccaggcagggaaggtgcaggaggctcaggactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaa

SEQ ID NO: 181856 - DNA, 556 bp, Homo sapiens
  Payload ID: 15810
  Gene Symbol: SIRT2
  Gene Name: sirtuin 2
  ENST ID: ENST00000451193
  CDS Start-End: 146-265
gagcagtcggtgacgggacacagtggttggtgacgggacagagcggtcggtgacagcctcaagggcttcagcaccgcgcccatggcagagccagaccgactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgctagagtgcaatggcatgatctcggctcactgcaacctccgcctcccgggttcaagtgattctcctgcctcagcctcccaagtagctgagattacaggtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggc

SEQ ID NO: 181857 - DNA, 578 bp, Homo sapiens
  Payload ID: 15810
  Gene Symbol: SIRT2
  Gene Name: sirtuin 2
  ENST ID: ENST00000447739
  CDS Start-End: 359-578
aaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgccaccttcctgccacagccttttccccaaacctggtatcaccccctctcctccctccctaatcccacctctcgggcctggccactccaccccaccccttccaggactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtacc

SEQ ID NO: 181858 - DNA, 556 bp, Homo sapiens
  Payload ID: 15810
  Gene Symbol: SIRT2
  Gene Name: sirtuin 2
  ENST ID: ENST00000423526
  CDS Start-End: 125-283
agtggttggtgacgggacagagcggtcggtgacagcctcaagggcttcagcaccgcgcccatggcagagccagaccgactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctctgccactgtctccctcctcaggcagccaggcctgctgccctgagcctccctctcctgcggcaggcgagcagctgtctgcagccatcttttagcctgggcaggccccaaagacaacacaggcagtggctacaaagcatttgttccttgtgtcctcctgcacctggattctggggtcgcagagtcatctgtttggtgggagctggaatctccacatccgcaggcatccccgactttcgctctccatccaccggcctctatgacaacctagagaagtaccatcttccctacccagaggccatctttgagatcagctatt

SEQ ID NO: 181859 - DNA, 985 bp, Homo sapiens
  Payload ID: 15810
  Gene Symbol: SIRT2
  Gene Name: sirtuin 2
  ENST ID: ENST00000443898
  CDS Start-End: 191-481
aaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagacccctctcaccctctggagacccaggcagggaaggtgcaggaggctcaggccaccttcctgccacagccttttccccaaacctggtatcaccccctctcctccctccctaatcccacctctcgggcctggccactccaccccaccccttccaggactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctg

SEQ ID NO: 181860 - DNA, 1170 bp, Homo sapiens
  Payload ID: 15810
  Gene Symbol: SIRT2
  Gene Name: sirtuin 2
  ENST ID: ENST00000613542
  CDS Start-End: 1-1170
atgagtgacgaggcagaggactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgcctggcccttgctgagctccttggatggaagaaggagctggaggaccttgtccggagggagcacgccagcatagatgcccaggggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctga

SEQ ID NO: 181861 - DNA, 2062 bp, Homo sapiens; identical to SEQ ID NO: 181850
  Payload ID: 15810
  Gene Symbol: SIRT2
  Gene Name: Sirtuin 2
  ENST ID: ENST00000635478
  CDS Start-End: 406-1464

SEQ ID NO: 181862 - DNA, 1912 bp, Homo sapiens; identical to SEQ ID NO: 181849
  Payload ID: 15810
  Gene Symbol: SIRT2
  Gene Name: Sirtuin 2
  ENST ID: ENST00000634707
  CDS Start-End: 406-1110

SEQ ID NO: 181863 - DNA, 1170 bp, Homo sapiens; identical to SEQ ID NO: 181860
  Payload ID: 15810
  Gene Symbol: SIRT2
  Gene Name: Sirtuin 2
  ENST ID: ENST00000634328
  CDS Start-End: 1-1170

SEQ ID NO: 181864 - DNA, 927 bp, Homo sapiens; identical to SEQ ID NO: 181853
  Payload ID: 15810
  Gene Symbol: SIRT2
  Gene Name: Sirtuin 2
  ENST ID: ENST00000635486
  CDS Start-End: 222-557

SEQ ID NO: 181865 - DNA, 848 bp, Homo sapiens; identical to SEQ ID NO: 181854
  Payload ID: 15810
  Gene Symbol: SIRT2
  Gene Name: Sirtuin 2
  ENST ID: ENST00000634932
  CDS Start-End: 459-848

SEQ ID NO: 181866 - DNA, 578 bp, Homo sapiens; identical to SEQ ID NO: 181857
  Payload ID: 15810
  Gene Symbol: SIRT2
  Gene Name: Sirtuin 2
  ENST ID: ENST00000635192
  CDS Start-End: 359-578

SEQ ID NO: 181867 - DNA, 556 bp, Homo sapiens; identical to SEQ ID NO: 181858
  Payload ID: 15810
  Gene Symbol: SIRT2
  Gene Name: Sirtuin 2
  ENST ID: ENST00000634761
  CDS Start-End: 125-283

SEQ ID NO: 181868 - DNA, 556 bp, Homo sapiens; identical to SEQ ID NO: 181856
  Payload ID: 15810
  Gene Symbol: SIRT2
  Gene Name: Sirtuin 2
  ENST ID: ENST00000635627
  CDS Start-End: 146-265

SEQ ID NO: 181869 - DNA, 555 bp, Homo sapiens; identical to SEQ ID NO: 181852
  Payload ID: 15810
  Gene Symbol: SIRT2
  Gene Name: Sirtuin 2
  ENST ID: ENST00000635338
  CDS Start-End: 320-555

SEQ ID NO: 181870 - DNA, 1251 bp, Homo sapiens; identical to SEQ ID NO: 181855
  Payload ID: 15810
  Gene Symbol: SIRT2
  Gene Name: Sirtuin 2
  ENST ID: ENST00000635078
  CDS Start-End: 539-1251

SEQ ID NO: 181871 - DNA, 890 bp, Homo sapiens; identical to SEQ ID NO: 181851
  Payload ID: 15810
  Gene Symbol: SIRT2
  Gene Name: Sirtuin 2
  ENST ID: ENST00000634637
  CDS Start-End: 383-890

SEQ ID NO: 181872 - DNA, 985 bp, Homo sapiens; identical to SEQ ID NO: 181859
  Payload ID: 15810
  Gene Symbol: SIRT2
  Gene Name: Sirtuin 2
  ENST ID: ENST00000635694
  CDS Start-End: 191-481

SEQ ID NO: 181873 - DNA, 2070 bp, Homo sapiens; identical to SEQ ID NO: 181848
  Payload ID: 15810
  Gene Symbol: SIRT2
  Gene Name: Sirtuin 2
  ENST ID: ENST00000634533
  CDS Start-End: 303-1472

SEQ ID NO: 181874 - DNA, 2543 bp, Homo sapiens
  Payload ID: 15811
  Gene Symbol: SIRT3
  Gene Name: sirtuin 3
  Uniprot ID: Q9NTG7
  ENST ID: ENST00000382743
  CDS Start-End: 104-1303
cggaggcggggctggggcgccgggggcgggggtgggaggcggaggcggggccggggcgccgggggcggggcgagtccggaggactccttggactgcgcggaacatggcgttctggggttggcgcgccgcggcagccctccggctgtggggccgggtagttgaacgggtcgaggccgggggaggcgtggggccgtttcaggcctgcggctgtcggctggtgcttggcggcagggacgatgtgagtgcggggctgagaggcagccatggggcccgcggtgagcccttggacccggcgcgccccttgcagaggcctcccagacccgaggtgcccagggcattccggaggcagccgagggcagcagctcccagtttcttcttttcgagtattaaaggtggaagaaggtccatatctttttctgtgggtgcttcaagtgttgttggaagtggaggcagcagtgacaaggggaagctttccctgcaggatgtagctgagctgattcgggccagagcctgccagagggtggtggtcatggtgggggccggcatcagcacacccagtggcattccagacttcagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagagtgtcgggcatccctgcctcaaagctggttgaagctcatggaacctttgcctctgccacctgcacagtctgccaaagacccttcccaggggaggacattcgggctgacgtgatggcagacagggttccccgctgcccggtctgcaccggcgttgtgaagcccgacattgtgttctttggggagccgctgccccagaggttcttgctgcatgtggttgatttccccatggcagatctgctgctcatccttgggacctccctggaggtggagccttttgccagcttgaccgaggccgtgcggagctcagttccccgactgctcatcaaccgggacttggtggggcccttggcttggcatcctcgcagcagggacgtggcccagctgggggacgtggttcacggcgtggaaagcctagtggagcttctgggctggacagaagagatgcgggaccttgtgcagcgggaaactgggaagcttgatggaccagacaaataggatgatggctgcccccacacaataaatggtaacataggagacatccacatcccaattctgacaagacctcatgcctgaagacagcttgggcaggtgaaaccagaatatgtgaactgagtggacacccgaggctgccactggaatgtcttctcaggccatgagctgcagtgactggtagggctgtgtttacagtcagggccaccccgtcacatatacaaaggagctgcctgcctgtttgctgtgttgaactcttcactctgctgaagctcctaatggaaaaagctttcttctgactgtgaccctcttgaactgaatcagaccaactggaatcccagaccgagtctgctttctgtgcctagttgaacggcaagctcggcatctgttggttacaagatccagacttgggccgagcggtccccagccctcttcatgttccgaagtgtagtcttgaggccctggtgccgcacttctagcatgttggtctcctttagtggggctatttttaatgagagaaaatctgttctttccagcatgaaatacatttagtctcctcaaagggactgcaggtgttgacatgagttggaaagggaaccctgggatacgtggcgtcccctctattggaacagtctgaggactgaaggcatttgtccctggatttattggagacggcccagctcctccctctgaaggtggtcacattctgttgactctccatactcagcctctcctccagaaacagatctgttccagaacattccagcactttctatctggcctccttgtccccacactacgcccccccaccctcgccagggcttcctctagtgacactgttagagctaatctctgagacagggaaggcattactcacttaaaacccaggctgagtcctggccacctgctggattgtgacataggaggtggaatccactgaactgctacttctgcacaggctccttctcctggggctgtacccaggcccagccctgatggctcaccctgtcaggcaccagctgctccctcctgggctctcacccacctgcacatcctccttcctagcatcacattacctgcgtgtttccccagacaaaagcacttcccattcttgaaccttgcctaccctgggctgagctgacggcaatagatttaatgacagtgactcccaggaagggggtcctgtgactttgcgccttaataagaacaaaaggtggaattggtgacctaggaaaactgttgaatt

SEQ ID NO: 181875 - DNA, 763 bp, Homo sapiens
  Payload ID: 15811
  Gene Symbol: SIRT3
  Gene Name: sirtuin 3
  ENST ID: ENST00000528469
  CDS Start-End: 484-763
ggcgtttgcagcccacttcccgcgcacttggctgtgccattgaggcgtcaaagagtgtgggcgcctgtggtcgaacccgctacggactagctttgtggtgtcagcctttgtgacccggaattgctcctgtcaaatgaggatcttcccagtagtgttttgcgaggattaggtgtaaatataatgcctgaccatagtaaaagcgctcagaaagtattaactatcaccgccatccgggttgaaaaagttcgtgtttagtaggagcacagtagctgtttggggaacgaccttaagtgaatagatgtctgaaatgctgtgtgaagtggggcgcttaataggtgtattaaaggtggaagaaggtccatatctttttctgtgggtgcttcaagtgttgttggaagtggaggcagcagtgacaaggggaagctttccctgcaggatgtagctgagctgattcgggccagagcctgccagagggtggtggtcatggtgggggccggcatcagcacacccagtggcattccagacttcagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagag

SEQ ID NO: 181876 - DNA, 1395 bp, Homo sapiens
  Payload ID: 15811
  Gene Symbol: SIRT3
  Gene Name: sirtuin 3
  ENST ID: ENST00000524564
  CDS Start-End: 27-1088
ggaggactccttggactgcgcggaacatggcgttctggggttggcgcgccgcggcagccctccggctgtggggccgggtagttgaacgggtcgaggccgggggaggcgtggggccgtttcaggcctgcggctgtcggctggtgcttggcggcagggacgatgtgagtgcggggctgagaggcagccatggggcccgcggtgagcccttggacccggcgcgccccttgcagaggcctcccagacccgaggtgcccagggcattccggaggcagccgagggcagcagctcccagtttcttcttttcgagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagagtgtcgggcatccctgcctcaaagctggttgaagctcatggaacctttgcctctgccacctgcacagtctgccaaagacccttcccaggggaggacattcgggctgacgtgatggcagacagggttccccgctgcccggtctgcaccggcgttgtgaagcccgacattgtgttctttggggagccgctgccccagaggttcttgctgcatgtggttgatttccccatggcagatctgctgctcatccttgggacctccctggaggtggagccttttgccagcttgaccgaggccgtgcggagctcagttccccgactgctcatcaaccgggacttggtggggcccttggcttggcatcctcgcagcagggacgtggcccagctgggggacgtggttcacggcgtggaaagcctagtggagcttctgggctggacagaagagatgcgggaccttgtgcagcgggaaactgggaaggtacagactgctgaggaggaccatccaaggggctgcccttctcactgctctaggcttgatggaccagacaaataggatgatggctgcccccacacaataaatggtaacataggagacatccacatcccaattctgacaagacctcatgcctgaagacagcttgggcaggtgaaaccagaatatgtgaactgagtggacacccgaggctgccactggaatgtcttctcaggccatgagctgcagtgactggtagggctgtgtttacagtcagggccaccccgtcacatatacaaaggagctgcctgcctgtttgctgtgttgaactcttcactctgctgaagctcctaatggaaaaagctttcttctgactgtgaccctcttg

SEQ ID NO: 181877 - DNA, 1235 bp, Homo sapiens
  Payload ID: 15811
  Gene Symbol: SIRT3
  Gene Name: sirtuin 3
  ENST ID: ENST00000532956
  CDS Start-End: 25-1062
aggactccttggactgcgcggaacatggcgttctggggttggcgcgccgcggcagccctccggctgtggggccgggtagttgaacgggtcgaggccgggggaggcgtggggccgtttcaggcctgcggctgtcggctggtgcttggcggcagggacgatgtgagtgcggggctgagaggcagccatggggcccgcggtgagcccttggacccggcgcgccccttgcagaggcctcccagacccgaggtgcccagggcattccggaggcagccgagggcagcagctcccagtttcttcttttcgagtattaaaggtggaagaaggtccatatctttttctgtgggtgcttcaagtgttgttggaagtggaggcagcagtgacaaggggaagctttccctgcaggatgtagctgagctgattcgggccagagcctgccagagggtggtggtcatggtgggggccggcatcagcacacccagtggcattccagacttcagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagagtgtcgggcatccctgcctcaaagctggttgaagctcatggaacctttgcctctgccacctgcacagtctgccaaagacccttcccaggggaggacattcgggtggagccttttgccagcttgaccgaggccgtgcggagctcagttccccgactgctcatcaaccgggacttggtggggcccttggcttggcatcctcgcagcagggacgtggcccagctgggggacgtggttcacggcgtggaaagcctagtggagcttctgggctggacagaagagatgcgggaccttgtgcagcgggaaactgggaagcttgatggaccagacaaataggatgatggctgcccccacacaataaatggtaacataggagacatccacatcccaattctgacaagacctcatgcctgaagacagcttgggcaggtgaaaccagaatatgtgaactgagtggacacccgaggctgccactggaatgtcttctcaggccatgagctgcagtgact

SEQ ID NO: 181878 - DNA, 365 bp, Homo sapiens
  Payload ID: 15811
  Gene Symbol: SIRT3
  Gene Name: sirtuin 3
  ENST ID: ENST00000525776
  CDS Start-End: 295-365
agaaaggtgattattttgagaggcctggggagacacacatgctcattctcgagggtggcggtggtgcagagggcagagccatgctcgttcttgctatcctgagattggttgctatctgtttcctttgctgctgtgtttttttctgtcagtattaaaggtggaagaaggtccatatctttttctgtgggtgcttcaagtgttgttggaagtggaggcagcagtgacaaggggaagctttccctgcaggatgtagctgagctgattcgggccagagcctgccagagggtggtggtcatggtgggggccggcatcagcacacccagtggcattccagacttcagatcgccggggagtggcctgtacag

SEQ ID NO: 181879 - DNA, 1588 bp, Homo sapiens
  Payload ID: 15811
  Gene Symbol: SIRT3
  Gene Name: sirtuin 3
  ENST ID: ENST00000532837
  CDS Start-End: 16-156
tggactgcgcggaacatggcgttctggggttggcgcgccgcggcagccctccggctgtggggccgggtagttgaacgggtcgaggccgggggaggcgtggggccgtttcaggcctgcggctgtcggctggtgcttggcggcagggacgattattaaaggtggaagaaggtccatatctttttctgtgggtgcttcaagtgttgttggaagtggaggcagcagtgacaaggggaagctttccctgcaggatgtagctgagctgattcgggccagagcctgccagagggtggtggtcatggtgggggccggcatcagcacacccagtggcattccagacttcagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagagtgtcgggcatccctgcctcaaagctggttgaagctcatggaacctttgcctctgccacctgcacagtctgccaaagacccttcccaggggaggacattcgggctgacgtgatggcagacagggttccccgctgcccggtctgcaccggcgttgtgaagcccgacattgtgttctttggggagccgctgccccagaggttcttgctgcatgtggttgatttccccatggcagatctgctgctcatccttgggacctccctggaggtggagccttttgccagcttgaccgaggccgtgcggagctcagttccccgactgctcatcaaccgggacttggtggggcccttggcttggcatcctcgcagcagggacgtggcccagctgggggacgtggttcacggcgtggaaagcctagtggagcttctgggctggacagaagagatgcgggaccttgtgcagcgggaaactgggaagcttgatggaccagacaaataggatgatggctgcccccacacaataaatggtaacataggagacatccacatcccaattctgacaagacctcatgcctgaagacagcttgggcaggtgaaaccagaatatgtgaactgagtggacacccgaggctgccactggaatgtcttctcaggccatgagctgcagtgactggtagggctgtgtttacagtcagggccaccccgtcacatatacaaaggagctgcctgcctgtttgctgtgttgaactcttcactctgctgaagctcctaatggaaaaagctttcttctgactgtgaccctcttgaactgaatcagaccaactggaatcccagaccgagtctgctttctgtgcctagttgaacggcaagctcggcatctgttggttacaagatccagacttgggccgagcggtccccagccctcttcatgttccgaagtgtagtcttgaggccctggtgccgcacttctagcatgttggtctcctttagtggggctatttttaatgagagaaaatct

SEQ ID NO: 181880 - DNA, 2627 bp, Homo sapiens
  Payload ID: 15811
  Gene Symbol: SIRT3
  Gene Name: sirtuin 3
  ENST ID: ENST00000529937
  CDS Start-End: 10-414
gcgcggaacatggcgttctggggttggcgcgccgcggcagccctccggctgtggggccgggtagttgaacgggtcgaggccgggggaggcgtggggccgtttcaggcctgcggctgtcggctggtgcttggcggcagggacgatgctgacgtgatggcagacagggttccccgctgcccggtctgcaccggcgttgtgaagcccgacattgtgttctttggggagccgctgccccagaggttcttgctgcatgtggttgatttccccatggcagatctgctgctcatccttgggacctccctggaggtttgtcagcaggcctgtgcagggaggaggctggagggcaggggaagggaggggtacaggagtcatctcatgggcccttccagggctggtgccactttgggaaggtgaatggattcagctggggttccaggctgagggagcagcagcctgtgcaggagacaggaaggtgggaagctgctgggctttggaggtggtataggtgtgggtggggcaccacgtgtgaggagaagggagaaggatgggggtgtgggggcgaggtggaggggcagggcctcccaggtcagatcaggaatactgatgctgcagtgggaggagtgataaatccacagggactggcccggggacgtagctgcacccttggggtcagggaggcctttggggagtggagagtggagcaagcagtgccaggaggctggtcctggagaaggtggagctgtggtcgcctgagggatggcgaggagggggactggactcgcagtctgtgatgttttggggacgtgagaaggaggcgtctggcttggtctgtaaggtcagggcacttgctggtgaggcgtgatttgggagggaggatgcccagctcggttctgtgtgtgtctgaggtgtcgggaaacatgccctggatgtgttcaagcagctgttctgcgtctgcgtctgcagctcaggaaattcctaaaagctgtgatgagagcaagaaatgagaccatgaagtcagtgtgtgcgtgactggatgtaggcaccgaggacagaagggccagaaagacctgtgctcagaggggcccagggcagccacaggggcccagagcatgtgtttgttcaggcattcattgtgtgctgggccctgctccagtgctttggacatacacggtcagatgtcagtgtaagaagttatatagtttgttaggagatgattgatgttatgagaaagataacaagtaggatagaaaggctagaagggttgggaaccagctgcagtgtcaagtcaggcaggtggagttggatctaagagtttaccgaggtgaggagggtctggcaggggacactgcacaggtgacaagcagcaaggagggtggggcgaagtcagcattgatggccacggggctggagcagagaagaaggtggggcacaagtgtcatctcatgggaggctggcgccacctcagaaggtgaatgggttcagcttgggttccaggccagagtctgaagttgagaggactccgttgggtgctgggctgtgagcccaccatgggggcaagactgggagcagcagacccagcagggcccttgtaggtaatcaccggctggcactggctgggggccaggtaaagccagcagaggctgaggggtgctggagtctgggtgtgtgtgaacgcagagtgggtacgctggcacagtgcatgggaggccgtggattcccaaggaccccagggctgtggctggagcagctggaaagacggagccgccgcttcctgagatggagaagcctggtggagccttttgccagcttgaccgaggccgtgcggagctcagttccccgactgctcatcaaccgggacttggtggggcccttggcttggcatcctcgcagcagggacgtggcccagctgggggacgtggttcacggcgtggaaagcctagtggagcttctgggctggacagaagagatgcgggaccttgtgcagcgggaaactgggaaggtacagactgctgaggaggaccatccaaggggctgcccttctcactgctctaggcttgatggaccagacaaataggatgatggctgcccccacacaataaatggtaacataggagacatccacatcccaattctgacaagacctcatgcctgaagacagcttgggcaggtgaaaccagaatatgtgaactgagtggacacccgaggctgccactggaatgtcttctcaggccatgagctgcagtgactggtagggctgtgtttacagtcagggccaccccgtcacatatacaaaggagctgcctgcctgtttgctgtgttgaactcttcactctgctgaagctcctaatggaaaaagctttcttctgactgtgaccctcttgaactgaatcagaccaactggaatcccagaccgagtctgctttctgtgcctagttgaacggcaagctcggcatctgttggttacaagatccagacttgggccgagcggtccccagccctcttcatgttccgaagtgtagtcttgaggccctggtgccgcacttctagcatgttggtctcctttagtggggctatttttaatgagagaaaatctgttctttccagcatgaaatacatttagtctcctc

SEQ ID NO: 181881 - DNA, 681 bp, Homo sapiens
  Payload ID: 15811
  Gene Symbol: SIRT3
  Gene Name: sirtuin 3
  ENST ID: ENST00000530067
  CDS Start-End: 18-158
cttggactgcgcggaacatggcgttctggggttggcgcgccgcggcagccctccggctgtggggccgggtagttgaacgggtcgaggccgggggaggcgtggggccgtttcaggcctgcggctgtcggctggtgcttggcggcagggacgattattaaaggtggaagaaggtccatatctttttctgtgggtgcttcaagtgttgttggaagtggaggcagcagtgacaaggggaagctttccctgcaggatgtagctgagctgattcgggccagagcctgccagagggtggtggtcatggtgggggccggcatcagcacacccagtggcattccagacttcagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagaggtgatacgggcatgaaaaccaggcttgaggacatcacaaccccaaggggctgtgcctccttccaggagtcctgccaagcccagaagttgtgctcttggccttgc

SEQ ID NO: 181882 - DNA, 1475 bp, Homo sapiens
  Payload ID: 15811
  Gene Symbol: SIRT3
  Gene Name: sirtuin 3
  ENST ID: ENST00000525319
  CDS Start-End: 27-983
ggaggactccttggactgcgcggaacatggcgttctggggttggcgcgccgcggcagccctccggctgtggggccgggtagttgaacgggtcgaggccgggggaggcgtggggccgtttcaggcctgcggctgtcggctggtgcttggcggcagggacgatgatgtagctgagctgattcgggccagagcctgccagagggtggtggtcatggtgggggccggcatcagcacacccagtggcattccagacttcagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagagtgtcgggcatccctgcctcaaagctggttgaagctcatggaacctttgcctctgccacctgcacagtctgccaaagacccttcccaggggaggacattcgggctgacgtgatggcagacagggttccccgctgcccggtctgcaccggcgttgtgaagcccgacattgtgttctttggggagccgctgccccagaggttcttgctgcatgtggttgatttccccatggcagatctgctgctcatccttgggacctccctggaggtggagccttttgccagcttgaccgaggccgtgcggagctcagttccccgactgctcatcaaccgggacttggtggggcccttggcttggcatcctcgcagcagggacgtggcccagctgggggacgtggttcacggcgtggaaagcctagtggagcttctgggctggacagaagagatgcgggaccttgtgcagcgggaaactgggaagcttgatggaccagacaaataggatgatggctgcccccacacaataaatggtaacataggagacatccacatcccaattctgacaagacctcatgcctgaagacagcttgggcaggtgaaaccagaatatgtgaactgagtggacacccgaggctgccactggaatgtcttctcaggccatgagctgcagtgactggtagggctgtgtttacagtcagggccaccccgtcacatatacaaaggagctgcctgcctgtttgctgtgttgaactcttcactctgctgaagctcctaatggaaaaagctttcttctgactgtgaccctcttgaactgaatcagaccaactggaatcccagaccgagtctgctttctgtgcctagttgaacggcaagctcggcatctgttggttacaagatccagacttgggccgagcggtccccagccctcttcatgttccgaagtgtagtcttgaggccctggtgccgcacttctagcatgttggtctcctttagt

SEQ ID NO: 181883 - DNA, 785 bp, Homo sapiens
  Payload ID: 15811
  Gene Symbol: SIRT3
  Gene Name: sirtuin 3
  ENST ID: ENST00000526854
  CDS Start-End: 3-290
acatggcgttctggggttggcgcgccgcggcagccctccggctgtggggccgggtagttgaacgggtcgaggccgggggaggcgtggggccgtttcaggcctgcggctgtcggctggtgcttggcggcagggacgatgtgagtgcggggctgagaggcagccatggggcccgcggtgagcccttggacccggcgcgccccttgcagaggcctcccagacccgaggtgcccagggcattccggaggcagccgagggcagcagctcccagtttcttcttttcgaggatgtagctgagctgattcgggccagagcctgccagagggtggtggtcatggtgggggccggcatcagcacacccagtggcattccagacttcagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagagtgtcgggcatccctgcctcaaagctggttgaagctcatggaacctttgcctctgccacctgcacagtctgccaaagacccttcccaggggaggacattcgggctgacgtgatggcagacagggttccccgctgcccggtctgcaccggcgttgtgaagcccgacattgtgttct

SEQ ID NO: 181884 - DNA, 430 bp, Homo sapiens
  Payload ID: 15811
  Gene Symbol: SIRT3
  Gene Name: sirtuin 3
  ENST ID: ENST00000525237
  CDS Start-End: 377-430
ggcgttctggggttggcgcgccgcggcagccctccggctgtggggccgggtagttgaacgggtcgaggccgggggaggcgtggggccgtttcaggcctgcggctgtcggctggtgcttggcggcagggacgatgtgagtgcggggctgagaggcagccatggggcccgcggtgagcccttggacccggcgcgccccttgcagaggcctcccagacccgaggtgcccagggcattccggaggcagccgagggcagcagctcccagtttcttcttttcgagtgttgttggaagtggaggcagcagtgacaaggggaagctttccctgcaggatgtagctgagctgattcgggccagagcctgccagagggtggtggtcatggtgggggccggcatcagcacacccagtggcattccagacttcagatcgccg

SEQ ID NO: 181885 - DNA, 779 bp, Homo sapiens
  Payload ID: 15811
  Gene Symbol: SIRT3
  Gene Name: sirtuin 3
  ENST ID: ENST00000529055
  CDS Start-End: 12-152
ctgcgcggaacatggcgttctggggttggcgcgccgcggcagccctccggctgtggggccgggtagttgaacgggtcgaggccgggggaggcgtggggccgtttcaggcctgcggctgtcggctggtgcttggcggcagggacgattattaaaggtggaagaaggtccatatctttttctgtgggtgcttcaagtgttgttggaagtggaggcagcagtgacaaggggaagctttccctgcaggatgtagctgagctgattcgggccagagcctgccagagggtggtggtcatggtgggggccggcatcagcacacccagtggcattccagacttcagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagaggagtcctgccaagcccagaagttgtgctcttggccttgcgtgctcatctcggaggcggcagcaacacttcgctttggcttgaatttcagtgtcgggcatccctgcctcaaagctggttgaagctcatggaacctttgcctctgccacctgcacagtctgccaaagacccttcccaggggaggacattcgggctgacgtgatggcagac

SEQ ID NO: 181886 - DNA, 1225 bp, Homo sapiens
  Payload ID: 15811
  Gene Symbol: SIRT3
  Gene Name: sirtuin 3
  Uniprot ID: Q9NTG7
  ENST ID: ENST00000529382
  CDS Start-End: 365-1138
acttggctgtgccattgaggcgtcaaagagtgtgggcgcctgtggtcgaacccgctacggactagctttgtggtgtcagcctttgtgacccggaattgctcctgtcaaatgaggatcttcccagtagtgttttgcgaggattaggtgtaaatataatgcctgaccatagtaaaagcgctcagaaagtattaactatcaccgccatccgggttgaaaaagtattaaaggtggaagaaggtccatatctttttctgtgggtgcttcaagtgttgttggaagtggaggcagcagtgacaaggggaagctttccctgcaggatgtagctgagctgattcgggccagagcctgccagagggtggtggtcatggtgggggccggcatcagcacacccagtggcattccagacttcagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagagtgtcgggcatccctgcctcaaagctggttgaagctcatggaacctttgcctctgccacctgcacagtctgccaaagacccttcccaggggaggacattcgggctgacgtgatggcagacagggttccccgctgcccggtctgcaccggcgttgtgaagcccgacattgtgttctttggggagccgctgccccagaggttcttgctgcatgtggttgatttccccatggcagatctgctgctcatccttgggacctccctggaggtggagccttttgccagcttgaccgaggccgtgcggagctcagttccccgactgctcatcaaccgggacttggtggggcccttggcttggcatcctcgcagcagggacgtggcccagctgggggacgtggttcacggcgtggaaagcctagtggagcttctgggctggacagaagagatgcgggaccttgtgcagcgggaaactgggaagcttgatggaccagacaaataggatgatggctgcccccacacaataaatggtaacataggagacatccacatcccaattctgacaagacctcatgcctgaagacagctt

SEQ ID NO: 181887 - DNA, 1217 bp, Homo sapiens
  Payload ID: 15812
  Gene Symbol: SIRT4
  Gene Name: sirtuin 4
  Uniprot ID: Q9Y6E7
  ENST ID: ENST00000202967
  CDS Start-End: 60-1004
gcaaatgcaatcagacggtcccactgtggggtgtgaagtgtccgtagagctgtgagagaatgaagatgagctttgcgttgactttcaggtcagcaaaaggccgttggatcgcaaaccccagccagccgtgctcgaaagcctccattgggttatttgtgccagcaagtcctcctctggaccctgagaaggtcaaagagttacagcgcttcatcaccctttccaagagactccttgtgatgactggggcaggaatctccaccgaatcggggataccagactacaggtcagaaaaagtggggctttatgcccgcactgaccgcaggcccatccagcatggtgattttgtccggagtgccccaatccgccagcggtactgggcgagaaacttcgtaggctggcctcaattctcctcccaccagcctaaccctgcacactgggctttgagcacctgggagaaactcggaaagctgtactggttggtgacccaaaatgtggatgctttgcacaccaaggcggggagtcggcgcctgacagagctccacggatgcatggacagggtcctgtgcttggattgtggggaacagactccccggggggtgctgcaagagcgtttccaagtcctgaaccccacctggagtgctgaggcccatggcctggctcctgatggtgacgtctttctctcagaggagcaagtccggagctttcaggtcccaacctgcgttcaatgtggaggccatctgaaaccagatgtcgttttcttcggggacacagtgaaccctgacaaggttgattttgtgcacaagcgtgtaaaagaagccgactccctcttggtggtgggatcatccttgcaggtatactctggttacaggtttatcctcactgcctgggagaagaagctcccgattgcaatactgaacattgggcccacacggtcggatgacttggcgtgtctgaaactgaattctcgttgtggagagttgctgcctttgatagacccatgctgaccacagcctgatattccagaacctggaacagggactttcacttgaatcttgctgctaaatgtaaatgccttctcaaatgacagattccagttcccattcaacagagtagggtgcactgacaaagtatagaaggttctaggtatcttaatgtgtggatattcttaattaaaactcattttttttaaataaaaaattgttcagctttatatgaaa

SEQ ID NO: 181888 - DNA, 531 bp, Homo sapiens
  Payload ID: 15812
  Gene Symbol: SIRT4
  Gene Name: sirtuin 4
  ENST ID: ENST00000536460
  CDS Start-End: 212-531
aaaatgcaaatgcaatcagacggtcccactgtggggtgtgaagtgtccgtagagctgtgagaggtcagcaaaaggccgttggatcgcaaaccccagccagccgtgctcgaaagcctccattgggttatttgtgccagcaagtcctcctctggaccctgagaaggtcaaagagttacagcgcttcatcaccctttccaagagactccttgtgatgactggggcaggaatctccaccgaatcggggataccagactacaggtcagaaaaagtggggctttatgcccgcactgaccgcaggcccatccagcatggtgattttgtccggagtgccccaatccgccagcggtactgggcgagaaacttcgtaggctggcctcaattctcctcccaccagcctaaccctgcacactgggctttgagcacctgggagaaactcggaaagctgtactggttggtgacccaaaatgtggatgctttgcacaccaaggcggggagtcggcgcctgacagagctccacggatgcatggacag

SEQ ID NO: 181889 - DNA, 1528 bp, Homo sapiens
  Payload ID: 15813
  Gene Symbol: SIRT5
  Gene Name: sirtuin 5
  Uniprot ID: Q9NXA8
  ENST ID: ENST00000359782
  CDS Start-End: 226-1104
agactgtattcgggggcgcgagctgccccagtaaatggaaatgttttctaacatataaaaacctacagaagaagaaaataattttctggatcaaattagaagtctgtattatattgatgtctccagattcaaatatattagaaagcagccgtggagacaaccatcttcattttgggagaaataactaaagcccgcctcaagcattagaactacagacaaaccctgatgcgacctctccagattgtcccaagtcgattgatttcccagctatattgtggcctgaagcctccagcgtccacacgaaaccagatttgcctgaaaatggctcggccaagttcaagtatggcagattttcgaaagttttttgcaaaagcaaagcacatagtcatcatctcaggagctggtgttagtgcagaaagtggtgttccgaccttcagaggagctggaggttattggagaaaatggcaagcccaggacctggcgactcccctggcctttgcccacaacccgtcccgggtgtgggagttctaccactaccggcgggaggtcatggggagcaaggagcccaacgccgggcaccgcgccatagccgagtgtgagacccggctgggcaagcagggccggcgagtcgtggtcatcacccagaacatcgatgagctgcaccgcaaggctggcaccaagaaccttctggagatccatggtagcttatttaaaactcgatgtacctcttgtggagttgtggctgagaattacaagagtccaatttgtccagctttatcaggaaaagggtgtgaagaggcaggctgcgggggcttgctgcgacctcacgtcgtgtggtttggagaaaacctggatcctgccattctggaggaggttgacagagagctcgcccactgtgatttatgtctagtggtgggcacttcctctgtggtgtacccagcagccatgtttgccccccaggtggctgccaggggcgtgccagtggctgaatttaacacggagaccaccccagctacgaacagattcaggtttcatttccagggaccctgtggaacgactcttcctgaagcccttgcctgtcatgaaaatgaaactgtttcttaagtgtcctggggaagaaagaaattacagtatatctaagaactaggccacacgcagaggagaaatggtcttatgggtggtgagctgagtactgaacaatctaaaaatagcctctgattccctcgctggaatccaacctgttgataagtgatgggggtttagaagtagcaaagagcacccacattcaaaagtcacagaactggaaagttaattcatattatttggtttgaactgaaacgtgaggtatctttgatgtgtatggttggttattgggagggaaaaattttgtaaattagattgtctaaaaaaaatagttattctgattatatttttgttatctgggcaaagtagaagtcaaggggtaaaaaccctactattctgatttttgcacaagttttagtggaaaataaaatcacactctacagta

SEQ ID NO: 181890 - DNA, 1342 bp, Homo sapiens
  Payload ID: 15813
  Gene Symbol: SIRT5
  Gene Name: sirtuin 5
  ENST ID: ENST00000379250
  CDS Start-End: 236-475
ggggcgtgggagactgtattcgggggcgcgagctgccccagtaaatggaaatgttttctaacatataaaaacctacagaagaagaaaataattttctggatcaaattagaagtctgtattatattgatgtctccagattcaaatatattagaaagcagccgtggagacaaccatcttcattttgggagaaataactaaagcccgcctcaagcattagaactacagacaaaccctgatgcgacctctccagattgtcccaagtcgattgatttcccagctatattgtggcctgaagcctccagcgtccacacgaaaccagatttgcctgaaaatggctcggccaagttcaagacctggcgactcccctggcctttgcccacaacccgtcccgggtgtgggagttctaccactaccggcgggaggtcatggggagcaaggagcccaacgccgggcaccgcgccatagccgagtgtgagacccggctgggcaagcagggccggcgagtcgtggtcatcacccagaacatcgatgagctgcaccgcaaggctggcaccaagaaccttctggagatccatggtagcttatttaaaactcgatgtacctcttgtggagttgtggctgagaattacaagagtccaatttgtccagctttatcaggaaaaggtgctccagaacctggaactcaagatgccagcatcccagttgagaaacttccccggtgtgaagaggcaggctgcgggggcttgctgcgacctcacgtcgtgtggtttggagaaaacctggatcctgccattctggaggaggttgacagagagctcgcccactgtgatttatgtctagtggtgggcacttcctctgtggtgtacccagcagccatgtttgccccccaggtggctgccaggggcgtgccagtggctgaatttaacacggagaccaccccagctacgaacagattcaggtttcatttccagggaccctgtggaacgactcttcctgaagcccttgcctgtcatgaaaatgaaactgtttcttaagtgtcctggggaagaaagaaattacagtatatctaagaactaggccacacgcagaggagaaatggtcttatgggtggtgagctgagtactgaacaatctaaaaatagcctctgattccctcgctggaatccaacctgttgataagtgatgggggtttagaagtagcaaagagcacccacattcaaaagtcacagaactggaaagttaattcatattatttggtttgaactgaaacgtgaggtatctttgatgtgtatggttggttattgggagggaaaaattttgtaaattagattgtctaaaaaaaa

SEQ ID NO: 181891 - DNA, 2339 bp, Homo sapiens
  Payload ID: 15813
  Gene Symbol: SIRT5
  Gene Name: sirtuin 5
  Uniprot ID: Q9NXA8
  ENST ID: ENST00000379262
  CDS Start-End: 219-1118
attcgggggcgcgagctgccccagtaaatggaaatgttttctaacatataaaaacctacagaagaagaaaataattttctggatcaaattagaagtctgtattatattgatgtctccagattcaaatatattagaaagcagccgtggagacaaccatcttcattttgggagaaataactaaagcccgcctcaagcattagaactacagacaaaccctgatgcgacctctccagattgtcccaagtcgattgatttcccagctatattgtggcctgaagcctccagcgtccacacgaaaccagatttgcctgaaaatggctcggccaagttcaagtatggcagattttcgaaagttttttgcaaaagcaaagcacatagtcatcatctcaggagctggtgttagtgcagaaagtggtgttccgaccttcagaggagctggaggttattggagaaaatggcaagcccaggacctggcgactcccctggcctttgcccacaacccgtcccgggtgtgggagttctaccactaccggcgggaggtcatggggagcaaggagcccaacgccgggcaccgcgccatagccgagtgtgagacccggctgggcaagcagggccggcgagtcgtggtcatcacccagaacatcgatgagctgcaccgcaaggctggcaccaagaaccttctggagatccatggtagcttatttaaaactcgatgtacctcttgtggagttgtggctgagaattacaagagtccaatttgtccagctttatcaggaaaaggtgctccagaacctggaactcaagatgccagcatcccagttgagaaacttccccggtgtgaagaggcaggctgcgggggcttgctgcgacctcacgtcgtgtggtttggagaaaacctggatcctgccattctggaggaggttgacagagagctcgcccactgtgatttatgtctagtggtgggcacttcctctgtggtgtacccagcagccatgtttgccccccaggtggctgccaggggcgtgccagtggctgaatttaacacggagaccaccccagctacgaacagattcagtcatttgatctccatctcatctctaattattataaagaattaaaacaagtcatcattgtagaaaagcaagaaaatgcagatagagaaaaagaagaaaataaaactggagtatttccacaacccaagtttagagttggcccccacctcccatgccatggactgagcagcaggggcccagcatcccttggatatggtggctgtgtcttcatgtgaaagaaactgaacttggtggtttttcctgccagttcaggagagattcttggcatgtaatatatatcactgctcaagtcaagcctcctaaaaccacagacctgtttcagctgctacttcagccaaaattcttcagcttcatattgtcttgaaaacctatgattgtctctaacaaacaggctacttgctagttagaaattcttatcaatttggcaagctacttatcaaccagactgaccacaagaactgtcatctcatcaatgaaggagtaactgatcaatgaagccagcaatgcttttttcttggcatcatcaaagctgacatttagaagagatgctggtgatagtcatctcatcctactcaatttttcaaaggcagaaaccaaccctggagcaattgagaggactgtttaaacacagagcttaacaatggcagaattgtatatctcgtgcttaacagattttggttgaactttaccctaggtcaggggtcagcaaactactgcctgtgggccaaatttgcccaccacctgtatctgtaaataaggtttcattggaacacagctgtggccatatgtttgtatattgtgtgtggctgcttttgcattaggatgacagaggtgaatagttgcaacagagactggctggtctgcaaagcctaaaatatgtcctgtgtggccctttacagaaaaagttttctaacccctgctctaggttacggagaaaaaaaaaatggaataatgttctctgctacttttaacctgattttctttgttacctaaataggcagctagaatgctgcctatattttaataaggatttggatctcacaagacaccttaggccttacacaagttgttcagattctttgccccagttctaatctagtgacaaaggcatagaattctcctcccacaggaatgtatttctattttcaaggtgttaattagttccagttttggttttgtcgttttccccatgtccgatgcttatattggatgatttctgataaaccctgactattccaataaaccctaggcatttttgaatttaaa

SEQ ID NO: 181892 - DNA, 4382 bp, Homo sapiens
  Payload ID: 15813
  Gene Symbol: SIRT5
  Gene Name: sirtuin 5
  Uniprot ID: Q9NXA8
  ENST ID: ENST00000397350
  CDS Start-End: 481-1089
atgtgggggatggtgggtgggtacagagagctgggagggaggcaccccggggggcggggcgtgggagactgtattcgggggcgcgagctgccccagtaaatggaaatgttttctaacatataaaaacctacagaagaagaaaataattttctggatcaaattagaagtctgtattatattgatgtctccagattcaaatatattagaaagcagccgtggagacaaccatcttcattttgggagaaataactaaagcccgcctcaagcattagaactacagacaaaccctgatgcgacctctccagattgtcccaagtcgattgatttcccagctatattgtggcctgaagcctccagcgtccacacgaaaccagatttgcctgaaaatggctcggccaagttcaagacctggcgactcccctggcctttgcccacaacccgtcccgggtgtgggagttctaccactaccggcgggaggtcatggggagcaaggagcccaacgccgggcaccgcgccatagccgagtgtgagacccggctgggcaagcagggccggcgagtcgtggtcatcacccagaacatcgatgagctgcaccgcaaggctggcaccaagaaccttctggagatccatggtagcttatttaaaactcgatgtacctcttgtggagttgtggctgagaattacaagagtccaatttgtccagctttatcaggaaaaggtgctccagaacctggaactcaagatgccagcatcccagttgagaaacttccccggtgtgaagaggcaggctgcgggggcttgctgcgacctcacgtcgtgtggtttggagaaaacctggatcctgccattctggaggaggttgacagagagctcgcccactgtgatttatgtctagtggtgggcacttcctctgtggtgtacccagcagccatgtttgccccccaggtggctgccaggggcgtgccagtggctgaatttaacacggagaccaccccagctacgaacagattcaggtttcatttccagggaccctgtggaacgactcttcctgaagcccttgcctgtcatgaaaatgaaactgtttcttaagtgtcctggggaagaaagaaattacagtatatctaagaactaggccacacgcagaggagaaatggtcttatgggtggtgagctgagtactgaacaatctaaaaatagcctctgattccctcgctggaatccaacctgttgataagtgatgggggtttagaagtagcaaagagcacccacattcaaaagtcacagaactggaaagttaattcatattatttggtttgaactgaaacgtgaggtatctttgatgtgtatggttggttattgggagggaaaaattttgtaaattagattgtctaaaaaaaatagttattctgattatatttttgttatctgggcaaagtagaagtcaaggggtaaaaaccctactattctgatttttgcacaagttttagtggaaaataaaatcacactctacagtaggtaatttattgtataaagacattaccccacgatatggctttattagggactttttttttttttttttgagacagagtttcactcttgttgcccaggctggagtgcagtggtgcgatctcagctcacagcaacctccgcctcccgggttcaagagattctcctgcctcagcctcatgagtagctgggattacaggtatgtaccaccacacccagctaattttgtatttttagtagagacggggtttctccatgttggtcaggctggtcttaaactctcgacctcaggtgatctgcccgcctcggcctcccaaagtgctgagattacgggcatgagccaccgcacccggcttactgggggctttttaaccttgtttggctacattacctcagtgaacaaggggaagctcacaacaggaactcacacaaagaaggaagagaacagtaccaacaaggtagaacatcacgatgagaagaaagaatgatgcaaatatgtggacccccaggataaacacagctgcccaaaatttagctctggcccccttagatgggggaagtcaacagtgaagtgtttctcagcatcataaaggcagaagctgtggttcctgtggggcctgccaaccgttcccagatgctgaactctgctgggagttttttccatgggactttaaaaaatgatgcccttaggttgggccagacctctgttaacttcagtagggatggcaccaggttcaagaggccaaagaagagacctggagctagtgaaggaaacatagggtttatttggggaaccttacagggtggtccagtggccgcgggctggacagaactgcaaccacttataaaaagcatgcagtttacatagcactttcactcagcaccctcccctcagcagcctccacgtggcaaccctcacttcttaagttattgctgtcagatgcatctgccatacagggtcattctcaggggatgcttaagttatttctgtcaggtacatcttccatacactttactaccttggagtaaagtagtaagaatacagctttttccttaacctttaccagctaactcagtgcttaggggccttggaatgcctgctgtccagcaggtgtcacaggcctgactgggaggcatggccattatcaacagtgtatgaaggtcacatatggctccctgaagtgattacatacttggaccacatcacctcagccccttgcaaaattgcatttaatgttacacccttggcttttgtagaaacaggcaacaagacactatcatataaaactttgtactgcattgcaaggcataacctttaataaatcccagtggtcctttgtgtagggaacggggatgctcatagcctatggggcggctggagaaccagtcagggaccctgagggctcgatgtacactttacatgggtgggccaaggagtttacactgagggcactggtaatacctgtaatagtcttatagtacttataaagcagttttgcacataaaataccatcatgcacttataagtttgttcttgggctgctccaagttaactttattcattttcctagtgttagtgtctcagggagtctgattatatttttgatttgtaatttctatctgactaaggcctagagatttcaaaactgttctttgcaattcctctcatactgaacctctggttcagcagctttttttgttgttgttgttttcaagttttatcatttttgttcctatttggttttgtcgtttttaaattgagaattgcttctaaaacagaagacatgaaaagagaattaaaaatacaatatatgtgtaagatagaattattcaacttagcatttattaaacatctaccagatgatagacattagaaataaaatgactagcaagacctggcccttcccctcaggggttcacagaatggctggagcaactgtcatataagctgttatgaagtgcagaaactacacagacatttgtgcgggttcagaccagcgcaattagagatgggcagagtgggatggggtaggggtaaggtgcttgaaatttgcctgggtgggaatttttgaagtataaaaaggacttctacctggggggctgcggcagtagagggaagagcacggtcggtacaaatgcatggcaggtgtgaaacagtttgatttgttcaaagaatgatgaatcacttagtgttgtataatggatgggaggagagaaacacagcgatcacaaagggccatgtttgccaagaaataaaatatacttggaaaaaaagtacgtatgtgtatataccacaaaactcgggtgcattctctagggaccggcgaagccattctttcaggagatatgctcagcatttgccacgggccagctgctgttccaggtcgtgggttagggcccggcaccaggaagggcgcccctcccacagggccgacatcctaaccggcgtcgctgcggccgcggagctgggaaggccgagggcgccgggcacgtctgtgcagatttctttagagtccaggtctgtcgcccgcgtcttcgtcggtggcagcagggctgactggccacggcggccatctgctagagcgcatttcttcccatgaaacgccacctcctccgaagtgcggagcgaacgcagccaaatctacacaaagactgacaagctggatccactcgacggaacccagggccaaaaaacggcggcgagcagcgcctcgggcccgcgattaccggttttctgagcaccggacagcgtgagccgtgccagccctgtctcgccatcccagccgaggagggcagcgcgatggctcttccctgccttgaaatcaaccccattgccagccgctttcgccggcagagcattttccgtggggtcca

SEQ ID NO: 181893 - DNA, 571 bp, Homo sapiens
  Payload ID: 15813
  Gene Symbol: SIRT5
  Gene Name: sirtuin 5
  ENST ID: ENST00000606427
  CDS Start-End: 221-346
gtattcgggggcgcgagctgccccagtaaatggaaatgttttctaacatataaaaacctacagaagaagaaaataattttctggatcaaattagaagtctgtattatattgatgtctccagattcaaatatattagaaagcagccgtggagacaaccatcttcattttgggagaaataactaaagcccgcctcaagcattagaactacagacaaaccctgatgcgacctctccagattgtcccaagtcgattgatttcccagctatattgtggcctgaagcctccagcgtccacacgaaaccagatttgcctgaaaatggctcggccaagttcaacacaaggctgagagaaattaagacggtcacggtggaacagaacagaggcctcagaaataacactacacatctacaaccatctgatctttgacaaacctgacaaaaacaagcagcctatctctggaagggatgtgagttcaggtatggcagattttcgaaagttttttgcaaaagcaaagcacatagtcatcatctcaggagctggtgttagtgcagaaagtggtgttccgaccttc

SEQ ID NO: 181894 - DNA, 3922 bp, Homo sapiens
  Payload ID: 15813
  Gene Symbol: SIRT5
  Gene Name: sirtuin 5
  Uniprot ID: Q9NXA8
  ENST ID: ENST00000606117
  CDS Start-End: 297-1229
ccggagcgcggtcgggacacagcgcctctaggagaaagcctggaaggcgctccgggggtacccagagctcttagcgggccggcagcatgtgcggggcccaagtaaatggaaatgttttctaacatataaaaacctacagaagaagaaaataattttctggatcaaattagaagtctgtattatattgatgtctccagattcaaatatattagaaagcagccgtggagacaaccatcttcattttgggagaaataactaaagcccgcctcaagcattagaactacagacaaaccctgatgcgacctctccagattgtcccaagtcgattgatttcccagctatattgtggcctgaagcctccagcgtccacacgaaaccagatttgcctgaaaatggctcggccaagttcaagtatggcagattttcgaaagttttttgcaaaagcaaagcacatagtcatcatctcaggagctggtgttagtgcagaaagtggtgttccgaccttcagaggagctggaggttattggagaaaatggcaagcccaggacctggcgactcccctggcctttgcccacaacccgtcccgggtgtgggagttctaccactaccggcgggaggtcatggggagcaaggagcccaacgccgggcaccgcgccatagccgagtgtgagacccggctgggcaagcagggccggcgagtcgtggtcatcacccagaacatcgatgagctgcaccgcaaggctggcaccaagaaccttctggagatccatggtagcttatttaaaactcgatgtacctcttgtggagttgtggctgagaattacaagagtccaatttgtccagctttatcaggaaaaggtgctccagaacctggaactcaagatgccagcatcccagttgagaaacttccccggtgtgaagaggcaggctgcgggggcttgctgcgacctcacgtcgtgtggtttggagaaaacctggatcctgccattctggaggaggttgacagagagctcgcccactgtgatttatgtctagtggtgggcacttcctctgtggtgtacccagcagccatgtttgccccccaggtggctgccaggggcgtgccagtggctgaatttaacacggagaccaccccagctacgaacagattcaggtttcatttccagggaccctgtggaacgactcttcctgaagcccttgcctgtcatgaaaatgaaactgtttcttaagtgtcctggggaagaaagaaattacagtatatctaagaactaggccacacgcagaggagaaatggtcttatgggtggtgagctgagtactgaacaatctaaaaatagcctctgattccctcgctggaatccaacctgttgataagtgatgggggtttagaagtagcaaagagcacccacattcaaaagtcacagaactggaaagttaattcatattatttggtttgaactgaaacgtgaggtatctttgatgtgtatggttggttattgggagggaaaaattttgtaaattagattgtctaaaaaaaatagttattctgattatatttttgttatctgggcaaagtagaagtcaaggggtaaaaaccctactattctgatttttgcacaagttttagtggaaaataaaatcacactctacagtaggtaatttattgtataaagacattaccccacgatatggctttattagggactttttttttttttttttgagacagagtttcactcttgttgcccaggctggagtgcagtggtgcgatctcagctcacagcaacctccgcctcccgggttcaagagattctcctgcctcagcctcatgagtagctgggattacaggtatgtaccaccacacccagctaattttgtatttttagtagagacggggtttctccatgttggtcaggctggtcttaaactctcgacctcaggtgatctgcccgcctcggcctcccaaagtgctgagattacgggcatgagccaccgcacccggcttactgggggctttttaaccttgtttggctacattacctcagtgaacaaggggaagctcacaacaggaactcacacaaagaaggaagagaacagtaccaacaaggtagaacatcacgatgagaagaaagaatgatgcaaatatgtggacccccaggataaacacagctgcccaaaatttagctctggcccccttagatgggggaagtcaacagtgaagtgtttctcagcatcataaaggcagaagctgtggttcctgtggggcctgccaaccgttcccagatgctgaactctgctgggagttttttccatgggactttaaaaaatgatgcccttaggttgggccagacctctgttaacttcagtagggatggcaccaggttcaagaggccaaagaagagacctggagctagtgaaggaaacatagggtttatttggggaaccttacagggtggtccagtggccgcgggctggacagaactgcaaccacttataaaaagcatgcagtttacatagcactttcactcagcaccctcccctcagcagcctccacgtggcaaccctcacttcttaagttattgctgtcagatgcatctgccatacagggtcattctcaggggatgcttaagttatttctgtcaggtacatcttccatacactttactaccttggagtaaagtagtaagaatacagctttttccttaacctttaccagctaactcagtgcttaggggccttggaatgcctgctgtccagcaggtgtcacaggcctgactgggaggcatggccattatcaacagtgtatgaaggtcacatatggctccctgaagtgattacatacttggaccacatcacctcagccccttgcaaaattgcatttaatgttacacccttggcttttgtagaaacaggcaacaagacactatcatataaaactttgtactgcattgcaaggcataacctttaataaatcccagtggtcctttgtgtagggaacggggatgctcatagcctatggggcggctggagaaccagtcagggaccctgagggctcgatgtacactttacatgggtgggccaaggagtttacactgagggcactggtaatacctgtaatagtcttatagtacttataaagcagttttgcacataaaataccatcatgcacttataagtttgttcttgggctgctccaagttaactttattcattttcctagtgttagtgtctcagggagtctgattatatttttgatttgtaatttctatctgactaaggcctagagatttcaaaactgttctttgcaattcctctcatactgaacctctggttcagcagctttttttgttgttgttgttttcaagttttatcatttttgttcctatttggttttgtcgtttttaaattgagaattgcttctaaaacagaagacatgaaaagagaattaaaaatacaatatatgtgtaagatagaattattcaacttagcatttattaaacatctaccagatgatagacattagaaataaaatgactagcaagacctggcccttcccctcaggggttcacagaatggctggagcaactgtcatataagctgttatgaagtgcagaaactacacagacatttgtgcgggttcagaccagcgcaattagagatgggcagagtgggatggggtaggggtaaggtgcttgaaatttgcctgggtgggaatttttgaagtataaaaaggacttctacctggggggctgcggcagtagagggaagagcacggtcggtacaaatgcatggcaggtgtgaaacagtttgatttgttcaaagaatgatgaatcacttagtgttgtataatggatgggaggagagaaacacagcgatcacaaagggccatgtttgccaagaaataaaatatacttggaaaaaaa

SEQ ID NO: 181895 - DNA, 1506 bp, Homo sapiens
  Payload ID: 15814
  Gene Symbol: SIRT6
  Gene Name: sirtuin 6
  Uniprot ID: Q8N6T7
  ENST ID: ENST00000305232
  CDS Start-End: 12-998
ggcagtcgaggatgtcggtgaattacgcggcggggctgtcgccgtacgcggacaagggcaagtgcggcctcccggagatcttcgaccccccggaggagctggagcggaaggtgtgggaactggcgaggctggtctggcagtcttccagtgtggtgttccacacgggtgccggcatcagcactgcctctggcatccccgacttcaggggtccccacggagtctggaccatggaggagcgaggtctggcccccaagttcgacaccacctttgagagcgcgcggcccacgcagacccacatggcgctggtgcagctggagcgcgtgggcctcctccgcttcctggtcagccagaacgtggacgggctccatgtgcgctcaggcttccccagggacaaactggcagagctccacgggaacatgtttgtggaagaatgtgccaagtgtaagacgcagtacgtccgagacacagtcgtgggcaccatgggcctgaaggccacgggccggctctgcaccgtggctaaggcaagggggctgcgagcctgcaggaacgccgacctgtccatcacgctgggtacatcgctgcagatccggcccagcgggaacctgccgctggctaccaagcgccggggaggccgcctggtcatcgtcaacctgcagcccaccaagcacgaccgccatgctgacctccgcatccatggctacgttgacgaggtcatgacccggctcatgaagcacctggggctggagatccccgcctgggacggcccccgtgtgctggagagggcgctgccacccctgccccgcccgcccacccccaagctggagcccaaggaggaatctcccacccggatcaacggctctatccccgccggccccaagcaggagccctgcgcccagcacaacggctcagagcccgccagccccaaacgggagcggcccaccagccctgccccccacagaccccccaaaagggtgaaggccaaggcggtccccagctgaccagggtgcttggggagggtggggctttttgtagaaactgtggattctttttctctcgtggtctcactttgttacttgtttctgtccccgggagcctcagggctctgagagctgtgctccaggccaggggttacacctgccctccgtggtccctccctgggctccaggggcctctggtgcggttccgggaagaagccacaccccagaggtgacaggtgagcccctgccacaccccagcctctgacttgctgtgttgtccagaggtgaggctgggccctccctggtctccagcttaaacaggagtgaactccctctgtccccagggcctcccttctgggccccctacagcccaccctacccctcctccatgggccctgcaggaggggagacccaccttgaagtgggggatcagtagaggcttgcactgcctttggggctggagggagacgtgggtccaccaggcttctggaaaagtcctcaatgcaataaaaacaatttctttcttgca

SEQ ID NO: 181896 - DNA, 1641 bp, Homo sapiens
  Payload ID: 15814
  Gene Symbol: SIRT6
  Gene Name: sirtuin 6
  Uniprot ID: Q8N6T7
  ENST ID: ENST00000337491
  CDS Start-End: 66-1133
gccccgcttccggcggaagcggcctcaacaagggaaactttattgttcccgtggggcagtcgaggatgtcggtgaattacgcggcggggctgtcgccgtacgcggacaagggcaagtgcggcctcccggagatcttcgaccccccggaggagctggagcggaaggtgtgggaactggcgaggctggtctggcagtcttccagtgtggtgttccacacgggtgccggcatcagcactgcctctggcatccccgacttcaggggtccccacggagtctggaccatggaggagcgaggtctggcccccaagttcgacaccacctttgagagcgcgcggcccacgcagacccacatggcgctggtgcagctggagcgcgtgggcctcctccgcttcctggtcagccagaacgtggacgggctccatgtgcgctcaggcttccccagggacaaactggcagagctccacgggaacatgtttgtggaagaatgtgccaagtgtaagacgcagtacgtccgagacacagtcgtgggcaccatgggcctgaaggccacgggccggctctgcaccgtggctaaggcaagggggctgcgagcctgcaggggagagctgagggacaccatcctagactgggaggactccctgcccgaccgggacctggcactcgccgatgaggccagcaggaacgccgacctgtccatcacgctgggtacatcgctgcagatccggcccagcgggaacctgccgctggctaccaagcgccggggaggccgcctggtcatcgtcaacctgcagcccaccaagcacgaccgccatgctgacctccgcatccatggctacgttgacgaggtcatgacccggctcatgaagcacctggggctggagatccccgcctgggacggcccccgtgtgctggagagggcgctgccacccctgccccgcccgcccacccccaagctggagcccaaggaggaatctcccacccggatcaacggctctatccccgccggccccaagcaggagccctgcgcccagcacaacggctcagagcccgccagccccaaacgggagcggcccaccagccctgccccccacagaccccccaaaagggtgaaggccaaggcggtccccagctgaccagggtgcttggggagggtggggctttttgtagaaactgtggattctttttctctcgtggtctcactttgttacttgtttctgtccccgggagcctcagggctctgagagctgtgctccaggccaggggttacacctgccctccgtggtccctccctgggctccaggggcctctggtgcggttccgggaagaagccacaccccagaggtgacaggtgagcccctgccacaccccagcctctgacttgctgtgttgtccagaggtgaggctgggccctccctggtctccagcttaaacaggagtgaactccctctgtccccagggcctcccttctgggccccctacagcccaccctacccctcctccatgggccctgcaggaggggagacccaccttgaagtgggggatcagtagaggcttgcactgcctttggggctggagggagacgtgggtccaccaggcttctggaaaagtcctcaatgcaataaaaacaatttctttcttgca

SEQ ID NO: 181897 - DNA, 1361 bp, Homo sapiens
  Payload ID: 15814
  Gene Symbol: SIRT6
  Gene Name: sirtuin 6
  ENST ID: ENST00000601488
  CDS Start-End: 9-572
agtcgaggatgtcggtgaattacgcggcggggctgtcgccgtacgcggacaagggcaagtgcggcctcccggagatcttcgaccccccggaggagctggagcggaaggtgtgggaactggcgaggctggtctggcagtcttccagtgtggtgttccacacgggtgccggcatcagcactgcctctggcatccccgacttcagggacaaactggcagagctccacgggaacatgtttgtggaagaatgtgccaagtgtaagacgcagtacgtccgagacacagtcgtgggcaccatgggcctgaaggccacgggccggctctgcaccgtggctaaggcaagggggctgcgagcctgcaggggagagctgagggacaccatcctagactgggaggactccctgcccgaccgggacctggcactcgccgatgaggccagcagatccggcccagcgggaacctgccgctggctaccaagcgccggggaggccgcctggtcatcgtcaacctgcagcccaccaagcacgaccgccatgctgacctccgcatccatggctacgttgacgaggtcatgacccggctcatgaagcacctggggctggagatccccgcctgggacggcccccgtgtgctggagagggcgctgccacccctgccccgcccgcccacccccaagctggagcccaaggaggaatctcccacccggatcaacggctctatccccgccggccccaagcaggagccctgcgcccagcacaacggctcagagcccgccagccccaaacgggagcggcccaccagccctgccccccacagaccccccaaaagggtgaaggccaaggcggtccccagctgaccagggtgcttggggagggtggggctttttgtagaaactgtggattctttttctctcgtggtctcactttgttacttgtttctgtccccgggagcctcagggctctgagagctgtgctccaggccaggggttacacctgccctccgtggtccctccctgggctccaggggcctctggtgcggttccgggaagaagccacaccccagaggtgacaggtgagcccctgccacaccccagcctctgacttgctgtgttgtccagaggtgaggctgggccctccctggtctccagcttaaacaggagtgaactccctctgtccccagggcctcccttctgggccccctacagcccaccctacccctcctccatgggccctgcaggaggggagacccaccttgaagtgggggatcagtagaggcttgcactgcctttggggctggagggagacgtgggtccaccaggcttctggaaaagtcctcaatgcaataaaaacaatttctttcttgca

SEQ ID NO: 181898 - DNA, 827 bp, Homo sapiens
  Payload ID: 15814
  Gene Symbol: SIRT6
  Gene Name: sirtuin 6
  ENST ID: ENST00000597896
  CDS Start-End: 1-827
gacaagggcaagtgcggcctcccggagatcttcgaccccccggaggagctggagcggaaggtgtgggaactggcgaggctggtctggcagtcttccagtgtggtgttccacacgggtgccggcatcagcactgcctctggcatccccgacttcagggacaaactggcagagctccacgggaacatgtttgtggaagaatgtgccaagtgtaagacgcagtacgtccgagacacagtcgtgggcaccatgggcctgaaggccacgggccggctctgcaccgtggctaaggcaagggggctgcgagcctgcaggggagagctgagggacaccatcctagactgggaggactccctgcccgaccgggacctggcactcgccgatgaggccagcaggaacgccgacctgtccatcacgctgggtacatcgctgcagatccggcccagcgggaacctgccgctggctaccaagcgccggggaggccgcctggtcatcgtcaacctgcagcccaccaagcacgaccgccatgctgacctccgcatccatggctacgttgacgaggtcatgacccggctcatgaagcacctggggctggagatccccgcctgggacggcccccgtgtgctggagagggcgctgccacccctgccccgcccgcccacccccaagctggagcccaaggaggaatctcccacccggatcaacggctctatccccgccggccccaagcaggagccctgcgcccagcacaacggctcagagcccgccagccccaaacgggagcggcccaccagccctgccccccacagaccccccaaaagggtgaaggc

SEQ ID NO: 181899 - DNA, 1473 bp, Homo sapiens
  Payload ID: 15814
  Gene Symbol: SIRT6
  Gene Name: sirtuin 6
  ENST ID: ENST00000600938
  CDS Start-End: 27-158
ttattgttcccgtggggcagtcgaggatgtcggtgaattacgcggcggggctgtcgccgtacgcggacaagggcaagtgcggcctcccggaggggtccccacggagtctggaccatggaggagcgaggtctggcccccaagttcgacaccacctttgagagcgcgcggcccacgcagacccacatggcgctggtgcagctggagcgcgtgggcctcctccgcttcctggtcagccagaacgtggacgggctccatgtgcgctcaggcttccccagggacaaactggcagagctccacgggaacatgtttgtggaagaatgtgccaagtgtaagacgcagtacgtccgagacacagtcgtgggcaccatgggcctgaaggccacgggccggctctgcaccgtggctaaggcaagggggctgcgagcctgcaggggagagctgagggacaccatcctagactgggaggactccctgcccgaccgggacctggcactcgccgatgaggccagcaggaacgccgacctgtccatcacgctgggtacatcgctgcagatccggcccagcgggaacctgccgctggctaccaagcgccggggaggccgcctggtcatcgtcaacctgcagcccaccaagcacgaccgccatgctgacctccgcatccatggctacgttgacgaggtcatgacccggctcatgaagcacctggggctggagatccccgcctgggacggcccccgtgtgctggagagggcgctgccacccctgccccgcccgcccacccccaagctggagcccaaggaggaatctcccacccggatcaacggctctatccccgccggccccaagcaggagccctgcgcccagcacaacggctcagagcccgccagccccaaacgggagcggcccaccagccctgccccccacagaccccccaaaagggtgaaggccaaggcggtccccagctgaccagggtgcttggggagggtggggctttttgtagaaactgtggattctttttctctcgtggtctcactttgttacttgtttctgtccccgggagcctcagggctctgagagctgtgctccaggccaggggttacacctgccctccgtggtccctccctgggctccaggggcctctggtgcggttccgggaagaagccacaccccagaggtgacaggtgagcccctgccacaccccagcctctgacttgctgtgttgtccagaggtgaggctgggccctccctggtctccagcttaaacaggagtgaactccctctgtccccagggcctcccttctgggccccctacagcccaccctacccctcctccatgggccctgcaggaggggagacccaccttgaagtgggggatcagtagaggcttgcactgcctttggggctggagggagacgtgggtccaccaggcttctggaaaagtcctcaatgcaataaaaacaatttctttcttgc

SEQ ID NO: 181900 - DNA, 716 bp, Homo sapiens
  Payload ID: 15814
  Gene Symbol: SIRT6
  Gene Name: sirtuin 6
  ENST ID: ENST00000601571
  CDS Start-End: 1-561
gtgaattacgcggcggggctgtcgccgtacgcggacaagggcaagtgcggcctcccggagatcttcgaccccccggaggagctggagcggaaggtgtgggaactggcgaggctggtctggcagtcttccagtgtggtgttccacacgggtgccggcatcagcactgcctctggcatccccgacttcagggacaaactggcagagctccacgggaacatgtttgtggaagaatgtgccaagtgtaagacgcagtacgtccgagacacagtcgtgggcaccatgggcctgaaggccacgggccggctctgcaccgtggctaaggcaagggggctgcgagcctgcaggggagagctgagggacaccatcctagactgggaggactccctgcccgaccgggacctggcactcgccgatgaggccagcaggaacgccgacctgtccatcacgctgggtacatcgctgcagatccggcccagcgggaacctgccgctggctaccaagcgccggggaggccgcctggtcatcgtcaacctgcagcccaccaagcacgtaggtgtctgagcctacccctgcccagggccaccatgcaccctctgtcccccacgcctgacccgtcccgcccctcggcaggaccgccatgctgacctccgcatccatggctacgttgacgaggtcatgacccggctcatgaagcacctggggctggagatccccgc

SEQ ID NO: 181901 - DNA, 1507 bp, Homo sapiens
  Payload ID: 15814
  Gene Symbol: SIRT6
  Gene Name: sirtuin 6
  ENST ID: ENST00000594279
  CDS Start-End: 220-750
cctgtcggggctgatcggggagagaggggatgtagttccaggaagaggggacgacaggcgcaaagggagatcttcgaccccccggaggagctggagcggaaggtgtgggaactggcgaggctggtctggcagtcttccagtgtggtgttccacacgggtgccggcatcagcactgcctctggcatccccgacttcaggggtccccacggagtctggaccatggaggagcgaggtctggcccccaagttcgacaccacctttgagagcgcgcggcccacgcagacccacatggcgctggtgcagctggagcgcgtgggcctcctccgcttcctggtcagccagaacgtggacgggctccatgtgcgctcaggcttccccagggacaaactggcagagctccacgggaacatgtttgtggaagaatgtgccaagtgtaagacgcagtacgtccgagacacagtcgtgggcaccatgggcctgaaggccacgggccggctctgcaccgtggctaaggcaagggggctgcgagcctgcaggggagagctgagggacaccatcctagactgggaggactccctgcccgaccgggacctggcactcgccgatgaggccagcagatccggcccagcgggaacctgccgctggctaccaagcgccggggaggccgcctggtcatcgtcaacctgcagcccaccaagcacgaccgccatgctgacctccgcatccatggctacgttgacgaggtcatgacccggctcatgaagcacctggggctggagatccccgcctgggacggcccccgtgtgctggagagggcgctgccacccctgccccgcccgcccacccccaagctggagcccaaggaggaatctcccacccggatcaacggctctatccccgccggccccaagcaggagccctgcgcccagcacaacggctcagagcccgccagccccaaacgggagcggcccaccagccctgccccccacagaccccccaaaagggtgaaggccaaggcggtccccagctgaccagggtgcttggggagggtggggctttttgtagaaactgtggattctttttctctcgtggtctcactttgttacttgtttctgtccccgggagcctcagggctctgagagctgtgctccaggccaggggttacacctgccctccgtggtccctccctgggctccaggggcctctggtgcggttccgggaagaagccacaccccagaggtgacaggtgagcccctgccacaccccagcctctgacttgctgtgttgtccagaggtgaggctgggccctccctggtctccagcttaaacaggagtgaactccctctgtccccagggcctcccttctgggccccctacagcccaccctacccctcctccatgggccctgcaggaggggagacccaccttgaagtgggggatcagtagaggcttgcactgcctttggggctggagggagacgtgggtccaccaggcttctggaaaagtc

SEQ ID NO: 181902 - DNA, 1372 bp, Homo sapiens
  Payload ID: 15814
  Gene Symbol: SIRT6
  Gene Name: sirtuin 6
  ENST ID: ENST00000599365
  CDS Start-End: 6-137
cgaggatgtcggtgaattacgcggcggggctgtcgccgtacgcggacaagggcaagtgcggcctcccggaggggtccccacggagtctggaccatggaggagcgaggtctggcccccaagttcgacaccacctttgagagcgcgcggcccacgcagacccacatggcgctggtgcagctggagcgcgtgggcctcctccgcttcctggtcagccagaacgtggacgggctccatgtgcgctcaggcttccccagggacaaactggcagagctccacgggaacatgtttgtggaagaatgtgccaagtgtaagacgcagtacgtccgagacacagtcgtgggcaccatgggcctgaaggccacgggccggctctgcaccgtggctaaggcaagggggctgcgagcctgcaggaacgccgacctgtccatcacgctgggtacatcgctgcagatccggcccagcgggaacctgccgctggctaccaagcgccggggaggccgcctggtcatcgtcaacctgcagcccaccaagcacgaccgccatgctgacctccgcatccatggctacgttgacgaggtcatgacccggctcatgaagcacctggggctggagatccccgcctgggacggcccccgtgtgctggagagggcgctgccacccctgccccgcccgcccacccccaagctggagcccaaggaggaatctcccacccggatcaacggctctatccccgccggccccaagcaggagccctgcgcccagcacaacggctcagagcccgccagccccaaacgggagcggcccaccagccctgccccccacagaccccccaaaagggtgaaggccaaggcggtccccagctgaccagggtgcttggggagggtggggctttttgtagaaactgtggattctttttctctcgtggtctcactttgttacttgtttctgtccccgggagcctcagggctctgagagctgtgctccaggccaggggttacacctgccctccgtggtccctccctgggctccaggggcctctggtgcggttccgggaagaagccacaccccagaggtgacaggtgagcccctgccacaccccagcctctgacttgctgtgttgtccagaggtgaggctgggccctccctggtctccagcttaaacaggagtgaactccctctgtccccagggcctcccttctgggccccctacagcccaccctacccctcctccatgggccctgcaggaggggagacccaccttgaagtgggggatcagtagaggcttgcactgcctttggggctggagggagacgtgggtccaccaggcttctggaaaagtcctcaatgcaataaaaacaatttctttcttgca

SEQ ID NO: 181903 - DNA, 1743 bp, Homo sapiens
  Payload ID: 15815
  Gene Symbol: SIRT7
  Gene Name: sirtuin 7
  Uniprot ID: Q9NRC8
  ENST ID: ENST00000328666
  CDS Start-End: 64-1266
atgcgccctgagcgcggcctgccgtgtgaggcggaagcggaagagcaggtctccaggggagcgatggcagccgggggtctgagccgctccgagcgcaaagcggcggagcgggtccggaggttgcgggaggagcagcagagggagcgcctccgccaggtgtcgcgcatcctgaggaaggcggcggcggagcgcagcgccgaggagggccggctgctggccgagagcgcggacctggtaacggagctgcagggccggagccggcggcgcgagggcctgaagcggcggcaggaggaggtgtgcgacgacccggaggagctgcgggggaaggtccgggagctggccagcgccgtccggaacgccaaatacttggtcgtctacacaggcgcgggaatcagcacggcagcgtctatcccagactaccggggccctaatggagtgtggacactgcttcagaaagggagaagcgttagtgctgccgacctgagcgaggccgagccaaccctcacccacatgagcatcacccgtctgcatgagcagaagctggtgcagcatgtggtgtctcagaactgtgacgggctccacctgaggagtgggctgccgcgcacggccatctccgagctccacgggaacatgtacattgaagtctgtacctcctgcgttcccaacagggagtacgtgcgggtgttcgatgtgacggagcgcactgccctccacagacaccagacaggccggacctgccacaagtgtgggacccagctgcgggacaccattgtgcactttggggagagggggacgttggggcagcctttgaactgggaagcggcgaccgaggctgccagcagagcagacaccatcctgtgtctagggtccagcctgaaggttctaaagaagtacccacgcctctggtgcatgaccaagccccctagccggcggccgaagctttacatcgtgaacctgcagtggaccccgaaggatgactgggctgccctgaagctacatgggaagtgtgatgacgtcatgcggctcctcatggccgagctgggcttggagatccccgcctatagcaggtggcaggatcccattttctcactggcgactcccctgcgtgctggtgaagaaggcagccacagtcggaagtcgctgtgcagaagcagagaggaggccccgcctggggaccggggtgcaccgcttagctcggcccccatcctagggggctggtttggcaggggctgcacaaaacgcacaaaaaggaagaaagtgacgtaatcacgtgctcgatgaagaacagttggcactttgcagatggccagtgtcacggtgaaggctgggttgcccccacgggtctagggagaacgaactctttggggatgacattttcaccgtgacatttttagccatttgtccttgaggaagccccttgcactgctgcggttgtaccctgatacggcctggccatcgaggacacctgcccatccggcctctgtgtcaagaggtggcagccgcacctttctgtgagaacggaactcgggttatttcagccccggcctgcagagtggaagcgcccagcggcctttcctcgctcaccaggccagtctcagggcctcaccgtatttctactactacttaatgaaaaagtgtgaactttatagaatcctctctgtactggatgtgcggcagaggggtggctccgagcctcggctctatgcagacctttttatttctattaaacgtttctgcactggc

SEQ ID NO: 181904 - DNA, 754 bp, Homo sapiens
  Payload ID: 15815
  Gene Symbol: SIRT7
  Gene Name: sirtuin 7
  ENST ID: ENST00000575360
  CDS Start-End: 6-356
gagcgatggcagccgggggtctgagccgctccgagcgcaaagcggcggagcgggtccggaggttgcgggaggagcagcagagggagcgcctccgccaggtgtcgcgcatcctgaggaaggcggcggcggagcgcagcgccgaggagggccggctgctggccgagagcgcggacctggtaacggagctgcagggccggagccggcggcgcgagggcctgaagcggcggcaggaggaggtgtgcgacgacccggaggagctgcgggggaaggtccgggagctggccagcgccgtccggaacgccaaatacttggtcgtctacacaggcgcgggaatcagcacggtggagcgggaatagtcagcactgggacatgagaatggacagtcgcctggacccacctagggattcaccatttgctaaatgtgcagcgtctatcccagactaccggggccctaatggagtgtggacactgcttcagaaagggagaagcgttagtgctgccgacctgagcgaggccgagccaaccctcacccacatgagcatcacccgtctgcatgagcagaagctggtgcagcatgtggtgtctcagaactgtgacgggctccacctgaggagtgggctgccgcgcacggccatctccgagctccacgggaacatgtacattgaagtctgtacctcctgcgttcccaacagggagtacgtgcgggtgttcgatgtgacggagcgcactgccctccacagacaccagacaggcc

SEQ ID NO: 181905 - DNA, 909 bp, Homo sapiens
  Payload ID: 15815
  Gene Symbol: SIRT7
  Gene Name: sirtuin 7
  ENST ID: ENST00000572902
  CDS Start-End: 460-909
tttgcttctgctggcttgctggacctgggctggggtgccaagtggcgcctgctgcgtcagagctcaaggaatctgtgcccaccaccagctcctggtccgtaggaggtgtcgcgcatcctgaggaaggcggcggcggagcgcagcgccgaggagggccggctgctggccgagagcgcggacctggtaacggagctgcagggccggagccggcggcgcgagggcctgaagcggcggcaggaggaggtgtgcgacgacccggaggagctgcgggggaaggtccgggagctggccagcgccgtccggaacgccaaatacttggtcgtctacacaggcgcgggaatcagcacggcagcgtctatcccagactaccggggccctaatggagtgtggacactgcttcagaaagggagaagcgttagtgctgccgacctgagcgaggccgagccaaccctcacccacatgagcatcacccgtctgcatgagcagaagctggtgcagcatgtggtgtctcagaactgtgacgggctccacctgaggagtgggctgccgcgcacggccatctccgagctccacgggaacatgtacattgaagtctgtacctcctgcgttcccaacagggagtacgtgcgggtgttcgatgtgacggagcgcactgccctccacagacaccagacaggccggacctgccacaagtgtgggacccagctgcgggacaccattgtgcactttggggagagggggacgttggggcagcctttgaactgggaagcggcgaccgaggctgccagcagagcagacaccatcctgtgtctagggtccagcctgaaggttctaaagaagtacccacgcctctggtgcatgaccaagccccctagccggcggccgaagctttacatcgtgaacctgcag

SEQ ID NO: 181906 - DNA, 802 bp, Homo sapiens
  Payload ID: 15816
  Gene Symbol: SIVA1
  Gene Name: SIVA1, apoptosis-inducing factor
  Uniprot ID: O15304
  ENST ID: ENST00000329967
  CDS Start-End: 103-630
aaacccgctctcgcccgcggatgggcgcgcagctgtgacgtcacggcgtcgttggtaaggggctggcggccggggagctgcgtagctcccggccccgcggccatgcccaagcggagctgccccttcgcggacgtggccccgctacagctcaaggtccgcgtgagccagagggagttgagccgcggcgtgtgcgccgagcgctactcgcaggaggtcttcgagaagaccaagcgactcctgttcctcggggcccaggcctacctggaccacgtgtgggatgaaggctgtgccgtcgttcacctgccagagtccccaaagcctggccctacaggggccccgagggctgcacgtgggcagatgctgattggaccagacggccgcctgatcaggagccttgggcaggcctccgaagctgacccatctggggtagcgtccattgcctgttcctcatgcgtgcgagccgtggatgggaaggcggtctgcggtcagtgtgagcgagccctgtgcgggcagtgtgtgcgcacctgctggggctgcggctccgtggcctgtaccctgtgtggcctcgtggactgcagtgacatgtacgagaaagtgctgtgcaccagctgtgccatgttcgagacctgaggctggctcaagccggctgccttcaccgggagccacgccgtgcatggcagccttccctggacgagcgctcggtgttcacactgaactgtggggtcgacgggaggggtgccttttacatgttctattttgtatcctaatgacagaatgaataaacctctttatatttgcacaa

SEQ ID NO: 181907 - DNA, 550 bp, Homo sapiens
  Payload ID: 15816
  Gene Symbol: SIVA1
  Gene Name: SIVA1, apoptosis-inducing factor
  Uniprot ID: O15304
  ENST ID: ENST00000347067
  CDS Start-End: 44-376
gggctggcggccggggagctgcgtagctcccggccccgcggccatgcccaagcggagctgccccttcgcggacgtggccccgctacagctcaaggtccgcgtgagccagagggagttgagccgcggcgtgtgcgccgagcgctactcgcaggaggtcttcgacccatctggggtagcgtccattgcctgttcctcatgcgtgcgagccgtggatgggaaggcggtctgcggtcagtgtgagcgagccctgtgcgggcagtgtgtgcgcacctgctggggctgcggctccgtggcctgtaccctgtgtggcctcgtggactgcagtgacatgtacgagaaagtgctgtgcaccagctgtgccatgttcgagacctgaggctggctcaagccggctgccttcaccgggagccacgccgtgcatggcagccttccctggacgagcgctcggtgttcacactgaactgtggggtcgacgggaggggtgccttttacatgttctattttgtatcctaatgacagaatgaataaacctctttatatttgcacaaga

SEQ ID NO: 181908 - DNA, 856 bp, Homo sapiens
  Payload ID: 15816
  Gene Symbol: SIVA1
  Gene Name: SIVA1, apoptosis-inducing factor
  ENST ID: ENST00000553819
  CDS Start-End: 32-541
ggggagctgcgtagctcccggccccgcggccatgcccaagcggagctgccccttcgcggacgtggccccgctacagctcaaggtccgcgtgagccagagggagttgagccgcggcgtgtgcgccgagcgctactcgcaggaggtcttcgagaagaccaagcgactcctgttcctcggggcccaggcctacctggaccacgtgtgggatgaaggctgtgccgtcgttcacctgccagagtccccaaagcctggccctacaggggccccgagggctgcacgtgggcagatgctgattggaccagacggccgcctgatcaggagccttgggcaggcctccgaagctgacccatctggggtagcgtccattgcctgttcctcatgcgtgcgagccgtggatgggaaggcggtctgcggtcagtgtgagcgagccctgtgcgggcagtgtgtgcgcacctgctggggctgcggctccgtggcctgtaccctgtgtggcctcgtggagccggccttgtgctggaaagagcatgatgtgggcatgtgagaaacaaactcacccatccacacccgaagaatggactcagagacctcagagaccggagaacagcaaaaaactatccctaagaggccaggtgtggtggctcacaccttataatcccaacgttttgggaggacaaggcaggaggatcacttgaggcccggagttcaagaccggcctgaacaacatagcgagaccctatctctaccataaaaaagacccagaacatcctcgccagcctgtgctccctatggggcaccccctccagtggaagtgagggcagccacgcacccctgggaatgccttagagaggggccaatt

SEQ ID NO: 181909 - DNA, 550 bp, Homo sapiens
  Payload ID: 15816
  Gene Symbol: SIVA1
  Gene Name: SIVA1, apoptosis-inducing factor
  ENST ID: ENST00000553810
  CDS Start-End: 43-550
ggctggcggccggggagctgcgtagctcccggccccgcggccatgcccaagcggagctgccccttcgcggacgtggccccgctacagctcaaggtccgcgtgagccagagggagttgagccgcggcgtgtgcgccgagcgctactcgcaggaggtcttcgagaagaccaagcgactcctgttcctcggggcccaggcctacctggaccacgtgtgggatgaaggctgtgccgtcgttcacctgccagagtccccaaagcctggccctacaggggccccgagggctgcacgtgggcagatgctgattggaccagacggccgcctgatcaggagccttgggcaggcctccgaagctgacccatctggggtagcgtccattgcctgttcctcatgcgtgcgagccgtggatgggaaggcggtctgcggtcagtgtgagcgagccctgtgcgggcagtgtgtgcgcacctgctggggctgcggctccgtggcctgtaccctgtgtggcctcgtggagggctactcacctggtggatgggagtggacagtgtgga

SEQ ID NO: 181910 - DNA, 674 bp, Homo sapiens
  Payload ID: 15816
  Gene Symbol: SIVA1
  Gene Name: SIVA1, apoptosis-inducing factor
  ENST ID: ENST00000556195
  CDS Start-End: 309-581
cccctcctgtcccaagaggtattcatggagcgcgcggccctgccaggcacggcggctttctcgggagaccaaaggcaggcaagacagatgtgccccgtctcccgggagctccccagcctagttggggagaccagcaggaggagtcgccacaggtggtcggggcaggcacagagaagaccaagcgactcctgttcctcggggcccaggcctacctggaccacgtgtgggatgaaggctgtgccgtcgttcacctgccagagtccccaaagcctggccctacaggggccccgagggctgcacgtgggcagatgctgattggaccagacggccgcctgatcaggagccttgggcaggcctccgaagctgacccatctggggtagcgtccattgcctgttcctcatgcgtgcgagccgtggatgggaaggcggtctgcggtcagtgtgagcgagccctgtgcgggcagtgtgtgcgcacctgctggggctgcggctccgtggcctgtaccctgtgtggcctcgtggactgcagtgacatgtacgagaaagtgctgtgcaccagctgtgccatgttcgagacctgaggctggctcaagccggctgccttcaccgggagccacgccgtgcatggcagccttccctggacgagcgctcggtgttcacactgaactgtgggg

SEQ ID NO: 181911 - DNA, 1244 bp, Homo sapiens
  Payload ID: 15816
  Gene Symbol: SIVA1
  Gene Name: SIVA1, apoptosis-inducing factor
  ENST ID: ENST00000535554
  CDS Start-End: 56-529
gtcgttggtaaggggctggcggccggggagctgcgtagctcccggccccgcggccatgcccaagcggagctgccccttcgcggacgtggccccgctacagctcaaggtccgcgtgagccagagggagttgagccgcggcgtgtgcgccgagcgctactcgcaggaggtcttcgagaagaccaagcgactcctgttcctcggggcccaggcctacctggaccacgtgtgggatgaaggctgtgccgtcgttcacctgccagagtccccaaagcctggccctacaggggccccgagggctgcacgtgggcagatgctgattggaccagacggccgcctgatcaggagccttgggcaggcctccgaagctgacccatctggggtagcgtccattgcctgttcctcatgcgtgcgagccgtggatgggaaggcggtctgcggtcagtgtgagcgagccctgtgcgggcagtgtgtgcgcacctgctggggctgcggctccgtggcctgtaccctgtgtggcctcgtggagtaagtacttcagtccctggagctgctgagatcccatagccccagcaagccgtgatgggggacgggtgggtcacccatgtgggcccagaacacacacgtgtggcccctgatgcagtgccatctggcattgcctaacgggacatggtggcaatagatgcttggcccaactttagtggttagtaatcctctctaagggaaagctgaacctcacagatgacctgctctgtatccggctctagtccctgtcttcagccacttcctgttctgatctttgagcacccccacctcctcctcctctggtctttgagccccccctccccccgtccgaggagcccctggttggtgacacaggtgcacaccgcagcttcaccacagtcatgcgtgccgtttggttgtagaccctctcaggcaggaagtggagtgtttgtgtagtctcccatttgtgggtgggtttgctgcagctggctggatcccgtccttactcctaaggtggggaggggcgttctcaccctaggggctactcacctggtggatgggagtggacagtgtggagcctgtttgccctgccccgtgagaaagatgacttcatccagacacatgtggaactggctccatagacccaaagcaagcttagtccaaacaatgtctgaaattgtccatctaaaatagaaaccacatgttacatctcgagtcctttctctcgagcctttcttcagtcg

SEQ ID NO: 181912 - DNA, 3996 bp, Homo sapiens
  Payload ID: 15817
  Gene Symbol: SIX1
  Gene Name: SIX homeobox 1
  Uniprot ID: Q15475
  ENST ID: ENST00000247182
  CDS Start-End: 274-1128
tagcagcatccaccgggcgggaggtcggaggcagcaaggccttaaaggctactgagtgcgccggccgttccgtgtccagaacctcccctactcctccgccttctcttccttggccgcccaccgccaagttccgactccggttttcgcctttgcaaagcctaaggaggaggttaggaacagccgcgcccccctccctgcggccgccgccccctgcctctcggctctgctccctgccgcgtgcgcctgggccgtgcgccccggcaggccccagccatgtcgatgctgccgtcgtttggctttacgcaggagcaagtggcgtgcgtgtgcgaggttctgcagcaaggcggaaacctggagcgcctgggcaggttcctgtggtcactgcccgcctgcgaccacctgcacaagaacgagagcgtactcaaggccaaggcggtggtcgccttccaccgcggcaacttccgtgagctctacaagatcctggagagccaccagttctcgcctcacaaccaccccaaactgcagcaactgtggctgaaggcgcattacgtggaggccgagaagctgcgcggccgacccctgggcgccgtgggcaaatatcgggtgcgccgaaaatttccactgccgcgcaccatctgggacggcgaggagaccagctactgcttcaaggagaagtcgaggggtgtcctgcgggagtggtacgcgcacaatccctacccatcgccgcgtgagaagcgggagctggccgaggccaccggcctcaccaccacccaggtcagcaactggtttaagaaccggaggcaaagagaccgggccgcggaggccaaggaaagggagaacaccgaaaacaataactcctcctccaacaagcagaaccaactctctcctctggaagggggcaagccgctcatgtccagctcagaagaggaattctcacctccccaaagtccagaccagaactcggtccttctgctgcagggcaatatgggccacgccaggagctcaaactattctctcccgggcttaacagcctcgcagcccagtcacggcctgcagacccaccagcatcagctccaagactctctgctcggccccctcacctccagtctggtggacttggggtcctaagtggggagggactggggcctcgaagggattcctggagcagcaaccactgcagcgactagggacacttgtaaatagaaatcaggaacatttttgcagcttgtttctggagttgtttgcgcataaaggaatggtggactttcacaaatatctttttaaaaatcaaaaccaacagcgatctcaagcttaatctcctcttctctccaactctttccacttttgcattttccttcccaatgcagagatcagggaaaaaaaaaaaaaaaaacccaaacaaacaaaagcacccaggcacccagtctgagttctgggcaactgatacgcctgtttcagcagcctttcttttttttcaatgaatgggaattgcaaatcaactggattttcattatttccttttaatttatatatggagaaatgtgaagagggaaaggaaatggaaagagaaagagaaagggagataaaaatagtgaaaataagagcctccaggctcagaagaactgattacattcttaaggtgaacaggaaaaatacaatctataactttctttgatgaggaaaaattaagtttacatttttcatatttagtgttaaacaatttaatgtagattaaaataaaagaccagtattaggaggaaaaaacaagtgcctaaatgtcttaatgctctctatgtgagacagaaatagacgtgaccattagtaatgcaactatttttgtcaaatttagtgggattttttggttgttgtttgttttcttgggttttttttttttaaatgacaaactctaaaaatgtaccaatgtgaaaaaacactttcctgaatgccattactcatgccctcaaagctttcatatctgtagcctactcctgtaaagggtttctcctgtttctagtttctagtttgcaaaggtatgccaacgaatctggcaacctggtatttgttactaaaacagcatgtgttttcaggtttcttttctattgtacctaaagcagtctaaattaaaacttagtagaacaccaggagtatgattctgtttctgaaaggtgagtggtgtattgctgtcattgggccctatttttttttttaaatatatttttctttcttacttaatggtggctgtgaattgcagggtactttgaaggccatcatctgaaccaagagtagtaactagattaattatatgacagaaagagtgaatttagccttggggtatttattaacttctattatttagatatgcaattttgtttaccactatctcttcacagcattcatatgttaactaagctcttttgtgttaacaagtttatgacaagactgtgaaagtaaaaataatttatctgcttgaagacaaaaaagggaaggagaacaaggatagaaacattgtgaattaatttgtacaaatagaaagcagaccagcaggacaggagctcttttgcagtgctgccggatggtgtctagaaaaatcccagtaatcatgtaggctccatattatttttgcctggggcaaaatgatgtatcttctgtatttagcttttaaaattagtgaaacaaatggcattatttattaaaattctactcaggataacaggattggcttgcttgtgctttgtaaaatattgttccccagggagaatctatttattttctgacatgacagtttcataattttgattttttcccatctataattgtcaccattaatatattatttctttcttactctttcctatttctgttctggtctagaaaactgaggtgtgcttggggaaatcaaggccttattttttaaaactgtcaaatagctttgagttccagggagaaatggtcactgtacttaactgtacacacttttacttataaagtcgtttttccccctcagtgatggacagatgtgcacacagccactcagagaccatcatttggtttgggagctcagggtcccaatctcccttgttagtgttttggatcattaagtcggtgtttatttaagtcactagggtgtttattctccctgtcttgggccacggagaaatgccaccctctgcaggaggggctctcacagggaatctcctcacattcttcacattcactccccaaaacaaacaccctgcacaaagatagctttcaatgaccctgacaggcttcaaaggacgctgcggaaatctctctggaaaataggaagggccaattactttaatttcttacatgccgtctcttcctactccggtgactaccctccactctcccagctccgcctgggataattttaggctcgtggaagttgtgtctcgcagggcgccccggcccacttcctgctcccttagttggtgaatcttggaaatgtctgcagatccggcgaggagcaagagcgctggtcctgtaaaagcccccgtgattactgcttgtaaacttgttaaaaggacaattttctgtcacagtcataaactctttgtaaaacccctggcactaaatccagagcgcgcatattccagatgtgtttaataagaaattgcacaatgtgcctccttccgccatcctcggctcagtctgggtaaaaggggcgagcaggaggaggcgagaaagctggatattgctttgagtttttttggcaatcatttcagagagatcattaggggaaactaaccatatttttttcttccctcgaggaaatcttcgagaaccagctgttaagggacctccagtttaccttctgggcgtcgcagtttaactgaatctaaagccacttttcgtttctcctctacagatgtcataacggtagccaaaagtaatgaacaacggcttataaatagtttgtaggacgaaaccatacagcattgtgccaagtgaaatgaaaaaaaaaaaaaacactcg

SEQ ID NO: 181913 - DNA, 1959 bp, Homo sapiens
  Payload ID: 15817
  Gene Symbol: SIX1
  Gene Name: SIX homeobox 1
  ENST ID: ENST00000554986
  CDS Start-End: 37-372
ctagtatctatgtacaaatcaggagggcctttaaatatgtccatgaatccagagcgacctttcaaggcagaagataaggagaacaccgaaaacaataactcctcctccaacaagcagaaccaactctctcctctggaagggggcaagccgctcatgtccagctcagaagaggaattctcacctccccaaagtccagaccagaactcggtccttctgctgcagggcaatatgggccacgccaggagctcaaactattctctcccgggcttaacagcctcgcagcccagtcacggcctgcagacccaccagcatcagctccaagactctctgctcggccccctcacctccagtctggtggacttggggtcctaagtggggagggactggggcctcgaagggattcctggagcagcaaccactgcagcgactagggacacttgtaaatagaaatcaggaacatttttgcagcttgtttctggagttgtttgcgcataaaggaatggtggactttcacaaatatctttttaaaaatcaaaaccaacagcgatctcaagcttaatctcctcttctctccaactctttccacttttgcattttccttcccaatgcagagatcagggaaaaaaaaaaaaaaaaacccaaacaaacaaaagcacccaggcacccagtctgagttctgggcaactgatacgcctgtttcagcagcctttcttttttttcaatgaatgggaattgcaaatcaactggattttcattatttccttttaatttatatatggagaaatgtgaagagggaaaggaaatggaaagagaaagagaaagggagataaaaatagtgaaaataagagcctccaggctcagaagaactgattacattcttaaggtgaacaggaaaaatacaatctataactttctttgatgaggaaaaattaagtttacatttttcatatttagtgttaaacaatttaatgtagattaaaataaaagaccagtattaggaggaaaaaacaagtgcctaaatgtcttaatgctctctatgtgagacagaaatagacgtgaccattagtaatgcaactatttttgtcaaatttagtgggattttttggttgttgtttgttttcttgggttttttttttttaaatgacaaactctaaaaatgtaccaatgtgaaaaaacactttcctgaatgccattactcatgccctcaaagctttcatatctgtagcctactcctgtaaagggtttctcctgtttctagtttctagtttgcaaaggtatgccaacgaatctggcaacctggtatttgttactaaaacagcatgtgttttcaggtttcttttctattgtacctaaagcagtctaaattaaaacttagtagaacaccaggagtatgattctgtttctgaaaggtgagtggtgtattgctgtcattgggccctatttttttttttaaatatatttttctttcttacttaatggtggctgtgaattgcagggtactttgaaggccatcatctgaaccaagagtagtaactagattaattatatgacagaaagagtgaatttagccttggggtatttattaacttctattatttagatatgcaattttgtttaccactatctcttcacagcattcatatgttaactaagctcttttgtgttaacaagtttatgacaagactgtgaaagtaaaaataatttatctgcttgaagacaaaaaagggaaggagaacaaggatagaaacattgtgaattaatttgtacaaatagaaagcagaccagcaggacaggagctcttttgcagtgctgccggatggtgtctagaaaaatcccagtaatcatgtaggctccatattatttttgcctggggcaaaatgatgtatcttctgtatttagcttttaaaattagtgaaacaaatggcattatttattaaaattctactcaggataacagga

SEQ ID NO: 181914 - DNA, 2205 bp, Homo sapiens
  Payload ID: 15818
  Gene Symbol: SIX2
  Gene Name: SIX homeobox 2
  Uniprot ID: Q9NPC8
  ENST ID: ENST00000303077
  CDS Start-End: 321-1196
acgggagggagaacgagtgagaagcgagcgagggaacggcgggcgggcgcggagcatgcggagcggcgccccgggcggcccccgggcttgggcgagggcttgggccaggcgcgcgggccgttggggttcggagcttcgtgggacccgcggccggcgcggggacgtacggcagtgactcggggctcaccgggggccagtgccgggccagggggccagccccgcccgcgtctcggcccggacggcccggcgaggaagctcccatgcgggaccgcgcggcccggtgagggcgcgcgcgggcgggcggggacgcagccggcaccatgtccatgctgcccaccttcggcttcacgcaggagcaagtggcgtgcgtgtgcgaggtgctgcagcagggcggcaacatcgagcggctgggccgcttcctgtggtcgctgcccgcctgcgagcaccttcacaagaatgaaagcgtgctcaaggccaaggccgtggtggccttccaccgcggcaacttccgcgagctctacaagatcctggagagccaccagttctcgccgcacaaccacgccaagctgcagcagctgtggctcaaggcacactacatcgaggcggagaagctgcgcggccgacccctgggcgccgtgggcaaataccgcgtgcgccgcaaattcccgctgccgcgctccatctgggacggcgaggagaccagctactgcttcaaggaaaagagtcgcagcgtgctgcgcgagtggtacgcgcacaacccctacccttcaccccgcgagaagcgtgagctggcggaggccacgggcctcaccaccacacaggtcagcaactggttcaagaaccggcggcagcgcgaccgggcggccgaggccaaggaaagggagaacaacgagaactccaattctaacagccacaacccgctgaatggcagcggcaagtcggtgttaggcagctcggaggatgagaagactccatcggggacgccagaccactcatcatccagccccgcactgctcctcagcccgccgccccctgggctgccgtccctgcacagcctgggccaccctccgggccccagcgcagtgccagtgccggtgccaggcggaggtggagcggacccactgcaacaccaccatggcctgcaggactccatcctcaaccccatgtcagccaacctcgtggacctgggctcctagaacccatttgccttgatgagcttgccttttgtgacttgacactggggacgtggagtggcggtgtccaggggcgccccgcccctgcggccccaccaggtactgaaagacccgcaggctgagcgggtagaacagccgggtagggcagatagctgtctatgttggttcttgtttgggatttattttcaacaagttacttttaggatccttttggggctggagactgagtcttgaaccacagaagggaataaattatacaccactgtcattctctctctccctctgtctcttccttttaccctctcttgtcttgccttttccccctttcctcttcctttcccttccttctcttttcttttttctgctttctgtctttctccctctccttgtattgctttccttctagatttctagcttgccaccgttcattctctccttctgtctctccctttctctctccttctctgtttctcctctcttctctcctgccagtctcttgtactctgtgtcctggtccctccgtatgtacccctgtctttctcctcctgactggtggtctatctgcccctacctctggccctcgctttaccggagtagggggtgggagagggaagaggagagaaaatacagggactttgaacctaggccatctcctgaggccttttccctcgcccatgtgggtcagtgggagctgcaggtgtcagcttttcgtctagtaacttaagtgagagagaaagggcagcgccacagaagcccctaaacgccgcctcgtcatacgcccctcctccttctctcttggcgaggccccgccacaccgcgctcttcctcccgggactgtgactacagcgctcccggctgagcgcgccccccgagccgccgacttgccgtctccccgtaatgccctcatgtgaatgttcttcgggaaatatttctgcttttattttataataaaattagaaatcataaatatataaatggttatatgccacaaggcccgcgggccgggagtgca

SEQ ID NO: 181915 - DNA, 2523 bp, Homo sapiens
  Payload ID: 15819
  Gene Symbol: SIX3
  Gene Name: SIX homeobox 3
  Uniprot ID: O95343
  ENST ID: ENST00000260653
  CDS Start-End: 208-1206
gcgggtgtgtgtgtgtgtggatgtgtgtggggtgtgggtgtcccttacgcccttcctcctctccctcctcctcctgctcccccctcctttccttctcctcctcccccctctcctctccctcctcctggtcctcatcgcccctctcctcctcttcctcccctctctcttcctctccctgaattttctcctctcctctcaggtcagtccatggtattccgctcccccctagacctctattcctcccacttcttgttgccaaacttcgccgattctcaccaccgctccatacttctggcgagtagcggcggcgggaacggtgcgggaggcggcggcggcgcgggaggcggcagcggcggcgggaacggtgcgggaggcggcggtgctggcggagcaggcggcggcggcggcggcggctccagggcccccccggaagagttgtccatgttccagctgcccaccctcaacttctcgccggagcaggtggccagcgtctgtgagacgctggaggagacgggcgacatcgagcggctgggccgcttcctctggtcgctgcccgtggcccccggggcgtgcgaggccatcaacaaacacgagtcgatcctgcgcgcgcgcgccgtggtcgccttccacacgggcaacttccgcgacctctaccacatccttgagaaccacaagttcaccaaggagtctcacggcaagctgcaggccatgtggctcgaggcgcactaccaggaggccgagaagctgcgcggccgcccactcggcccggtggacaagtaccgcgtgcgcaagaagttcccgctgccacgcaccatctgggacggcgagcagaagacgcattgcttcaaggagcggactcggagcctgttgcgggagtggtacctacaggacccctaccccaaccccagcaagaaacgcgaactggcgcaggccaccggcctcactcccacacaagtaggcaactggtttaagaaccggcggcagcgcgaccgcgccgcggcggccaagaacaggctccagcaccaggccattggaccgagcggcatgcgctcgctggccgagcccggctgccccacgcacggctcggcagagtcgccgtccacggcggccagcccgaccaccagcgtgtccagcctgacggagcgcgcagacaccggcacctccatcctctcggtaacctccagcgactcggaatgtgatgtatgatagccaaggccgccctcctccctctccttcccctcctcccccactccttcccctccgcctcctagccctcctcctcttcctcctcttccttctcctcctccatccccagaacaaaccgaaatcaggatacccaaccatacacacatacaagtccacacacactcccaccccagccaaaaatatataaaaaacaagaaaataacaaattaaccgcaaactatcaacaacccccaaccaccatctaccactacggccaccccaaaggaccccgacgccaacagacagtcaaacgctgatgttgcgggcagaaaacataaaagaggtgacaattgtatactttctaggacaagcacggcttctcctttcggttcccatggacccggcaccccacctgcatgacgatttatttgtatctgggaaaatattctctctagttaaaaatgatttaaagagtcgactatacaaaaatcaatcaccaccacgaggacaagagggcaaaagcaaaacagacaaaaagaaaaaaaatcgccgtctccgttccgaatttgttaaaaaaaaaaaaaaaaaaaaaaaaaaggacagggggaaaaaaaaaaaaaaagaactcctggagagggaaatagcaaatgtgtcttgccttttgttgctctctctctctttttttttctctcgctctctttctttctcttcttctctctgtttttaagtcaagtattggtcaaaaaaatgcaatcttctgttttttgttcagcagacaatcattttcttcgtaagcacctttttctctccactctgtcactgcctgtgtgggtactggttataaatgtggaaaaagaatagttatgactgtaacagatttttatttttatttcaaaattttatatgaattatgtatatcttaatgatcggtcattttcccagtttgtaatatatgtgtagaaattgcctgtatatgatattgctttttctcctctccctttctctttctctcctctccctctctctgtctttctccccgctcaactgtctcttttctttttggggttctcctcccactcggtgctcctggtgtcgacttggcagtcaaggagaggcatggtggcctgggttaggaagagggaccctgtcgctagcaaaagcggagagtgagattgtagtattcttatgcaaaagctatttccagtatttcttagcagcttcagaggtatctctcactccctgtagggcgcttttactgttatcttaaactgcgtgtttatctatatgtaaaaactttctaaagcaaatacagtattctccattttcttatcactccca

SEQ ID NO: 181916 - DNA, 6285 bp, Homo sapiens
  Payload ID: 15820
  Gene Symbol: SIX4
  Gene Name: SIX homeobox 4
  Uniprot ID: Q9UIU6
  ENST ID: ENST00000216513
  CDS Start-End: 61-2406
ggaaagaaagaggaaaagagtgcgagggagtgagggagggaggaaaataaacaacaaaaaatgtcctcttcctcccccaccgggcagatcgcaagtgcggcggacatcaagcaagagaatgggatggaaagcgcctcggaagggcaggaggcgcaccgagaagtggcggggggcgcggcggtagggctgagccccccggctccagccccttttcccctggagccgggggacgccgcgaccgctgccgccagggtgagcggagaggaaggggcagtggcggcggcggcggccggagcggcggcggatcaggtacaactccactcggaacttctgggcaggcaccaccacgccgccgccgccgccgcgcagaccccgctggccttctcgcccgaccacgtcgcctgcgtgtgcgaggcactgcagcaggggggcaacctggaccgcctggcccggttcctgtggtccctgccccagagcgacctgctacgtggcaacgagagcctgctgaaggcgcgggcgctcgtggccttccaccagggcatctaccccgagctctacagcatcctcgagagccacagcttcgagtcggccaaccacccgctgctgcagcagctctggtacaaggcgcgctacaccgaggccgagcgagcccgcggccggccgctgggagccgtagacaagtaccggctgcgcaggaaattccccctgccccgcaccatctgggacggcgaggagacggtgtattgtttcaaggagaagtcgcgcaacgcgctcaaggagctctacaagcagaatcgctacccttcgcccgccgagaagcggcacctggccaagatcaccggcctctccctcacccaggtcagcaactggttcaagaaccgccggcagcgcgacaggaacccctccgagacccagtccaaaagtgagtcagatggcaaccccagcactgaagatgaatccagcaagggacatgaggatttatctcctcacccactctccagttcatctgatggcatcaccaacctcagcctttccagtcatatggagccagtatatatgcaacaaattggaaatgctaagatatcattaagctcttctggagttctgttgaatggaagcttggtacctgcaagtacttcacctgtcttccttaatggaaattcttttattcagggacccagtggagttatccttaatggattaaatgtgggaaatacacaggcagtggcattgaacccaccaaaaatgtcatcaaacattgtgagcaatggtatatccatgactgacatactggggtctacttcccaggacgtgaaggaattcaaagtcctccagagttctgctaactcagcaaccaccacgtcctacagccccagtgtccctgtctcattcccaggcctgatacccagcactgaggtgaaaagagaaggcattcaaacagtggcttcccaagatggagggtctgtagtgacttttactacaccagtgcaaattaaccagtatggcattgtccagatccccaattccggagcaaacagccagttccttaatgggagcattggattctctccactgcagctgccccctgtgtcagtggcagcttcacaaggtaatatctcagtaagctcaagcacttcagatggaagcacatttacaagtgagtctaccacagtccagcaaggaaaggttttcttgagctctcttgctcccagtgcagtggtatacacggttcctaatacaggccagactataggatctgtgaaacaggaaggcttggaaaggagcctggtattttctcagttgatgcctgtcaatcagaatgcacaagtaaatgcaaacctgtcttctgaaaacatctcggggagtggcctgcatccactggcctcctcattagttaatgtatctccaactcacaatttttctctcagtccctctacactactaaatcccactgagctaaaccgcgacattgccgatagccaaccaatgtctgcaccggtggcaagcaaatctactgtgacatctgtcagcaacactaactatgcaactcttcagaactgctcccttattactggtcaagacctattgtcagtccctatgactcaggctgcccttggggaaatagttcctacagctgaagatcaggtaggtcacccctccccagcagtacatcaggattttgtccaagaacatcgtttggttctgcaatcggtagctaacatgaaagagaatttcttatcaaattctgagagcaaagcaacaagtagcttaatgatgctggactctaaatccaagtatgtcttagatggcatggttgatactgtctgtgaagacctggaaacagacaaaaaagagcttgccaagctccagactgtccagctggatgaagatatgcaagacttatgaactttatttcctcctcacctctttttggcatcagcggcaaatcttttcatgaagccccaaggacacaaaacattttcccatttaaaggaaaacactctagttttgcaagtatatgcatacaagagactttagattgatctgcatgaagatcacagttaagtatacaggagtagaactgcattattgcagcctttttgttcacttataaatttctcttttaaatagatggagacaaaggacaaggtgaaatgtatcaagtcaaagtgaatcatttagttgactctataattctaaggtcaaaatggaacttgatagttttttaaattaaaaaatgtatacacctaacatagaaaattaaagatagctgcagaccattagaaataatacaattgtttttgtttacttttactccatgggcattgaaaaggttaagaaacataaatggtacatatttttaaagttaagtagcatgcatatatatatgcacacacacctctttttcagcattttttgagaaagtcttgggtctcaaacacatttgtctcaacacatttccaaatgtgatttctaatagctcagtgtggctgagaaagtgcggaactccactaaaaactctgaaacttcagtataaatgtaaatatatcagttctataagcaggatttgagtaattacagtgaattttatttttaatgtatatgtttctcttcaggcgctatgaactgaaaaatatgttttcttactgtttaatttatttttattgtttgaacaggaagtgaacatagtcgtttccaacaaagttttactttttgtaggattttaaaaataatgatttttaccaggaatctattaaggtcaatattaataacactgaaacaggaaatctaactcccaatattggaattttggtactttttttcacatccttgttctttatttagcaactctgattcatttaaatatgttttttatagaattctatgtgcctttttacctcgtggcctttttattggtagtaaggtacagaagtgtcaacagaagcactgatggttcttttctactatctaacagggttaatttcaccacaaaattgctttaaatctgaagaacttaagtttcactaaataatatatatgacatttatcacacaaatggataaacaactaattattgttgatacttttcattacaaggaaaataagttataaataccatgtcaaattgattatacaggctatgaaaaccattttaaaggaaagaaaatatgtaaattctattgagcaaaattctgtcctgttgaaacttagttctaaaggttttgaatcagttgttacactctgacacatgactgttgtttgcactatattatcatgtcttctttaaaagtaaatatttttggtttctgtaagaagcttgtttaataatgttgtaagccgtggctatagttttatcaagactctgaacacaagatgtaacaatgcaaataaatttatgtagtgagtaaagttgctctctagtctctgaaaagcaaaaaaagtgagaaaataatttcttcagagataacttcaagttgttgaacataaaggtgttagatgttagcacatcttgctttttttttttttttgagatggagtctcgctctgttgcccaggctggagtgcagtggcacgatcttggctcactgcaagctctgcctcctgggttcacgccattctcctgcctcagcctcccgagtagctgggactacaggcacctgccaccatgcccggctaaatttttgtatttttagtagagacggggtttcaccgtgttagccaggatggtcttgatctcctgacctcgtgatctgcccgcctcggcctcccaaagtgctgggattataggcatgagccactgtgcctggccacatcttgcttttttttttatgatcagaacaaagggcccactctagttctctacatgtcaatcaatcaagcatgttgaataagggacatagaggatttaacttttgttatcataaatggaacttgcaggcatatatcaagaaccctatgaagaattcctctcccatcattttgataaagaactacatcatttttgatagaattggtgaatgttcctaaactgctgaagctacatgttttttgttttgttttacaaagtcaggtgtttgagagttcttttccactctactactactcatagagcttgttttttctttgggtgtgtgctgatcctgttactgagattaattacatggctctgcagtgtagtttacataaaaatgatgttttccacttgattgctgcagatatcaagagtttgttattttcaaatacccatccaacaagagagatggggaggtttttagttatatatgctatatatatatatataactggaaatgttttatatgttttccgaaaatacaataagcctctcttttattcagtgttcttcctcttttctcccttatgaaaaagaaaagatagcacaaaacttaagacttacctaggaaacccattcatattcccaccatgatgtaattataaccctacaattacttcaggtagctacacaatataccaggtaagaatcaatgcacagtataaagaacttattgttcttttctattctttcagttgaataagggccagttggtatgcagcccatgtatatgtgaatggagtaagataaaccccatgatctccttgcacagaattgcaaatgtcttttgccataccaagggccagactcagaacccttggagtcatgtggcagaatttccctcttacataaaccaatgcttgaaaatgctgcaaatgaccctctaatgatccctgaagatcaaaacaggggtaaatgactccctgcaaaacccaacccatgctgctggctgtgggatttttggtgtaagcctatctatgcactctatcagccagaatttggcatttagctcttagttaaatctagtaaaggacagtctattgtttaaagagaaggtgcatttgttcctcaatcaagcaagagcacctgtgttgtactgctttatatctcatgtatatttatagtaatgaaaagactttttaaattgtacacgtttcagtgcctttcttgtgttatgaaaggcaggtagatattatagccataggtaaaaatccatagttaaattgcacactgaccttaaatctctctgtgtatgcccttgtatcttgcatgttaaaagttggattattgggcatgtgtggcagcctgccctgctacatgctagacaagtgtgctttagtacatagccacaagttcttcattctttaaaatgttttgacagatcatctcataataaaaataattcaggaaaactatggggaaatagttacatttcacaaaagatattttaaactctttgtaaaacttagataatagagcctagcagttactttgtatctaattgatacattttatgttaatttaccaccatacattttattaatcaaaattgtatagcatgtgactcttttggctttcagagttctcaaaaatattattttgttgcatgtactgtatgtttagaggcaaccaattatatactcaatatggttttactgtgccttacacaaagagaaactctatacagaatgtatatcatggggtggggtaacagagtctttactgcactgttaggtgatggcacacagagcatgtcccagaacatttctgtgcttaattacccaaccaaagagatctgaagtatgtatgtcgtactgtaatgggggtttatgcctggacaattaagtgttttatttgttttctgaaatgatgtgaacttatttttctaaacactatgctaaataaactttatatttatacataccttgcattga

SEQ ID NO: 181917 - DNA, 1573 bp, Homo sapiens
  Payload ID: 15820
  Gene Symbol: SIX4
  Gene Name: SIX homeobox 4
  ENST ID: ENST00000556952
  CDS Start-End: 91-1573
atatagtatgcagcaaccggaggagtcacgttgggggaacggcagaaagcagctatccgtttacactactttgctctaacagctatcttaatgatcgcaagtgcggcggacatcaagcaagagaatgggatggaaagcgcctcggaagggcaggaggcgcaccgagaagtggcggggggcgcggcggtagggctgagccccccggctccagccccttttcccctggagccgggggacgccgcgaccgctgccgccagggtgagcggagaggaaggggcagtggcggcggcggcggccggagcggcggcggatcaggtacaactccactcggaacttctgggcaggcaccaccacgccgccgccgccgccgcgcagaccccgctggccttctcgcccgaccacgtcgcctgcgtgtgcgaggcactgcagcaggggggcaacctggaccgcctggcccggttcctgtggtccctgccccagagcgacctgctacgtggcaacgagagcctgctgaaggcgcgggcgctcgtggccttccaccagggcatctaccccgagctctacagcatcctcgagagccacagcttcgagtcggccaaccacccgctgctgcagcagctctggtacaaggcgcgctacaccgaggccgagcgagcccgcggccggccgctgggagccgtagacaagtaccggctgcgcaggaaattccccctgccccgcaccatctgggacggcgaggagacggtgtattgtttcaaggagaagtcgcgcaacgcgctcaaggagctctacaagcagaatcgctacccttcgcccgccgagaagcggcacctggccaagatcaccggcctctccctcacccaggtcagcaactggttcaagaaccgccggcagcgcgacaggaacccctccgagacccagtccaaaagtgagtcagatggcaaccccagcactgaagatgaatccagcaagggacatgaggatttatctcctcacccactctccagttcatctgatggcatcaccaacctcagcctttccagtcatatggagccagtatatatgcaacaaattggaaatgctaagatatcattaagctcttctggagttctgttgaatggaagcttggtacctgcaagtacttcacctgtcttccttaatggaaattcttttattcagggacccagtggagttatccttaatggattaaatgtgggaaatacacaggcagtggcattgaacccaccaaaaatgtcatcaaacattgtgagcaatggtatatccatgactgacatactggggtctacttcccaggacgtgaaggaattcaaagtcctccagagttctgctaactcagcaaccaccacgtcctacagccccagtgtccctgtctcattcccaggcctgatacccagcactgaggtgaaaagagaaggcattcaaacagtggcttcccaagatggagggtctgtagtgacttttactacaccagtgcaaattaaccagtatggcattgtccagatccccaattccggagcaaacagccagttccttaatgggagcattggattct

SEQ ID NO: 181918 - DNA, 3318 bp, Homo sapiens
  Payload ID: 15821
  Gene Symbol: SIX5
  Gene Name: SIX homeobox 5
  Uniprot ID: Q8N196
  ENST ID: ENST00000317578
  CDS Start-End: 383-2602
gcagaagctcagtctcggggcggaggcttcgcgcccttagtcctcctggacggcccgttaccttctgcgttgtcccgatggggaaactgaggccctgagccagaagcacacgctggggggaggcagaaagcgcggccagaggcggagggaaaacaaagggagaatcacagacagacgggagggggacggacacacacaaggggacagagacccgagtggagagctggatctcgccttcccggcgtggggcgcagggtcggccagaaagaagatcgagaagagcggggagtgggggcgaaaaggggggacaggtgggggaggaggctggggaaagcccgagggaggaagagagggagggaggaacttcccaaagttgcaaaacatggctaccttgcctgcggagccgagcgcggggccggcggctgggggggaggcggtggcggcggcggcggcgaccgaagaggaggaggaggaagcgcgccagctcttgcagactttgcaggcggccgagggtgaggcggcggcggcggccggggccggggcgggcgcagcggctgcgggagctgagggcccgggatccccgggcgtccccgggtcgccccccgaggccgcttccgaaccgcccacgggcctccgcttctcgcccgagcaggtggcgtgcgtctgcgaggcgctgctccaggcgggccacgccggccgcttgagccgcttcctgggcgcactgcccccggccgagcgcctacgtggcagcgacccggtgttgcgcgcgcgggccctggtggccttccagcggggcgagtacgccgagctctaccggctactcgagagccgccccttccccgccgcccaccacgccttcctgcaggacctctacctgcgcgcgcgctaccatgaggccgagcgggcccgcggccgcgcgcttggcgcagtggacaagtatcgactgcgcaagaagttcccgctgcccaagaccatctgggacggcgaggagacagtctactgcttcaaggagcgctcccgcgcagcgctcaaggcctgctaccgcggcaaccgctaccccacgccggacgagaagcgccgcctggccacactcaccggcctgtcgctcacgcaggtcagcaactggttcaagaaccggcgacagcgcgaccggaccggggccggaggcggcgcgccctgcaagagcgagtctgatgggaatcccacgactgaggacgagtccagccgaagtcctgaggacctggagagaggggcggccccagtgtccgccgaggccgctgcccagggctccatattcctggcagggaccggccctcccgcgccttgcccggcttcctcctccatcctggtgaacgggagcttcctggcagccagcggctccccagcagtgctcctcaacgggggccccgtcatcatcaacggcctggccctgggcgaggcctccagcctgggcccgctgctgctcactgggggcgggggtgcccctccaccgcagcccagccctcagggggccagcgagaccaagacctctctggtcctggaccctcagacaggggaggtgcggctggaggaggctcagtcggaggcccctgagaccaaaggggcccaggtggctgctccgggaccagcccttggagaggaggtcctggggcccctggcccaagtggtgcctggccccccgacggctgccacctttcctctgcccccggggccagtgcctgctgtggctgccccacaagtggtaccgctctccccacccccggggtatcccacgggcctgagccccacctccccactattgaacctgccccaggtagtacccacctcacaggtggtgaccctgccccaggctgtggggcccctgcagctgttggcagccgggccaggcagccctgtgaaggtggcagctgcagcaggccctgccaatgtgcacctcatcaactccggggtgggcgtgactgccctgcagctgccttcggccactgccccaggaaacttcctcctggccaaccctgtgtctggcagccccatcgtgacgggtgtggccctgcagcagggcaagatcatcctcaccgccaccttccccaccagcatgctcgtctcccaggtcctgccgccagcccccggcctggccctgccactgaagccagagacggccatctccgtgcctgagggaggcctcccggtggcccccagccctgctctcccagaggctcacgccctaggcaccctttctgcacagcagccaccccccgccgctgccaccacctccagcaccagcctgcccttctcccctgactcccctggcctcctgcccaacttcccggcgcccccaccagaggggctgatgttgtcacccgcggccgtgcctgtctggtcagcagggctggaactaagcgcaggaacagaggggctgctggaagcggaaaaggggctggggacacaggccccccacaccgtgctgaggctgccagaccccgaccctgaggggctgctcctgggggccaccgcagggggtgaggttgacgaggggttggaagctgaggccaaggttctgacccagctccagtcggtgcctgtggaggagcccttggaactgtgacccagtgtggccccgtggcctctcccgacattggtgctgaagacgcagggacaggaatgggaggggggagccccagaaatgcggttgctgaagaccccagtcaccacatccttctgcctgggtggcctctccaagccctggtggtgctgggggttgtatccccggccacctcctgtccaggtctccatccccctttggatgggaggcctctctgttacagccctccccatgctgtgccctgccatatacgtgggggactcagggtcctgactcaggggccctgccccctccacttggtactagctgtaagcggaacaccctgccccagggccggacttccagcccccagagccctctccctgtcactccctgaaacactattaatagctctgccgatagctggtgttgtcacaactgcctggaatccgaaggtggaggacaggcagccccgcgcccctgagactggagaccctccccagtgtggcatttcctgccaggggcggggggtggggcagctgtggggagacgggggtcttccttcaccagctcccctcgactcaagcccttgtcctcattatccggcccagaccaaagattccctcatccctgggggcagccctgccgctgtgtctcctttgtatcctaaatctttatttttctaggacatgttatgcctccattttcaattaaaataaagttatcggattacaccacca

SEQ ID NO: 181919 - DNA, 1975 bp, Homo sapiens
  Payload ID: 15821
  Gene Symbol: SIX5
  Gene Name: SIX homeobox 5
  ENST ID: ENST00000560168
  CDS Start-End: 12-221
agttgcaaaacatggctaccttgcctgcggagccgagcgcggggccggcggctgggggggaggcggtggcggcggcggcggcgaccgaagaggaggaggaggaagcgcgccagctcttgcagactttgcaggcggccgagggtcagcaactggttcaagaaccggcgacagcgcgaccggaccggggccggaggcggcgcgccctgcaagagcgagtctgatgggaatcccacgactgaggacgagtccagccgaagtcctgaggacctggagagaggggcggccccagtgtccgccgaggccgctgcccagggctccatattcctggcagggaccggccctcccgcgccttgcccggcttcctcctccatcctggtgaacgggagcttcctggcagccagcggctccccagcagtgctcctcaacgggggccccgtcatcatcaacggcctggccctgggcgaggcctccagcctgggcccgctgctgctcactgggggcgggggtgcccctccaccgcagcccagccctcagggggccagcgagaccaagacctctctggtcctggaccctcagacaggggaggtgcggctggaggaggctcagtcggaggcccctgagaccaaaggggcccaggtggctgctccgggaccagcccttggagaggaggtcctggggcccctggcccaagtggtgcctggccccccgacggctgccacctttcctctgcccccggggccagtgcctgctgtggctgccccacaagtggtaccgctctccccacccccggggtatcccacgggcctgagccccacctccccactattgaacctgccccaggtagtacccacctcacaggtggtgaccctgccccaggctgtggggcccctgcagctgttggcagccgggccaggcagccctgtgaaggtggcagctgcagcaggccctgccaatgtgcacctcatcaactccggggtgggcgtgactgccctgcagctgccttcggccactgccccaggtacccccatctccctccctcaggcctaggtgagagccggggaggggtgcagtcatctcggagagggaggggctgtccctgggctcctggagggcatctcatccctggcaagtcccagtgccccaaggcccaccacaaggctccctccgcccgccctccagctgcacagtctccacttctctctggcttggcctgctctcctggctctcacctgcgctcggtccctctctccccacaggaaacttcctcctggccaaccctgtgtctggcagccccatcgtgacgggtgtggccctgcagcagggcaagatcatcctcaccgccaccttccccaccagcatgctcgtctcccaggtcctgccgccagcccccggcctggccctgccactgaagccagagacggccatctccgtgcctgagggaggcctcccggtggcccccagccctgctctcccagaggctcacgccctaggcaccctttctgcacagcagccaccccccgccgctgccaccacctccagcaccagcctgcccttctcccctgactcccctggcctcctgcccaacttcccggcgcccccaccagaggggctgatgttgtcacccgcggccgtgcctgtctggtcagcagggctggaactaagcgcaggaacagaggggctgctggaagcggaaaaggggctggggacacaggccccccacaccgtgctgaggctgccagaccccgaccctgaggggctgctcctgggggccaccgcagggggtgaggttgacgaggggttggaagctgaggccaaggttctgacccagctccagtcggtgcctgtggaggagcccttggaactgtgacccagtgtggccccgtggcctctcccgacattggtgctgaagacgcagggacaggaatgggaggggggagccccagaaatgcggttgctgaagaccccagtcaccaca

SEQ ID NO: 181920 - DNA, 1809 bp, Homo sapiens
  Payload ID: 15821
  Gene Symbol: SIX5
  Gene Name: SIX homeobox 5
  ENST ID: ENST00000560160
  CDS Start-End: 1-767
cccccgaggccgcttccgaaccgcccacgggcctccgcttctcgcccgagcaggtggcgtgcgtctgcgaggcgctgctccaggcgggccacgccggccgcttgagccgcttcctgggcgcactgcccccggccgagcgcctacgtggcagcgacccggtgttgcgcgcgcgggccctggtggccttccagcggggcgagtacgccgagctctaccggctactcgagagccgccccttccccgccgcccaccacgccttcctgcaggacctctacctgcgcgcgcgctaccatgaggccgagcgggcccgcggccgcgcgcttggcgcagtggacaagtatcgactgcgcaagaagttcccgctgcccaagaccatctgggacggcgaggagacagtctactgcttcaaggagcgctcccgcgcagcgctcaaggcctgctaccgcggcaaccgctaccccacgccggacgagaagcgccgcctggccacactcaccggcctgtcgctcacgcaggtcagcaactggttcaagaaccggcgacagcgcgaccggaccggggccggaggcggcgcgccctgcaagaggaaacttcctcctggccaaccctgtgtctggcagccccatcgtgacgggtgtggccctgcagcagggcaagatcatcctcaccgccaccttccccaccagcatgctcgtctcccaggtcctgccgccagcccccggcctggccctgccactgaagccagagacggccatctccgtgcctgagggaggcctcccggtggcccccagccctgctctcccagaggctcacgccctaggcaccctttctgcacagcagccaccccccgccgctgccaccacctccagcaccagcctgcccttctcccctgactcccctggcctcctgcccaacttcccggcgcccccaccagaggggctgatgttgtcacccgcggccgtgcctgtctggtcagcagggctggaactaagcgcaggaacagaggggctgctggaagcggaaaaggggctggggacacaggccccccacaccgtgctgaggctgccagaccccgaccctgaggggctgctcctgggggccaccgcagggggtgaggttgacgaggggttggaagctgaggccaaggttctgacccagctccagtcggtgcctgtggaggagcccttggaactgtgacccagtgtggccccgtggcctctcccgacattggtgctgaagacgcagggacaggaatgggaggggggagccccagaaatgcggttgctgaagaccccagtcaccacatccttctgcctgggtggcctctccaagccctggtggtgctgggggttgtatccccggccacctcctgtccaggtctccatccccctttggatgggaggcctctctgttacagccctccccatgctgtgccctgccatatacgtgggggactcagggtcctgactcaggggccctgccccctccacttggtactagctgtaagcggaacaccctgccccagggccggacttccagcccccagagccctctccctgtcactccctgaaacactattaatagctctgccgatagctggtgttgtcacaactgcctggaatccgaaggtggaggacaggcagccccgcgcccctgagactggagaccctccccagtgtggcatttcctgccaggggcggggggtggggcagctgtggggagacgggggtcttccttcaccagctcccctcgactcaagcccttgtcctcattatccggcccagaccaaagattccctcatccctgggg

SEQ ID NO: 181921 - DNA, 1401 bp, Homo sapiens
  Payload ID: 15821
  Gene Symbol: SIX5
  Gene Name: SIX homeobox 5
  ENST ID: ENST00000622857
  CDS Start-End: 210-686
gacgggagggggacggacacacacaaggggacagagacccgagtggagagctggatctcgccttcccggcgtggggcgcagggtcggccagaaagaagatcgagaagagcggggagtgggggcgaaaaggggggacaggtgggggaggaggctggggaaagcccgagggaggaagagagggagggaggaacttcccaaagttgcaaaacatggctaccttgcctctgaagccagagacggccatctccgtgcctgagggaggcctcccggtggcccccagccctgctctcccagaggctcacgccctaggcaccctttctgcacagcagccaccccccgccgctgccaccacctccagcaccagcctgcccttctcccctgactcccctggcctcctgcccaacttcccggcgcccccaccagaggggctgatgttgtcacccgcggccgtgcctgtctggtcagcagggctggaactaagcgcaggaacagaggggctgctggaagcggaaaaggggctggggacacaggccccccacaccgtgctgaggctgccagaccccgaccctgaggggctgctcctgggggccaccgcagggggtgaggttgacgaggggttggaagctgaggccaaggttctgacccagctccagtcggtgcctgtggaggagcccttggaactgtgacccagtgtggccccgtggcctctcccgacattggtgctgaagacgcagggacaggaatgggaggggggagccccagaaatgcggttgctgaagaccccagtcaccacatccttctgcctgggtggcctctccaagccctggtggtgctgggggttgtatccccggccacctcctgtccaggtctccatccccctttggatgggaggcctctctgttacagccctccccatgctgtgccctgccatatacgtgggggactcagggtcctgactcaggggccctgccccctccacttggtactagctgtaagcggaacaccctgccccagggccggacttccagcccccagagccctctccctgtcactccctgaaacactattaatagctctgccgatagctggtgttgtcacaactgcctggaatccgaaggtggaggacaggcagccccgcgcccctgagactggagaccctccccagtgtggcatttcctgccaggggcggggggtggggcagctgtggggagacgggggtcttccttcaccagctcccctcgactcaagcccttgtcctcattatccggcccagaccaaagattccctcatccctgggggcagccctgccgctgtgtctcctttgtatcctaaatctttatttttctaggacatgttatgcctccattttcaattaaaataaagttatcggattacaccacc

SEQ ID NO: 181922 - DNA, 2787 bp, Homo sapiens
  Payload ID: 15822
  Gene Symbol: SIX6
  Gene Name: SIX homeobox 6
  Uniprot ID: O95475
  ENST ID: ENST00000327720
  CDS Start-End: 449-1189
gacactcgcatgtcttttcaacctccaggttctgcaaaatactgaagaaaagtccaggagctaacggcgggcgctgtcgagcacggggaggtgctgaaatagtcctggcgtgctgattcaagctttgattggcagagccacccggtgactgacagggggtctccatggcgcccgcgccgccaatccgcccaccccaatagcggagccagctcgcctgccggcgtgcctgagccgagccgagcccgaaccccaagccgcggagccagcacctcctccagtcggggtcgtccgctcccggccgttgagccaccgccgccacccggtagtgtgtcccgctgccccaatccgcctcatcaacaagcgcctggcacactcagccaggcccgcgggcatctgctgcgtgtcccgctccgggctcagtgccctcgccgccgccggcactgcctcgatgttccagctgcccatcttgaatttcagcccccagcaagtggccggggtatgtgagaccctggaagagagcggcgatgtggagcgcctgggtcgcttcctctggtcgctgcccgtggcccctgcggcctgcgaggccctcaacaagaatgagtcggtgctacgcgcacgagccatcgtggcctttcacggtggcaactaccgcgagctctatcatatcctggaaaaccacaagttcaccaaggagtcgcacgccaagctgcaggcgctgtggcttgaagcacactaccaggaggctgagaagctgcgtggaagacccctgggacctgtggacaagtaccgagtaaggaagaagttcccgctgccgcgcaccatttgggacggcgaacagaagacacactgcttcaaggagcgcacgcggcacctgctacgcgagtggtacctgcaggatccataccctaaccccagcaaaaaacgtgagctcgcccaggcaaccggactgacccctacgcaggtgggcaactggttcaaaaaccgccgacaaagggaccgagcggctgcagccaagaacagactccagcagcaggtcctgtcacagggttccgggcgggcactacgggcggagggcgacggcacgccagaggtgctgggcgtcgccaccagcccggccgccagtctatccagcaaggcggccacttcagccatctccatcacgtccagcgacagcgagtgcgacatctgagttgcccatccaggatgctcagaagcagattccagtgtaaaaacgagaaaaacaaaatgaaagaggggaagaagatgagagacctgcaaatccagcgccacagaagccaggtgaccagggacccgcgggctcgggttgccgtttcccgccccaccccgcggccggcctggcttcactggcgccctttggccgcgaccacgggaaccagcggtgaggcctgacccagcaccacgttcttcttgctttgctttttcctaaggattttgctgcaaagtctccttcggaacccgaactgcaagctgagcgcctgcccagattctcccatgggtatttcacgtcgaaaggacgctgttacatatgtataactttcgctttaaagtttttttttaacaaaacatatatatgctgtttatttacttatttaagagaccgccatggtaggtttctctgtagcttggggaacttgctgtttctaaacatgcaggctggtggtgatgggttctgtgtggagaagccaaacaataaaacaacctagtgggcaaccttcttaattaagggagctgctctcagattccttttcttcttattattattaatatcattcccttcaccaggcatgcagggacccttgagcaaatggtctccggaaggtcttacctatatatcttttgccttctttggtgcttcctggtatatgttttaaacaacctatggtaggtctataaccacctcccacgtcaaattacacgtatgtgcatatatgtatgtacctatacaaacatatgtatgtacctatacaaacatatgtatgtatgcatacacgtgatatatttaaggctagaaattggcaacatgtgagcgtcctctctaaggcaagtccccgcatccccagcacaggtaattatggcttgtccacttgacactcgtttacatgaagtgtcaacagctttcaggagcaatttaggaagccaaactatgggactcaataagtgagtcctattttctaaaaatgcaaaactatcctgactcaggctctgcagcaagaaaggctttctgtctccttcaaggccccctccaatacaaaagcagcaggcacccatgatcatgctagagtgagcatatactgcatttaggattgagctattattaaaataagacaaaagatgatagaagaggttgtaaataattagactaacatcttcttgctgcagaatttggttttaatcaaatgaatggtttttaacaagagggatactgagatgggggaaaggatgtaatcatgtcacatactgagggtaaaacaaggctgtagaaataactggcattttaaaaacctaatctccgaattaagcatagaacaagtcatcaagggcctcattgtcctggtaatggcctcgattaaaacataaaatatttttagcatttaatttttcctcgtgcacatgcatgtatgcacctatacatgaacaaatgcatgcatatacaacgcaaaaacatctaccatctttgcactaagaaaataaatgctagccagagtctctaattttgttcctagtgaaacagattgcatattataaaatttgacattgatctttaaa

SEQ ID NO: 181923 - DNA, 1313 bp, Homo sapiens
  Payload ID: 15823
  Gene Symbol: STEAP1
  Gene Name: six transmembrane epithelial antigen of the prostate 1
  Uniprot ID: Q9UHE8
  ENST ID: ENST00000297205
  CDS Start-End: 201-1220
gcggacgcggggcgccagcaggtggcgctggacgcgcaacggacaaggaggcggggcctgcagctggcttggaggctccgcgctctggaggctcaggcgccgcgtggggcccgcacctctgggcagcagcggcagccgagactcacggtcaagctaaggcgaagagtgggtggctgaagccatactattttatagaattaatggaaagcagaaaagacatcacaaaccaagaagaactttggaaaatgaagcctaggagaaatttagaagaagacgattatttgcataaggacacgggagagaccagcatgctaaaaagacctgtgcttttgcatttgcaccaaacagcccatgctgatgaatttgactgcccttcagaacttcagcacacacaggaactctttccacagtggcacttgccaattaaaatagctgctattatagcatctctgacttttctttacactcttctgagggaagtaattcaccctttagcaacttcccatcaacaatatttttataaaattccaatcctggtcatcaacaaagtcttgccaatggtttccatcactctcttggcattggtttacctgccaggtgtgatagcagcaattgtccaacttcataatggaaccaagtataagaagtttccacattggttggataagtggatgttaacaagaaagcagtttgggcttctcagtttcttttttgctgtactgcatgcaatttatagtctgtcttacccaatgaggcgatcctacagatacaagttgctaaactgggcatatcaacaggtccaacaaaataaagaagatgcctggattgagcatgatgtttggagaatggagatttatgtgtctctgggaattgtgggattggcaatactggctctgttggctgtgacatctattccatctgtgagtgactctttgacatggagagaatttcactatattcagagcaagctaggaattgtttcccttctactgggcacaatacacgcattgatttttgcctggaataagtggatagatataaaacaatttgtatggtatacacctccaacttttatgatagctgttttccttccaattgttgtcctgatatttaaaagcatactattcctgccatgcttgaggaagaagatactgaagattagacatggttgggaagacgtcaccaaaattaacaaaactgagatatgttcccagttgtagaattactgtttacacacatttttgttcaatattgatatattttatcaccaacatttcaagtttgtatttgttaataaaatgattattcaagga

SEQ ID NO: 181924 - DNA, 707 bp, Homo sapiens
  Payload ID: 15823
  Gene Symbol: STEAP1
  Gene Name: six transmembrane epithelial antigen of the prostate 1
  ENST ID: ENST00000412573
  CDS Start-End: 1-304
cccaatgaggcgatcctacagatacaagttgctaaactgggcatatcaacaggtccaacaaaataaagaagatgcctggattgagcatgatgtttggagaatggagatttatgtgtctctgggaattgtgggattggcaatactggctctgttggctgtgacatctattccatctgtgagtgactctttgacatggagagaatttcactatattcagattatccataagaagagtgatgtgccagaatcactctgggatccttgtctgacaagattcaaaggactaaatttaattcagtcatgaacactgccaattaccgtttatgggtagacatctttggaaatttccacaagagcaagctaggaattgtttcccttctactgggcacaatacacgcattgatttttgcctggaataagtggatagatataaaacaatttgtatggtatacacctccaacttttatgatagctgttttccttccaattgttgtcctgatatttaaaagcatactattcctgccatgcttgaggaagaagatactgaagattagacatggttgggaagacgtcaccaaaattaacaaaactgagatatgttcccagttgtagaattactgtttacacacatttttgttcaatattgatatattttatcaccaacatttcaagtttgtatttgttaataaaatgattattcaaggatc

SEQ ID NO: 181925 - DNA, 1709 bp, Homo sapiens
  Payload ID: 15824
  Gene Symbol: SSB
  Gene Name: Sjogren syndrome antigen B (autoantigen La)
  Uniprot ID: P05455
  ENST ID: ENST00000260956
  CDS Start-End: 175-1401
gctccacctcgtccgtggccctgcccacccaggccgcaagagctgccgggacggtccccatcttcttggagcgctttaggctggccggcggcgctgggaggtggagtcgttgctgttgctgtttgtgagcctgtggcgcggcttctgtgggccggaaccttaaagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaaaa

SEQ ID NO: 181926 - DNA, 1782 bp, Homo sapiens
  Payload ID: 15824
  Gene Symbol: SSB
  Gene Name: Sjogren syndrome antigen B (autoantigen La)
  Uniprot ID: P05455
  ENST ID: ENST00000409333
  CDS Start-End: 248-1474
ttttttttttttttttttttttacctccaccgccttctagtctcaccgaaggcttgtggccatctctgtaaagtttctggggaggtgggcacggggtaaacgccggagggttctgtggagcctatgggactgactggaggccaaagaactttgggccgcagatgtacaccagcgtcactcttttggtctgttagggccttcatcgctcacatcaggtttcagtgtgaaacgggaaaacatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaaaa

SEQ ID NO: 181927 - DNA, 674 bp, Homo sapiens
  Payload ID: 15824
  Gene Symbol: SSB
  Gene Name: Sjogren syndrome antigen B (autoantigen La)
  ENST ID: ENST00000413002
  CDS Start-End: 108-512
ggagcgctttaggctggccggcggcgctgggaggtggagtcgttgctgttgctgtttgtgagcctgtggcgcggcttctgtgggccggaaccttaaagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatatttctcatcctgttgctcacgttggagtgcagtggtgtgatcatggcccactgcagtcttgacctcctgggctcaagtgatcctcccacctcagcctcctgagtagctgggactacagaaaggcttcccaactgatgcaactcttgatgacataaaagaatggttagaagataaaggtcaagtactaaatattcagatgagaagaacattgcataaagcattta

SEQ ID NO: 181928 - DNA, 545 bp, Homo sapiens
  Payload ID: 15824
  Gene Symbol: SSB
  Gene Name: Sjogren syndrome antigen B (autoantigen La)
  ENST ID: ENST00000417292
  CDS Start-End: 186-545
ggagcgctttaggctggccggcggcgctgggaggtggagtcgttgctgttgctgtttgtgagcctgtggcgcggcttctgtgggccggaaccttaaagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccct

SEQ ID NO: 181929 - DNA, 2463 bp, Homo sapiens
  Payload ID: 15824
  Gene Symbol: SSB
  Gene Name: Sjogren syndrome antigen B (autoantigen La)
  ENST ID: ENST00000422006
  CDS Start-End: 1910-2463
aacagaaatgagtgcagaagacatggagaagaacgttcagaatagctttattcataacagcaaaaaactagaaacaacaaaatggtcagaaacagaagaatgggccagacgtcgtggctcactcctgtaatcccagcactttgggaggccaaggtggatggatcccttgaggtcagaagtttgaaacaagcctggccaacatggcaaaaccctgtctctacttaaaacagtacaaaaattagccatgcatggtggcaggcacctataatcccagctacttgggatattgaggcacgagaatcacttgaacccaggggggtagaggttgcggtgagccgagattgcgccactgcactctagcctgtgcaacagagtgagcctctgtctcaaaaaaaggaaaagaaatggaagaatggataaatcagttgtggtatgtgcgtataccacatgttgtggactgtttgtagttccccaaaattcatacattgacatcctaacctccagtgggatggtattaggaagtggggcctttgggaggtaataagatcatgatggtagaattctacctcatgaatgggatttagtgccttgtaagaagagactggagagtttacttcctttctgcttttcaccatgtaaggatacatgaagaagatggccatctgcaaaccaggaagcaggtcatcatgagacaccagatctaacagcatcttgatcttggacttctcagccttcaaaactgcgagcaataaatttctgttgtttaagacacccagtctatgatattttgttatagctgtccaaactgagacccagatatatacatactacatgacctagaacaggcaaagctaatcaatggtagttacttttaaggagggtattgactgagagaggagcccaaaggaactttctggagtgctgaaatgttctatatctcaatctggatggtaattacaaggtggtgttcacttgtgaaacttcattgagcacttaaaattcatgcaccttatagtttgtgtgatataattcaattaaaaaaatgtttagcccccaaaggcccttcttttctctttatctgtcacagttattttattttacatgaagtcttggtaaagaatctgtgctgttttatcaacttccatgtactgtcttctatagaagatctacttatcattttatgcatgctgatctcgtccacttgccaaatatagcaaattgacccaagtaaatttggctgttcacaattattagataatttagaggatagtggaggtcaccaattgttagacataggggtgggctctaggtctccccttaataacctcactttcatatgacttattacaatgaaggaagtttttgtagacaagattcaccttcaaacatctattagcaagaaaacacaaaagtagtcctacaatctattcccaaaattcagggagaccctagatttctggcttttaggcaatctgatattcatcttgcgcgcgcgcgtgcgcgcgcacacacacacacacacacacacacagaaatagaaaaacttagcaagcctagcagccttcagagtggtactcttggcctggagttttgatttagttgagttttctgccccttagtgatgaattctctcaattgccctaaccaaaagtctaaaatattataatcatctgccttgaataatttttcatggatttttttccccctcgcatttaaagtccaggttagaatgataagtccattctacgaagccatcagagttggtatggaactacaggatgttgggacttggcttccttctatcttgctgctttgccacacctatggtgtttccttcatttgcttggtccagttttgctcatcatccacatctagctagttgaagaaaagagaaagtgagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaa

SEQ ID NO: 181930 - DNA, 896 bp, Homo sapiens
  Payload ID: 15825
  Gene Symbol: SSNA1
  Gene Name: Sjogren syndrome nuclear autoantigen 1
  Uniprot ID: O43805
  ENST ID: ENST00000322310
  CDS Start-End: 81-440
ccgtgggggagtcgtgcgcaggcgcggacagcgctgcttccgcggcggttggggtggtggggccccgggcggcgttgaccatgacccagcagggcgcggcgctgcagaactacaacaacgagctggtcaagtgcatagaggagctgtgccagaagcgggaggagctgtgccggcagatccaggaggaggaggacgagaagcagcggctgcagaatgaggtgaggcagctgacagagaagctggcccgcgtcaacgagaacctggcacgcaagattgcctctcgcaacgagttcgaccggaccatcgcggagacggaggccgcctacctcaagatcctggagagctcccagactttgctcagcgttctcaagagggaagctgggaacctgaccaaggctacagccccagaccagaaaagtagcggcggcagggacagctgaccagaccacgggcagggcctgcctccgtgtgcccctcagctcagccccagcaagtgtgtgctcagagcatctttgttcttcacggcagcagctaccttccctcactgtctcaggtgccgagaggggcaggtgccagcctccactggcatcagtgacaagcccagggcacagcccacccgggggtcctcgcttcatgctcacacaggctatggggatggtgggctccaggtcagctctgcaaggggcttgtctctgtggcacccacactcctgccctgccagggaggctctggttgtctgagcaccatgggggccccctcaccttgtccctcctcagccagcagaggcccagggcaagggacaggaggacaggggttctccttcaccacagaacccaaacctcaggtctcacccctgtggcctgtgattatgaataaagattatctttgtaaagatc

SEQ ID NO: 181931 - DNA, 723 bp, Homo sapiens
  Payload ID: 15825
  Gene Symbol: SSNA1
  Gene Name: Sjogren syndrome nuclear autoantigen 1
  ENST ID: ENST00000464553
  CDS Start-End: 22-267
gggccccgggcggcgttgaccatgacccagcagggcgcggcgctgcagaactacaacaacgagctggtcaagtgcatagaggagctgtgccagaagcgggaggagctgtgccggcagatccaggaggaggaggacgagaagcagcggctgcagaatgagatcctggagagctcccagactttgctcagcgttctcaagagggaagctgggaacctgaccaaggctacagccccagaccagaaaagtagcggcggcagggacagctgaccagaccacgggcagggcctgcctccgtgtgcccctcagctcagccccagcaagtgtgtgctcagagcatctttgttcttcacggcagcagctaccttccctcactgtctcaggtgccgagaggggcaggtgccagcctccactggcatcagtgacaagcccagggcacagcccacccgggggtcctcgcttcatgctcacacaggctatggggatggtgggctccaggtcagctctgcaaggggcttgtctctgtggcacccacactcctgccctgccagggaggctctggttgtctgagcaccatgggggccccctcaccttgtccctcctcagccagcagaggcccagggcaagggacaggaggacaggggttctccttcaccacagaacccaaacctcaggtctcacccctgtggcctgtgattatgaataaagattatctttgtaaagatc

SEQ ID NO: 181932 - DNA, 698 bp, Homo sapiens
  Payload ID: 15826
  Gene Symbol: SSSCA1
  Gene Name: Sjogren syndrome/scleroderma autoantigen 1
  Uniprot ID: O60232
  ENST ID: ENST00000309328
  CDS Start-End: 63-662
cgcagcggagggcgctccgctttgacgtcacttcctgtgagcccggcggtgacaacggcaacatggccctgaacggagctgaagtcgacgacttctcctgggagcccccgactgaggcggagacgaaggtgctgcaggcgcgacgggagcggcaagatcgcatctcccggctcatgggcgactatctgctgcgcggttaccgcatgctgggcgagacgtgtgcggactgcgggacgatcctcctccaagacaaacagcggaaaatctactgcgtggcttgtcaggaactcgactcagacgtggataaagataatcccgctctgaatgcccaggctgccctctcccaagctcgggagcaccagctggcctcagcctcagagctccccctgggctctcgacctgcgccccagcccccagtacctcgtccggagcactgtgagggagctgcagcaggactcaaggcagcccaggggccacctgctcctgctgtgcctccaaatacagatgtcatggcctgcacacagacagccctcttgcagaagctgacctgggcctctgctgaactgggctctagcacctccctggagactagcatccagctgtgtggccttatccgcgcatgtgcggaggccctgcgcagcctgcagcagctacagcactaagagaagcccctgagaaaaaccctctagaaaaacagc

SEQ ID NO: 181933 - DNA, 713 bp, Homo sapiens
  Payload ID: 15826
  Gene Symbol: SSSCA1
  Gene Name: Sjogren syndrome/scleroderma autoantigen 1
  ENST ID: ENST00000526877
  CDS Start-End: 6-251
gcaacatggccctgaacggagctgaagtcgacgacttctcctgggagcccccgactgaggcggagacgaaggtgctgcaggcgcgacgggagcggcaagatcgcatctcccggctcatgggcgactatctgctgcgcggttaccgcatgctgggcgagacacgatcctcctccaagacaaacagcggaaaatctactgcgtggcttgtcaggaactcgactcagacgtggataaagataatcccgctctgaatgcccaggctgccctctcccaagctcgggagcaccagctggcctcagcctcagagctccccctgggctctcgacctgcgccccagcccccagtacctcgtccggagcactgtgagggagctgcagcaggactcaaggcagcccaggggccacctgctcctgctgtgcctccaaatacagatgtcatggcctgcacacagacagccctcttgcagaagctgacctgggcctctgctgaactgggctctagcacctccctggagactagcatccagctgtgtggccttatccgcgcatgtgcggaggccctgcgcagcctgcagcagctacagcactaagagaagcccctgagaaaaaccctctagaaaaacagctgttcctctgtgtggtttgtttttttcctggttccaagtgtgcatgccagccccagctccactcacctttttccagcttttggcctct

SEQ ID NO: 181934 - DNA, 806 bp, Homo sapiens
  Payload ID: 15826
  Gene Symbol: SSSCA1
  Gene Name: Sjogren syndrome/scleroderma autoantigen 1
  ENST ID: ENST00000527920
  CDS Start-End: 212-394
cggcaacatggccctgaacggagctggtgaggacctgggcggcaggggtttgtggctgtgaggtacgggaggcagcccactccggcaagacccccagtccctatgcctctcttccccagaagtcgacgacttctcctgggagcccccgactgaggcggagacgaaggtgctgcaggcgcgacgggagcggcaagatcgcatctcccggctcatgggcgactatctgctgcgcggttaccgcatgctgggcgagacgtgtgcggactgcgggacgatcctcctccaagacaaacagcggaaaatctactgcgtggcttgtcaggaactcgactcagacgtggataaagataatcccgctttgcgcgacgtggtcccacaaccgttgcctttttaagagaggcccggcccatccagagggggtggggcagaggcggagtctgaggagctggggaaggaacaaagcgaggcctgcgggcggcggctgggctccggcggggccgcggggtgcggggcctgcgggcggcggcccgggcggagcgttggagggaaggaggtggcatcgccgtccgcgccggccccggccatgaacgggctgccctcggcagaggcgccgggcggggcgggctgcgctttggccgggctcccaccgctgccgcgcggcctcagcggcctccttaatgcgagcgggggctcgtggcgggagctggagcgcgtctacagccagcgcagccgcatccacgacgagctgagccgcgccgcccgcgccccggacgggccccgccacgccgccggcgccgccaacgcgg

SEQ ID NO: 181935 - DNA, 879 bp, Homo sapiens
  Payload ID: 15826
  Gene Symbol: SSSCA1
  Gene Name: Sjogren syndrome/scleroderma autoantigen 1
  ENST ID: ENST00000531405
  CDS Start-End: 237-725
cttcctgtgagcccggcggtgacaacggcaacatggccctgaacggagctggtgaggacctgggcggcaggggtttgtggctgtgaggtacgggaggcagcccactccggcaagacccccagtccctatgcctctcttccccagaagtcgacgacttctcctgggagcccccgactgaggcggagacgaaggtgctgcaggcgcgacgggagcggcaagatcgcatctcccggctcatgggcgactatctgctgcgcggttaccgcatgctgggcgagacgtgtgcggactgcgggacgatcctcctccaagacaaacagcggaaaatctactgcgtggcttgtcaggaactcgactcagacgtggataaagataatcccgctctgaatgcccaggctgccctctcccaagctcgggagcaccagctggcctcagcctcagagctccccctgggctctcgacctgcgccccagcccccagtacctcgtccggagcactgtgagggagctgcagcaggactcaaggcagcccaggggccacctgctcctgctgtgcctccaaatacagatgtcatggcctgcacacagacagccctcttgcagaagctgacctgggcctctgctgaactgggctctagcacctccctggagactagcatccagctgtgtggccttatccgcgcatgtgcggaggccctgcgcagcctgcagcagctacagcactaagagaagcccctgagaaaaaccctctagaaaaacagctgttcctctgtgtggtttgtttttttcctggttccaagtgtgcatgccagccccagctccactcacctttttccagcttttggcctcttcacctctccactctgctctccttgacgcc

SEQ ID NO: 181936 - DNA, 1077 bp, Homo sapiens
  Payload ID: 15826
  Gene Symbol: SSSCA1
  Gene Name: Sjogren syndrome/scleroderma autoantigen 1
  ENST ID: ENST00000533115
  CDS Start-End: 1-582
gaagtcgacgacttctcctgggagcccccgactgaggcggagacgaaggtgctgcaggcgcgacgggagcggcaagatcgcatctcccggctcatgggcgactatctgctgcgcggttaccgcatgctgggcgagacgtgtgcggactgcgggacgatcctcctccaagacaaacagcggaaaatctactgcgtggcttgtcaggaactcgactcagacgtggataaagataatcccgctctgaatgcccaggctgccctctcccaagctcgggagcaccagctggcctcagcctcagagctccccctgggctctcgacctgcgccccagcccccagtacctcgtccggagcactgtgagggagctgcagcaggactcaaggcagcccaggggccacctgctcctgctgtgcctccaaatacagatgtcatggcctgcacacagacagccctcttgcagaagctgacctgggcctctgctgaactgggctctagcacctccctggagactagcatccagctgtgtggccttatccgcgcatgtgcggaggccctgcgcagcctgcagcagctacagcactaagagaagcccctgagaaaaaccctctagaaaaacagctgttcctctctttgcgcgacgtggtcccacaaccgttgcctttttaagagaggcccggcccatccagagggggtggggcagaggcggagtctgaggagctggggaaggaacaaagcgaggcctgcgggcggcggctgggctccggcggggccgcggggtgcggggcctgcgggcggcggcccgggcggagcgttggagggaaggaggtggcatcgccgtccgcgccggccccggccatgaacgggctgccctcggcagaggcgccgggcggggcgggctgcgctttggccgggctcccaccgctgccgcgcggcctcagcggcctccttaatgcgagcgggggctcgtggcgggagctggagcgcgtctacagccagcgcagccgcatccacgacgagctgagccgcgccgcccgcgccccggacgggccccgccacgccgccggcgccgccaacgcgg

SEQ ID NO: 181937 - DNA, 739 bp, Homo sapiens
  Payload ID: 15826
  Gene Symbol: SSSCA1
  Gene Name: Sjogren syndrome/scleroderma autoantigen 1
  ENST ID: ENST00000526433
  CDS Start-End: 1-323
gcatctcccggctcatgggcgactatctgctgcgcggttaccgcatgctgggcgagacgtgtgcggactgcgggacgatcctcctccaagacaaacagcggaaaatctactgcgtggcttgtcaggaactcgactcagacgtggataaagataatcccggtggggctgcggcagttggacatgtccttgttgtgccagctgtggggcctgtacgagtcaatccaggactacaaacacctgtgccaagacctgagcttctgccaggacctgtcatcctccctccattcggacagctcctacccaccggatgcgggcctgtctgacgacgaggagcctcccgatgccagcctgcctcctgacccgccaccccttactgtgccccagacgcacaatgcccgtgaccagtggctgcaggatgccttccacatcagcctctgaagggctggggggcagggggcatgcacccatgcaaaaggctcagaaactccccctccggcaagccctcagacttcggagcctgcgccttcccccctaccgcctcacctcacaggagggccaggcatgtattcctcagaggcgaaactgccaaactctttctcctgtcttgggttggctggcactggggcgggcatctagggtacagcctctgctcatggcactgggcctccagttcttccacatgtgtgcacccccagcttggccaaccctcagccttgcggtggggcccgaagcatcttcc

SEQ ID NO: 181938 - DNA, 3332 bp, Homo sapiens
  Payload ID: 15827
  Gene Symbol: SKOR1
  Gene Name: SKI family transcriptional corepressor 1
  Uniprot ID: P84550
  ENST ID: ENST00000341418
  CDS Start-End: 1-2607
atgatcccaaagagcctggtccaggcagcggaaacccagaggggtctctgcgagccaggagggaaaggaagagaggggagaagtggaggaaaaggggagacacgccccagaggagttggaacgcaggagggaaaggggaccatacccggtagcccgagggaaaaacgaggcgagaggggagaaggcgaccccgcgctgctacccgcggaagatttatggcgcctcccgggttccaaggacaggctgcgttcgtcgctgctgccaccgccgggacccccttcttctgactccgggcccggacccccctcctctcactcagggaaaaccgcgcagggacccaggaccctcaactgggccagaaagcaaagtgcaaggaccagcagcaacttgtgtgcctggagccttgcaatggctacgaagatggctgagattccttctagcccatatgagccgggacagcgaggcatgaaggatactcagagaggtgatgcccctcaaagaggaagcccagagccccgaatcctgcagttggcccgagtgggaaacgtatatctgaaggaggaaagctcaaggagtgggcgactggaagctaagaagtggatcccaacaaagttccttgagaacctctctgtcccacacgttgacctcggtggaaaccagctttggagcggcggcatggaggctctcaccactcagctggggccggggcgcgagggcagttcctcgcccaactccaagcaggagctgcagccgtactcgggctccagcgctctcaaacccaaccaggtgggcgagacgtcgctgtacggggtgcccattgtgtcgctggtcatcgacggccaggagcgcctatgcctggcgcagatctccaacaccctcctcaagaactacagctataatgagatccacaaccgccgcgtggccctgggcatcacgtgcgtgcagtgcacgccggtacagctggagattctgcgtcgggccggggccatgcccatctcgtcgcgccgctgcggcatgatcactaagcgagaggccgaacgcctgtgcaagtcgttcctgggcgagcacaaaccacccaagctgcccgagaacttcgccttcgatgtggtgcacgagtgcgcgtggggctcgcgtggtagcttcatccctgcgcgttacaacagctctcgtgccaagtgcatcaagtgcggctactgcagcatgtacttctcgcccaacaagttcatcttccactcgcaccgaacacccgacgccaagtacacgcagcccgatgccgccaacttcaactcctggcgtcgtcacctcaaactcagtgacaagtcggccacagacgaactgagccatgcttgggaggaccgcggacttggcctggcgactggagctagtggcccggcgggcccaggagggcccggtggcggcgccggcgtacgaagctacccggtgatcccggtgcccagcaaaggctttgggctcctgcaaaagctgcccccaccacttttcccccatccttacggcttccctacggccttcggcctatgccccaaaaaggacgacccggttttaggcgcgggcgagccaaagggcggctcctacgtgtcggccttccggccggtggtcaaggacaccgagagcatcgctaagctctacgggagcgcccgggaggcgtacggcgcggggcctgctcgggggccgggacccggcgctgggagcggcggctacgtgagcccggactttctgagcgagggcagctccagctacaattccgcctcgcccgacgtggacaccgcggacgagcccgaggtggacgtggaatccaaccgcttccccgacgacgaggacgcccaagaggagaccgagcccagcgcacccagcgcagggggcggcccagacgctggccggcccgcatttggggacttggcagccgaagacttggtgcggagacctgagaggagcccgccaagcggcggcggcggctacgagctgcgagagccttgcgggcccctaggaggccccgcgccggccaaggtgttcgcgcccgagagggatgagcacgtgaagagcgcggcggtggcgctggggcccgcggcctcctacgtctgcacccccgaggcccacgagccagataaggaagacaatcactcgcccgccgatgatttggaaacgaggaaatcctatccagaccaaaggagtatctcccagccaagtcctgcaaatacagacagaggcgaagatgggcttaccttggatgtcacaggaactcatttggtggagaaagatatcgagaacctggccagagaggaattgcaaaaactgctcctggaacaaatggagctccgcaagaagctggaacgggaatttcagagtctcaaagataattttcaggatcaaatgaagagggaattggcttatcgagaagaaatggtgcaacagctgcaaattgtcagagataccctgtgtaacgaactcgaccaggagcggaaggcgcgctatgccatccagcagaaattgaaagaagcccacgacgccctgcaccatttctcctgcaagatgctgacgccccgccactgcactggcaactgctccttcaagccaccgctgttgccctagggccggcctggccgcacccctgcgccctcaagccatgctgctccttgtaaatacccgctgctgcggtggccctgagcgaggaacaagccattcggacccgaccgatgtaaatacagccgcccgtccgcccgccttcctcccgggctccccggccttgcccgccccctcccgggcgtccctgtccagggccccggcttggtttccaagtgtaaataccgcctcgcgcctcaaatccccctaccccgtgtgaactctagggcatcggacctcaaggggttaactggacagacggggggcgggaggggagagcgccccctcccattgtatagccttgaacccgattgtgaatacaatgtagcaacttcgctggcgcctgccccgcactccccgtcccgtccacttctgaaactcctgttcctaatgacaaagtggctatgtgcaatggatataaatgtactgtgagtctctcggttcagtattaggttcactttaatttatttatgctgtaagttatttttgcttccttctcctggacccacttccagtcccgttttgcattcccctttggattttgctttggctattttttgttgtaacctcttgatgtaacagcactttaaaagggcgacaactgactcacgagatggcaaccacctggagcctgtttggggagaccaccctgtacccgtgactttcgtttttaataataataataataataataa

SEQ ID NO: 181939 - DNA, 3675 bp, Homo sapiens
  Payload ID: 15827
  Gene Symbol: SKOR1
  Gene Name: SKI family transcriptional corepressor 1
  Uniprot ID: P84550
  ENST ID: ENST00000380035
  CDS Start-End: 59-2956
gctgcgagggttgccgaaggcgcacggatctgggcgctgaaaaagccaggatttggcaatggctttgctgtgtggccttgggcaagtcactctgcgtatctgggtttcacttccttcccaatccgaaaacgggattgggttccttgcagcccgggcattcctgaggagcggcggcatggaggctctcaccactcagctggggccggggcgcgagggcagttcctcgcccaactccaagcaggagctgcagccgtactcgggctccagcgctctcaaacccaaccaggtgggcgagacgtcgctgtacggggtgcccattgtgtcgctggtcatcgacggccaggagcgcctatgcctggcgcagatctccaacaccctcctcaagaactacagctataatgagatccacaaccgccgcgtggccctgggcatcacgtgcgtgcagtgcacgccggtacagctggagattctgcgtcgggccggggccatgcccatctcgtcgcgccgctgcggcatgatcactaagcgagaggccgaacgcctgtgcaagtcgttcctgggcgagcacaaaccacccaagctgcccgagaacttcgccttcgatgtggtgcacgagtgcgcgtggggctcgcgtggtagcttcatccctgcgcgttacaacagctctcgtgccaagtgcatcaagtgcggctactgcagcatgtacttctcgcccaacaagttcatcttccactcgcaccgaacacccgacgccaagtacacgcagcccgatgccgccaacttcaactcctggcgtcgtcacctcaaactcagtgacaagtcggccacagacgaactgagccatgcttgggaggacgtcaaggccatgtttaatggcggcacgcgcaagcggaccttctccctacaaggaggcggcggaggcggtgccaatggcgggtcgggtgggcaggggaagggtggtgctggcggcggtggcggcggtggcccagggtgcggtgcagagatggccccaggcccgccgccccacaaaagcctgcgctgtggcgaagatgaggctgccgggcctccggggccacctccaccccacccgcagcgcggacttggcctggcgactggagctagtggcccggcgggcccaggagggcccggtggcggcgccggcgtacgaagctacccggtgatcccggtgcccagcaaaggctttgggctcctgcaaaagctgcccccaccacttttcccccatccttacggcttccctacggccttcggcctatgccccaaaaaggacgacccggttttaggcgcgggcgagccaaagggcggtcctggcactgggagcggcggcggcggcgcggggacaggcgggggtgcggggggcccgggagccagccacttgcccccgggggcaggggcgggcccgggcggcggcgccatgttctgggggcatcaaccctccggggcagccaaggacgcagcggcagtggctgcagcggccgccgccgccactgtgtacccgacgtttcccatgttctggccagcagcaggcagcctcccggtaccgtcctaccccgctgctcagagccaagccaaggccgtggcggcagccgtggcggcggcagcggcggcggcagcggcagctgctggcagcggtgccccagagcccctggacggtgccgagccagccaaagagagtggcctcggcgcggaggagcgctgcccgagcgctctgtcccgcgggcccctggacgaagacggcacggacgaggcgctgccaccgcccctggccccgttgcccccgccgcccccgccgcccgcacgcaaaggctcctacgtgtcggccttccggccggtggtcaaggacaccgagagcatcgctaagctctacgggagcgcccgggaggcgtacggcgcggggcctgctcgggggccgggacccggcgctgggagcggcggctacgtgagcccggactttctgagcgagggcagctccagctacaattccgcctcgcccgacgtggacaccgcggacgagcccgaggtggacgtggaatccaaccgcttccccgacgacgaggacgcccaagaggagaccgagcccagcgcacccagcgcagggggcggcccagacggtgaacagcccactggacccccttccgccacctcctctggcgcggacggtcccgcaaactctcccgacggcggcagcccccgcccccggcgccgcctcgggccacccccagctggccggcccgcatttggggacttggcagccgaagacttggtgcggagacctgagaggagcccgccaagcggcggcggcggctacgagctgcgagagccttgcgggcccctaggaggccccgcgccggccaaggtgttcgcgcccgagagggatgagcacgtgaagagcgcggcggtggcgctggggcccgcggcctcctacgtctgcacccccgaggcccacgagccagataaggaagacaatcactcgcccgccgatgatttggaaacgaggaaatcctatccagaccaaaggagtatctcccagccaagtcctgcaaatacagacagaggcgaagatgggcttaccttggatgtcacaggaactcatttggtggagaaagatatcgagaacctggccagagaggaattgcaaaaactgctcctggaacaaatggagctccgcaagaagctggaacgggaatttcagagtctcaaagataattttcaggatcaaatgaagagggaattggcttatcgagaagaaatggtgcaacagctgcaaattgtcagagataccctgtgtaacgaactcgaccaggagcggaaggcgcgctatgccatccagcagaaattgaaagaagcccacgacgccctgcaccatttctcctgcaagatgctgacgccccgccactgcactggcaactgctccttcaagccaccgctgttgccctagggccggcctggccgcacccctgcgccctcaagccatgctgctccttgtaaatacccgctgctgcggtggccctgagcgaggaacaagccattcggacccgaccgatgtaaatacagccgcccgtccgcccgccttcctcccgggctccccggccttgcccgccccctcccgggcgtccctgtccagggccccggcttggtttccaagtgtaaataccgcctcgcgcctcaaatccccctaccccgtgtgaactctagggcatcggacctcaaggggttaactggacagacggggggcgggaggggagagcgccccctcccattgtatagccttgaacccgattgtgaatacaatgtagcaacttcgctggcgcctgccccgcactccccgtcccgtccacttctgaaactcctgttcctaatgacaaagtggctatgtgcaatggatataaatgtactgtgagtctctcggttcagtattaggttcactttaatttatttatgctgtaagttatttttgcttccttctcctggacccacttccagtcccgttttgcattcccctttggattttgctttggctattttttgttgtaacctcttgatgtaacagcactttaaaagggcgacaactgactcacgagatggcaaccacctggagcctgtttggggagaccaccctgtacccgtgactttcgtttttaataataataataataa

SEQ ID NO: 181940 - DNA, 3597 bp, Homo sapiens
  Payload ID: 15827
  Gene Symbol: SKOR1
  Gene Name: SKI family transcriptional corepressor 1
  ENST ID: ENST00000554240
  CDS Start-End: 115-2895
gcgccgtcacccggagagcccggcggatcccggactcccgcccgccgctcctcccgccgcgcacctccgctcaccgctcgcccggctccagccgccgccgcactgagcggcggcatggaggctctcaccactcagctggggccggggcgcgagggcagttcctcgcccaactccaagcaggagctgcagccgtactcgggctccagcgctctcaaacccaaccaggtgggcgagacgtcgctgtacggggtgcccattgtgtcgctggtcatcgacggccaggagcgcctatgcctggcgcagatctccaacaccctcctcaagaactacagctataatgagatccacaaccgccgcgtggccctgggcatcacgtgcgtgcagtgcacgccggtacagctggagattctgcgtcgggccggggccatgcccatctcgtcgcgccgctgcggcatgatcactaagcgagaggccgaacgcctgtgcaagtcgttcctgggcgagcacaaaccacccaagctgcccgagaacttcgccttcgatgtggtgcacgagtgcgcgtggggctcgcgtggtagcttcatccctgcgcgttacaacagctctcgtgccaagtgcatcaagtgcggctactgcagcatgtacttctcgcccaacaagttcatcttccactcgcaccgaacacccgacgccaagtacacgcagcccgatgccgccaacttcaactcctggcgtcgtcacctcaaactcagtgacaagtcggccacagacgaactgagccatgcttgggaggacgtcaaggccatgtttaatggcggcacgcgcaagcggaccttctccctacaaggaggcggcggaggcggtgccaatggcgggtcgggtgggcaggggaagggtggtgctggcggcggtggcggcggtggcccagggtgcggtgcagagatggccccaggcccgccgccccacaaaagcctgcgctgtggcgaagatgaggctgccgggcctccggggccacctccaccccacccgcagcgcggacttggcctggcgactggagctagtggcccggcgggcccaggagggcccggtggcggcgccggcgtacgaagctacccggtgatcccggtgcccagcaaaggctttgggctcctgcaaaagctgcccccaccacttttcccccatccttacggcttccctacggccttcggcctatgccccaaaaaggacgacccggttttaggcgcgggcgagccaaagggcggtcctggcactgggagcggcggcggcggcgcggggacaggcgggggtgcggggggcccgggagccagccacttgcccccgggggcaggggcgggcccgggcggcggcgccatgttctgggggcatcaaccctccggggcagccaaggacgcagcggcagtggctgcagcggccgccgccgccactgtgtacccgacgtttcccatgttctggccagcagcaggcagcctcccggtaccgtcctaccccgctgctcagagccaagccaaggccgtggcggcagccgtggcggcggcagcggcggcggcagcggcagctgctggcagcggtgccccagagcccctggacggtgccgagccagccaaagagagtggcctcggcgcggaggagcgctgcccgagcgctctgtcccgcgggcccctggacgaagacggcacggacgaggcgctgccaccgcccctggccccgttgcccccgccgcccccgccgcccgcacgcaaaggctcctacgtgtcggccttccggccggtggtcaaggacaccgagagcatcgctaagctctacgggagcgcccgggaggcgtacggcgcggggcctgctcgggggccgggacccggcgctgggagcggcggctacgtgagcccggactttctgagcgagggcagctccagctacaattccgcctcgcccgacgtggacaccgcggacgagcccgaggtggacgtggaatccaaccgcttccccgacgacgaggacgcccaagaggagaccgagcccagcgcacccagcgcagggggcggcccagacggtgaacagcccactggacccccttccgccacctcctctggcgcggacggtcccgcaaactctcccgacggcggcagcccccgcccccggcgccgcctcgggccacccccagctggccggcccgcatttggggacttggcagccgaagacttggtgcggagacctgagaggagcccgccaagcggcggcggcggctacgagctgcgagagccttgcgggcccctaggaggccccgcgccggccaaggtgttcgcgcccgagagggatgagcacgtgaagagcgcggcggtggcgctggggcccgcggcctcctacgtctgcacccccgaggcccacgagccagataaggaagacaatcactcgcccgccgatgatttggaaacgaggaaatcctatccagaccaaaggagtatctcccagccaagtcctgcaaatacagacagaggcgaagatgggcttaccttggatgtcacaggaactcatttggtggagaaagatatcgagaacctggccagagaggaattgcaaaaactgctcctggaacaaatggagctccgcaagaagctggaacgggaatttcagagtctcaaagataattttcaggatcaaatgaagagggaattggcttatcgagaagaaatggtgcaacagctgcaaattgtcagagataccctgtgtaacgaactcgaccaggagcggaaggcgcgctatgccatccagcagaaattgaaagaagcccacgacgccctgcaccatttctcctgcaagatgctgacgccccgccactgcactggcaactgctccttcaagccaccgctgttgccctagggccggcctggccgcacccctgcgccctcaagccatgctgctccttgtaaatacccgctgctgcggtggccctgagcgaggaacaagccattcggacccgaccgatgtaaatacagccgcccgtccgcccgccttcctcccgggctccccggccttgcccgccccctcccgggcgtccctgtccagggccccggcttggtttccaagtgtaaataccgcctcgcgcctcaaatccccctaccccgtgtgaactctagggcatcggacctcaaggggttaactggacagacggggggcgggaggggagagcgccccctcccattgtatagccttgaacccgattgtgaatacaatgtagcaacttcgctggcgcctgccccgcactccccgtcccgtccacttctgaaactcctgttcctaatgacaaagtggctatgtgcaatggatataaatgtactgtgagtctctcggttcagtattaggttcactttaatttatttatgctgtaagttatttttgcttccttctcctggacccacttccagtcccgttttgcattcccctttggattttgctttggctattttttgttgtaacctcttgatgtaacagcactttaaaagggcgacaactgactcacgagatggcaaccacctggagcctgtttggggagaccaccctgtacccgtgactttcgttttt

SEQ ID NO: 181941 - DNA, 3620 bp, Homo sapiens
  Payload ID: 15827
  Gene Symbol: SKOR1
  Gene Name: SKI family transcriptional corepressor 1
  ENST ID: ENST00000554054
  CDS Start-End: 88-2901
gggcttcaggacccgggccggcagcaccggctgcgagggttgccgaaggcgcacggatctgggcgctgaaaaagccaggatttggcaatggctttgctgtgtggccttgggagcggcggcatggaggctctcaccactcagctggggccggggcgcgagggcagttcctcgcccaactccaagcaggagctgcagccgtactcgggctccagcgctctcaaacccaaccaggtgggcgagacgtcgctgtacggggtgcccattgtgtcgctggtcatcgacggccaggagcgcctatgcctggcgcagatctccaacaccctcctcaagaactacagctataatgagatccacaaccgccgcgtggccctgggcatcacgtgcgtgcagtgcacgccggtacagctggagattctgcgtcgggccggggccatgcccatctcgtcgcgccgctgcggcatgatcactaagcgagaggccgaacgcctgtgcaagtcgttcctgggcgagcacaaaccacccaagctgcccgagaacttcgccttcgatgtggtgcacgagtgcgcgtggggctcgcgtggtagcttcatccctgcgcgttacaacagctctcgtgccaagtgcatcaagtgcggctactgcagcatgtacttctcgcccaacaagttcatcttccactcgcaccgaacacccgacgccaagtacacgcagcccgatgccgccaacttcaactcctggcgtcgtcacctcaaactcagtgacaagtcggccacagacgaactgagccatgcttgggaggacgtcaaggccatgtttaatggcggcacgcgcaagcggaccttctccctacaaggaggcggcggaggcggtgccaatggcgggtcgggtgggcaggggaagggtggtgctggcggcggtggcggcggtggcccagggtgcggtgcagagatggccccaggcccgccgccccacaaaagcctgcgctgtggcgaagatgaggctgccgggcctccggggccacctccaccccacccgcagcgcggacttggcctggcgactggagctagtggcccggcgggcccaggagggcccggtggcggcgccggcgtacgaagctacccggtgatcccggtgcccagcaaaggctttgggctcctgcaaaagctgcccccaccacttttcccccatccttacggcttccctacggccttcggcctatgccccaaaaaggacgacccggttttaggcgcgggcgagccaaagggcggtcctggcactgggagcggcggcggcggcgcggggacaggcgggggtgcggggggcccgggagccagccacttgcccccgggggcaggggcgggcccgggcggcggcgccatgttctgggggcatcaaccctccggggcagccaaggacgcagcggcagtggctgcagcggccgccgccgccactgtgtacccgacgtttcccatgttctggccagcagcaggcagcctcccggtaccgtcctaccccgctgctcagagccaagccaaggccgtggcggcagccgtggcggcggcagcggcggcggcagcggcagctgctggcagcggtgccccagagcccctggacggtgccgagccagccaaagagagtggcctcggcgcggaggagcgctgcccgagcgctctgtcccgcgggcccctggacgaagacggcacggacgaggcgctgccaccgcccctggccccgttgcccccgccgcccccgccgcccgcacgcaaaggctcctacgtgtcggccttccggccggtggtcaaggacaccgagagcatcgctaagctctacgggagcgcccgggaggcgtacggcgcggggcctgctcgggggccgggacccggcgctgggagcggcggctacgtgagcccggactttctgagcgagggcagctccagctacaattccgcctcgcccgacgtggacaccgcggacgagcccgaggtggacgtggaatccaaccgcttccccgacgacgaggacgcccaagaggagaccgagcccagcgcacccagcgcagggggcggcccagacggtgaacagcccactggacccccttccgccacctcctctggcgcggacggtcccgcaaactctcccgacggcggcagcccccgcccccggcgccgcctcgggccacccccagctggccggcccgcatttggggacttggcagccgaagacttggtgcggagacctgagaggagcccgccaagcggcggcggcggctacgagctgcgagagccttgcgggcccctaggaggccccgcgccggccaaggtgttcgcgcccgagagggatgagcacgtgaagagcgcggcggtggcgctggggcccgcggcctcctacgtctgcacccccgaggcccacgagccagataaggaagacaatcactcgcccgccgatgatttggaaacgaggaaatcctatccagaccaaaggagtatctcccagccaagtcctgcaaatacagacagaggcgaagatgggcttaccttggatgtcacaggaactcatttggtggagaaagatatcgagaacctggccagagaggaattgcaaaaactgctcctggaacaaatggagctccgcaagaagctggaacgggaatttcagagtctcaaagataattttcaggatcaaatgaagagggaattggcttatcgagaagaaatggtgcaacagctgcaaattgtcagagataccctgtgtaacgaactcgaccaggagcggaaggcgcgctatgccatccagcagaaattgaaagaagcccacgacgccctgcaccatttctcctgcaagatgctgacgccccgccactgcactggcaactgctccttcaagccaccgctgttgccctagggccggcctggccgcacccctgcgccctcaagccatgctgctccttgtaaatacccgctgctgcggtggccctgagcgaggaacaagccattcggacccgaccgatgtaaatacagccgcccgtccgcccgccttcctcccgggctccccggccttgcccgccccctcccgggcgtccctgtccagggccccggcttggtttccaagtgtaaataccgcctcgcgcctcaaatccccctaccccgtgtgaactctagggcatcggacctcaaggggttaactggacagacggggggcgggaggggagagcgccccctcccattgtatagccttgaacccgattgtgaatacaatgtagcaacttcgctggcgcctgccccgcactccccgtcccgtccacttctgaaactcctgttcctaatgacaaagtggctatgtgcaatggatataaatgtactgtgagtctctcggttcagtattaggttcactttaatttatttatgctgtaagttatttttgcttccttctcctggacccacttccagtcccgttttgcattcccctttggattttgctttggctattttttgttgtaacctcttgatgtaacagcactttaaaagggcgacaactgactcacgagatggcaaccacctggagcctgtttggggagaccaccctgtacccgtgactttcgtttttaataataataataataa

SEQ ID NO: 181942 - DNA, 891 bp, Homo sapiens
  Payload ID: 15828
  Gene Symbol: SKOR2
  Gene Name: SKI family transcriptional corepressor 2
  Uniprot ID: Q2VWA4
  ENST ID: ENST00000400404
  CDS Start-End: 1-891
atggcttccagtccgctgccagggcccaacgacatcctgctggcgtcgccgtcgagcgccttccagcccgacacgctgagccagccgcggccagggcacgccaacctcaaacccaaccaggtgggccaggtgatcctctacggcattcccatcgtgtcgttggtgatcgacgggcaagagcgcctgtgcctggcgcagatctccaacactctgctcaagaacttcagctacaacgagatccacaaccgtcgcgtggcactgggcatcacgtgtgtgcagtgcacgccggtgcaactggagatcctgcggcgtgccggggccatgcccatctcatcgcgccgctgcggcatgatcaccaaacgcgaggccgagcgtctgtgcaagtcgttcctgggcgaaaacaggccgcccaagctgccagacaatttcgccttcgacgtgtcacacgagtgcgcctggggctgccgcggcagcttcattcccgcgcgctacaacagctcgcgcgccaagtgcatcaaatgcagctactgcaacatgtacttctcgcccaacaagttcattttccactcccaccgcacgcccgacgccaagtacactcagccagacgcagccaacttcaactcgtggcgccgtcatctcaagctcaccgacaagagtccccaggacgagctggtcttcgcctgggaggacgtcaaggccatgttcaacggcggcagccgcaagcgcgcactgccccagccgggcgcgcaccccgcctgccacccgctcagctctataagaacaaggagcatagctttttcatcacagactctgatgcttctggaggagatttttggagagaaagatcaggaggattatatgcgaataaatgaggacaacatttggttatga

SEQ ID NO: 181943 - DNA, 3006 bp, Homo sapiens
  Payload ID: 15828
  Gene Symbol: SKOR2
  Gene Name: SKI family transcriptional corepressor 2
  Uniprot ID: Q2VWA4
  ENST ID: ENST00000425639
  CDS Start-End: 1-3006
atggcttccagtccgctgccagggcccaacgacatcctgctggcgtcgccgtcgagcgccttccagcccgacacgctgagccagccgcggccagggcacgccaacctcaaacccaaccaggtgggccaggtgatcctctacggcattcccatcgtgtcgttggtgatcgacgggcaagagcgcctgtgcctggcgcagatctccaacactctgctcaagaacttcagctacaacgagatccacaaccgtcgcgtggcactgggcatcacgtgtgtgcagtgcacgccggtgcaactggagatcctgcggcgtgccggggccatgcccatctcatcgcgccgctgcggcatgatcaccaaacgcgaggccgagcgtctgtgcaagtcgttcctgggcgaaaacaggccgcccaagctgccagacaatttcgccttcgacgtgtcacacgagtgcgcctggggctgccgcggcagcttcattcccgcgcgctacaacagctcgcgcgccaagtgcatcaaatgcagctactgcaacatgtacttctcgcccaacaagttcattttccactcccaccgcacgcccgacgccaagtacactcagccagacgcagccaacttcaactcgtggcgccgtcatctcaagctcaccgacaagagtccccaggacgagctggtcttcgcctgggaggacgtcaaggccatgttcaacggcggcagccgcaagcgcgcactgccccagccgggcgcgcaccccgcctgccacccgctcagctctgtgaaggcggccgccgtggccgccgcggccgcggtggccggaggcgggggtctgctgggcccccacctgctgggtgcgcccccgccgccgccgccgccaccgccgcccttggcagagctggctggtgccccgcacgcccatcacaagcggccgcgcttcgacgacgacgacgactccttgcaggaggccgccgtagtggccgccgccagcctctcggccgcagccgccagcctctctgtggctgctgcttcgggcggcgcggggactggtgggggcggcgctgggggtggctgtgtggccggcgtgggcgtgggcgcgggcgcgggggcgggtgccggggcaggggccaaaggcccgcgcagctacccagtcatcccggtgcccagcaagggctcgttcgggggcgtcctgcagaagttcccgggctgcggcgggctcttcccgcacccctacaccttccctgccgcggccgccgccttcagcttgtgccataagaaagaggatgcgggtgccgccgctgaggccctggggggcgcgggcgcaggcggcgcgggcgcggcgcccaaggccggcttgtccggcctcttctggcccgcgggccgcaaggacgccttctatccgcccttctgcatgttctggccgccgcggacccctggcgggctcccggtgcccacctacctgcagcccccgcctcagccgccctcggcgctaggctgcgcgctaggcgaaagcccggccctgctgcgccaggccttcctggacctggctgagccaggcggtgctgctgggagcgccgaggccgcgcccccgccggggcagcccccgcaggtagtggccaacggcccgggctccggcccacctcctcctgccgggggcgccggctctcgcgacgcgctcttcgagtcgcccccgggcggcagcggcggggactgcagcgcgggctccacgccgcccgcggactctgtggcagctgccggggcaggggccgcggccgccgggtctggccccgcgggctcccgggttccggcgccccaccatccgcaccttctggaggggcgcaaagcgggcggtggcagctaccaccattccagcgccttccggccagtgggcggcaaggacgacgcggagagcctggccaagctgcacggggcgtcggcgggcgcgccccactcggcccagacgcatccccaccaccatcaccaccctcaccaccaccaccaccaccaccaccccccgcagccgccgtcgccgcttctgctgctgcccccgcagcccgacgagccgggttccgagcgccaccacccggccccgccgccgccgccgccgccgcccccgccgccccctctggcccagcacccgcaccaccgaggccttctgtctcccgggggaaccagctgctgctaccccagcgaggacagctccgaggacgaggacgacgaggaagaagagcaggaggtggacgtggagggccacaagccccccgagggcgaggaagaggaggaaggtcgagaccctgacgacgacgaggaagaggacgaggagacggaggtcctactcggcgaccccttagtcgggggcggccggttcctccagggccgagggccgtcggagaaggggagcagccgggaccgcgcgccggccgtcgcgggcgcgttcccgctcggcctgaactcctccaggctgctgcaggaagacgggaaactcggggaccccggctcggacctgcccccgcccccgccgccgcccctggccccccagaaggcgagtggcggcggcagcagcagcccgggcagcccagttcaccatccatcactggaggagcagccctcctacaaagatagtcagaaaactaaggaaaataaccaagtaattgtatctacaaaggatgacaacagcttttcagataagaacaaggagcatagctttttcatcacagactctgatgcttctggaggagatttttggagagaaagatcaggtgaacatacacaagaaaccaactcacctcattcactgaaaaaggatgtagaaaatatggggaaagaagaacttcagaaggttttatttgaacaaatagatttacggagacgactggaacaagaattccaggtgttaaaaggaaacacatctttcccagtattcaataattttcaggatcagatgaaaagggagctagcctaccgagaagaaatggtgcaacagttacaaattgtaagctgcatttctacttaa

SEQ ID NO: 181944 - DNA, 3048 bp, Homo sapiens
  Payload ID: 15828
  Gene Symbol: SKOR2
  Gene Name: SKI family transcriptional corepressor 2
  ENST ID: ENST00000620245
  CDS Start-End: 1-3048
atggcttccagtccgctgccagggcccaacgacatcctgctggcgtcgccgtcgagcgccttccagcccgacacgctgagccagccgcggccagggcacgccaacctcaaacccaaccaggtgggccaggtgatcctctacggcattcccatcgtgtcgttggtgatcgacgggcaagagcgcctgtgcctggcgcagatctccaacactctgctcaagaacttcagctacaacgagatccacaaccgtcgcgtggcactgggcatcacgtgtgtgcagtgcacgccggtgcaactggagatcctgcggcgtgccggggccatgcccatctcatcgcgccgctgcggcatgatcaccaaacgcgaggccgagcgtctgtgcaagtcgttcctgggcgaaaacaggccgcccaagctgccagacaatttcgccttcgacgtgtcacacgagtgcgcctggggctgccgcggcagcttcattcccgcgcgctacaacagctcgcgcgccaagtgcatcaaatgcagctactgcaacatgtacttctcgcccaacaagttcattttccactcccaccgcacgcccgacgccaagtacactcagccagacgcagccaacttcaactcgtggcgccgtcatctcaagctcaccgacaagagtccccaggacgagctggtcttcgcctgggaggacgtcaaggccatgttcaacggcggcagccgcaagcgcgcactgccccagccgggcgcgcaccccgcctgccacccgctcagctctgtgaaggcggccgccgtggccgccgcggccgcggtggccggaggcgggggtctgctgggcccccacctgctgggtgcgcccccgccgccgccgccgccaccgccgcccttggcagagctggctggtgccccgcacgcccatcacaagcggccgcgcttcgacgacgacgacgactccttgcaggaggccgccgtagtggccgccgccagcctctcggccgcagccgccagcctctctgtggctgctgcttcgggcggcgcggggactggtgggggcggcgctgggggtggctgtgtggccggcgtgggcgtgggcgcgggcgcgggggcgggtgccggggcaggggccaaaggcccgcgcagctacccagtcatcccggtgcccagcaagggctcgttcgggggcgtcctgcagaagttcccgggctgcggcgggctcttcccgcacccctacaccttccctgccgcggccgccgccttcagcttgtgccataagaaagaggatgcgggtgccgccgctgaggccctggggggcgcgggcgcaggcggcgcgggcgcggcgcccaaggccggcttgtccggcctcttctggcccgcgggccgcaaggacgccttctatccgcccttctgcatgttctggccgccgcggacccctggcgggctcccggtgcccacctacctgcagcccccgcctcagccgccctcggcgctaggctgcgcgctaggcgaaagcccggccctgctgcgccaggccttcctggacctggctgagccaggcggtgctgctgggagcgccgaggccgcgcccccgccggggcagcccccgcaggtagtggccaacggcccgggctccggcccacctcctcctgccgggggcgccggctctcgcgacgcgctcttcgagtcgcccccgggcggcagcggcggggactgcagcgcgggctccacgccgcccgcggactctgtggcagctgccggggcaggggccgcggccgccgggtctggccccgcgggctcccgggttccggcgccccaccatccgcaccttctggaggggcgcaaagcgggcggtggcagctaccaccattccagcgccttccggccagtgggcggcaaggacgacgcggagagcctggccaagctgcacggggcgtcggcgggcgcgccccactcggcccagacgcatccccaccaccatcaccaccctcaccaccaccaccaccaccaccaccccccgcagccgccgtcgccgcttctgctgctgcccccgcagcccgacgagccgggttccgagcgccaccacccggccccgccgccgccgccgccgccgcccccgccgccccctctggcccagcacccgcaccaccgaggccttctgtctcccgggggaaccagctgctgctaccccagcgaggacagctccgaggacgaggacgacgaggaagaagagcaggaggtggacgtggagggccacaagccccccgagggcgaggaagaggaggaaggtcgagaccctgacgacgacgaggaagaggacgaggagacggaggtcctactcggcgaccccttagtcgggggcggccggttcctccagggccgagggccgtcggagaaggggagcagccgggaccgcgcgccggccgtcgcgggcgcgttcccgctcggcctgaactcctccaggctgctgcaggaagacgggaaactcggggaccccggctcggacctgcccccgcccccgccgccgcccctggccccccagaaggcgagtggcggcggcagcagcagcccgggcagcccagttcaccatccatcactggaggagcagccctcctacaaagatagtcagaaaactaaggaaaataaccaagtaattgtatctacaaaggatgacaacagcttttcagataagaacaaggagcatagctttttcatcacagactctgatgcttctggaggagatttttggagagaaagatcaggtgaacatacacaagaaaccaactcacctcattcactgaaaaaggatgtagaaaatatggggaaagaagaacttcagaaggttttatttgaacaaatagatttacggagacgactggaacaagaattccaggtgttaaaaggaaacacatctttcccagtattcaataattttcaggatcagatgaaaagggagctagcctaccgagaagaaatggtgcaacagttacaaattatcccctatgcagcaagtttgatcaggaaagaaaagcttggcgcccatctcagcaaaagctaa

SEQ ID NO: 181945 - DNA, 5613 bp, Homo sapiens
  Payload ID: 15829
  Gene Symbol: SKI
  Gene Name: SKI proto-oncogene
  Uniprot ID: P12755
  ENST ID: ENST00000378536
  CDS Start-End: 73-2259
cggggcggcggcgggggccgggggggcccgggcgcgcgggagcgggagcggccgggggagccggagcgcaccatggaggcggcggcaggcggccgcggctgtttccagccgcacccggggctgcagaagacgctggagcagttccacctgagctccatgagctcgctgggcggcccggccgctttctcggcgcgctgggcgcaggaggcctacaagaaggagagcgccaaggaggcgggcgcggccgcggtgccggcgccggtgcccgcagccaccgagccgccgcccgtgctgcacctgcccgccatccagccgccgccgcccgtgctgcccgggcccttcttcatgccgtccgaccgctccaccgagcgctgcgagaccgtactggaaggcgagaccatctcgtgcttcgtggtgggaggcgagaagcgcctgtgtctgccgcagattctcaactcggtgctgcgcgacttctcgctgcagcagatcaacgcggtgtgcgacgagctccacatctactgctcgcgctgcacggccgaccagctggagatcctcaaagtcatgggcatcctgcccttctcggcgccctcgtgcgggctcatcaccaagacggacgccgagcgcctgtgcaacgcgctgctctacggcggcgcctacccgccgccctgcaagaaggagctggccgccagcctggcgctgggcctggagctcagcgagcgcagcgtccgcgtgtaccacgagtgcttcggcaagtgtaaggggctgctggtgcccgagctctacagcagcccgagcgccgcctgcatccagtgcctggactgccgcctcatgtacccgccgcacaagttcgtggtgcactcgcacaaggccctggagaaccggacctgccactggggcttcgactcggccaactggcgggcctacatcctgctgagccaggattacacgggcaaggaggagcaggcgcgcctcggccgctgcctggacgacgtgaaggagaaattcgactatggcaacaagtacaagcggcgggtgccccgggtctcctctgagcctccggcctccataagacccaaaacagatgacacctcttcccagtcccccgcgccttccgaaaaggacaagccgtccagctggctgcggaccttggccggctcttccaataagagcctgggctgtgttcaccctcgccagcgcctctctgctttccgaccctggtcccccgcagtgtcagcgagtgagaaagagctctccccacacctcccggccctcatccgagacagcttctactcctacaagagctttgagacagccgtggcgcccaacgtggccctcgcaccgccggcccagcagaaggttgtgagcagccctccgtgtgccgccgccgtctcccgggcccccgagcctctcgccacttgcacccagcctcggaagcggaagctgactgtggacaccccaggagccccagagacgctggcgcccgtggctgccccagaggaggacaaggactcggaggcggaggtggaagttgaaagcagggaggaattcacctcctccttgtcctcgctctcttccccgtcctttacctcatccagctccgccaaggacctgggctccccgggtgcgcgtgccctgccctcggccgtccctgatgctgcggcccctgccgacgcccccagtgggctggaggcggagctggagcacctgcggcaggcactggagggcggcctggacaccaaggaagccaaagagaagttcctgcatgaggtggtcaagatgcgcgtgaagcaggaggagaagctcagcgcagccctgcaggccaagcgcagcctccaccaggagctggagttcctacgcgtggccaagaaggagaagctgcgggaggccacggaggccaagcgtaacctgcggaaggagatcgagcgtctccgcgccgagaacgagaagaagatgaaagaggccaacgagtcacggctgcgcctgaagcgggagctggagcaggcgcggcaggcccgggtgtgcgacaagggctgcgaggcgggccgcctgcgcgccaagtactcggcccagatcgaagacctgcaggtgaagctgcagcacgcggaggcggaccgggagcagctgcgggccgacctgctgcgggagcgcgaggcccgggagcacctggagaaggtggtgaaggagctgcaggaacagctgtggccgcgggcccgccccgaggctgcgggcagcgagggcgctgcggagctggagccgtagattccgtgcctgccgccgcagcgccgccgacaacgcgggtgcaggggggcgcggctgggcggtgcagctccgcccggctccgcccctgcagcccacacagcacaacgtcttaccgtgcctattaccaagcgagtgtttgtaaccatgtagttttggaacccactgcaaaattttctactggccaagttcaagtgagtaagccgcgtcccccaactacagctggagacggggccagctcggcggcctgctggtcctctgcttgctggaacattctaacatttacacttttgttataagctatttaaaaccagtaaggagacttgaaattcagaaaatcaacacatttttaaatgactaacttctaaaagccccaacacatgacgccatctgaagacccgcaacggagtgggggtggcggccgccccaccctccccacccggggaagccatcacagctcatctgcccgcggctgcgtgaggacagcaggggtttttcttcagagtctattttttcagcgacaaggacccaggtcttcctgctgctgccagggagagcagggacagtgccgcgtgcgagatgagctcgaacactgcccgccttactgccgcctaccccgcccgccacgccgccgtcgatgccagcgctgtccccacgggtaccaggaagtgcagagccgcacaggagctgccccggagctgaggggacggtcttcggctcctctgcaccccgtgattctgcccacgctcctccaccacgaggcactgacctgcgtcgggtggtgaccgtggctggcggtcacgccctcagcccctccgggcacacgtgccgcctgaccgggcgacccttttcagttcggcaaacgtcgctcccttcattttgggactgaggctgcagcattggaacaaaagagcattatttcaatttttctttctttttttttgttcgttcatttaaacgtatatttagaactgcactttgtccacaaccttcccttctctttctattccccagtgaactgaggtttttaccgatttatagagcagtcaaatccgaagtgctcgagtgcttagaaaccccctctggtgcttggttgaacaagggaatcacaagaaaacgaaaatgcaaaaactgaacttcgggggtcgttctgtgccttccagcatcttgtacagcaaatcctgactcgtgtctttttacccccaagatatctgtcttcagtagcgactgaatctgccactctcagaataagttccttgcatttattccaaataatctcgtttactctcacctgtttatgcaaattgtataaggtttcttatgcccaagcttgaaaaatgatttcccagtagacaagaggcggctacctatcctacagttacggtatttatttacataagaagatcttacaggagttctttgcttgaatccgttctaacacccgcggcagctgcacgcgctcacagaaggtggaggttacttgcccaggtacagacgacctcggggcagtgacgagcaaagaccagagactgctgagccctcgcatctgggtggcggaattgcctgcggggttttgcccttggtttactgaggggggtcttggttgctgctgaagccccccaccccttctaaagtgcaatgcaaaagggacatcatgtatatgcagcgtttgtttggaattttctttgcttttgttttctttgcggttgttctgtgtgcatggattccacacctctgccgtaggtagatccgtcagcgggcattattaccgtgtcttgtaaagggtcggttttgttatgcaacatgcagaatgctgtttttagccttgttttaccagagttgttttttttttcagttatttcttcaagggaaactaaatgatttagttggagcaaagctttaagtgtgttggcgtgcttctgtgtggctgtcctgtgtcgccaggtcgaagatcacagtgaggtagaggccctgccccatccccagggccgccaggcttgctccgtttgctttgagtttttagaccccagagggagatgagcttttccaagctgtgtctgggccagagcctctccttgcccttgctccatcccgacggtcaccgttgggtccacgcctccaccgccccatcttgccccaaacggaaagcgctgtatctgcagtggcagcccttccccacttcggctctgggagggtccagccagtgtcacctgggcccaccctttcctgcagctgccaggcccgtgcggtcagtgggacccggacgtgggcaggcgagctcgggaccctcccaggcagttcccacagctcttgcctcggctcaccagggtcacttccactgtcaggggcctgagggggcagctgtggctgcagggctgctctggactgaggggtcccaggccccgaggggtgcacgcctggctccccttggcacaggtgcgagtccgtttcttttcagcagaagggggaagaggtgtccgctgtgtgggctgctgactcctctgtgtgtgaggcccttcatctaagtgattgtgtattcagtttaattctcattatatttctatactgaaagaagatttttaacgaagggaaaaacaacagcaataacattcatatctctggagcagctaactcatacacgtaatgtctgcttttcgtacagaactagccaatgtaaaaacagttcacctgtaaatactttttcctttttcaccgttgtattatacatgtatatgctgggtcctttttcagaaactcttttcttacctgagagttgtcttgttttctgggctgtttttaactgaggaaaaaaaaaatgctttcctgccggggggcaggggagacggagaaacccatgtgcgtttcccatgtgaccccctcctccctgtgggtctgagccccggccccccccacctcctcctccctgtgggtccgaaccccggcccccccaccccctcctccctgtgggtccgaaccccggcccccccaccccctcctccctgtgggtccgatccccggccccccccaccccctcctccctgtgggtccgaaccccggccccccccccaccccctcctccctgtgggtccgaaccccggcccccccacccctccctcagcccaccagggtccagggagatgttcgttctcgctttaagtcaggagtcacaaatgacttttttttttcaattaaggaaaaagctccatctctacctttaacatcacccagacccccgcccctgcccgtgccccacgctgctgctaacgacagtatgatgcttactctgctactcggaaactatttttatgtaattaatgtatgctttcttgtttataaatgcctgatttaaaaagaaaa

SEQ ID NO: 181946 - DNA, 6598 bp, Homo sapiens
  Payload ID: 15830
  Gene Symbol: SKIDA1
  Gene Name: SKI/DACH domain containing 1
  ENST ID: ENST00000449193
  CDS Start-End: 2254-4980
tttgctttaacaacaagtgggggtggttgaatttactcctccctctcctctctcctccccttcctcttgctgcggttcttgacactactacaaaccaggactataaacataaacatgtgtcactgtaacagggcaggttcccagtagctgcagcagtgaaagacagtgattggctccagtgctcccagaaggatttgggctgaagccaggggaacagaaccagaagaggattccctttccagagaccatcaggctcctcatgtcttgtctctcctctctcccctcgtggtggctcaggatttcagtatggctgagcagcccatagagtcagctgacatggtcaacaaatttatcaaagaaaccccctggcttttgaagaatagtactttatacatctggatctgcacatcaggcaaagctcagaaatatccgtttattcttttaatcacgcggatgtgtctatttttggaggaacaaggaaacacataaatgcctgggttgcatttatgttgtagttgcaaacactgaacagttaagaagattttgccgaattttgcaaagcagccaaggagccgccttgggatcgtggtaatgcgactgggaggacccttgctctcatttggcaatattttggatatccttgaaaacgacaccaaaatttgccttaatttgactaagaagaggttaaaccacattgattttcatccaaagtgattttgttaaagcagatgcttgactttgatggaaaaactgggagttgtggaagatttacctaaactaccaaccaaaagcatcacaaaccactgaaacagtctgcatcgtacatcagcactttcttttcattgttattacgtaaaacctctggaagcaccttgggcgtttgacagtttcttttctttgctgcagaaggaagcaatctgctccctggaattctgacctgtggtgaacaggaccctggcaaaggctttgctggggactcttggacgatcccgcctccaatccagtacggttaattgtggaaaagtgtacacatttctggcttatctatgctttgttatgggtctgacgtgaaactacctcctccccaccccaccccccagcagagaaccgaaatccagttgaattgttacagtgtttcggagctggagccttgaactgcttccttggtcaaataactttgtttctggttgtaaaaaggcatttcaggaaaaaaaaaaaaaaaaaaggaaaatcgagagaaattccaaacgtaagtccgcactggggtggttcacggggcgggtttaactttggagctcccagccggtctccttccccactcctgtaagggaaataccaggctattctgcacattttcccttaagctccattttccaaaaggaaaagggggtggggtatctctctttcggcttgataatgttttttaaatgcttttctttgaaatgataatagctgtatcggtaaaatgcaaataaacgaaaaaaataggcagtatttctttaaaggcgaatatacggtgcggtttttttttttttctcccttaagcgtacacacactgcttctgatgaagtctgtgagtcaggctgtttctgagctccgatagtttaatggaaagatttatataccgactgtattatttactttgggaggggaggtggcagtataagggtatgctaattagtgggagattttggggggaaggggtggaatatcaatttttattgcatcacctgtcaggagtgtccaatcagcgctggctttaggggaattaattgatgaaggtgtctccggacgagctcacttcactctgtcattttatttgtagctaaagcagcggcgggaatagcagctgcatttcttttctctttctcccttcacattccattatcatagtgctccaatggagaaggaaggaatagaggggcccaggtactgatctgcatcggggactcagaccaacacactggcagatcagaaaccggatggttttttccctcttttttaaaaaaacgaaaacaacaacaacaaaaaagcaagaatcaagtcagtgtaatttcatggggtttccccccccccaataatttcgcctagagtttggcacttccttcgccgggaataacagtctttgttattttattagcaggatgccttgagacacacgcagcatctggctgaggattaacatacatacatgtgtatgtatgcgtcacgtatatatttactgcaaatggtggggatcatttagtgcccgagatgggagacctgaagtcaggttttgaagaggtggatggcgtgaggctcggctacctcatcattaaagggaagcaaatgtttgccctctcccaagtcttcacagatctgctgaaaaacatcccgaggacgaccgtgcacaagcgcatggatcatctgaaagtgaagaagcaccactgcgatctggaggagttgcggaaactcaaggcaattaacagcatcgccttccacgccgccaaatgcacgctcatctcccgggaagacgtggaagcgctctacacctcctgcaaaaccgagcgcgtcctcaagaccaagcgcaggcgggtcggccgggccctggccacaaaggcgccgccgccagagcgcgccgctgccgccagcccccgcccgggattttggaaggacaagcaccaactttggcggggcctgagcggagccgcgcggcccctgccaatcagcgcgcagtcccagcgcccgggcgccgccgccgcgcgccccgccgcccatctacctcagatttttagcaaataccccggctcgcactacccggagatcgtgcgctcgccgtgcaaaccccctctaaactatgaaactgccccgctccagggaaactacgtcgccttcccctcggaccctgcttattttcggagcctgctgtgcagcaaacacccggcagccgccgccgccgccgccgccgccgctgctgccgccgccgccgccgccgccgccgccgcctattaccaggtatcggcggccgggccccagcccaaggcagcggcgggcgccggaggcccggggagcctgagctaccgctgcaagcgcaagcgcggcggcgccaaggactgcctgctcgcgcctcacgccggcgcgcggcgcctgctgctgttgcccaggtcctacaaagccaaggcggcggcggcggcggcggcggcggcagcggcggcggcggccgccgcgggggccacttgcctggagaggtttcatctggtcaacggcttctgcccgcctccgcaccaccaccaccaccaccaccatcaccaccaccaccaccaccaccgggcccagccgccgcagcagagtcaccacccccctcaccaccaccggccgcagccccatctgggcagctttcccgagagctgcagcagcgactccgagtccagctcctactcggaccacgcggccaacgactcggattttggctccagtttgtccagctccagcaattctgtgtcctcagaggaagaggaggaggagggagaggaggaggaggaggaagaggaggaggaggggggcagcggggcctcggattccagtgaagtcagctcggaggaggaggactcgtccaccgagtcggactccagctccggctccagccaagtgtcagtgcagagcatccgattcaggcgcaccagcttctgcaagcctcccagcgtgcaggcgcaggccaacttcttgtaccatctggcctccgccgccgctgcaaccaaacccgctgctttcgaggatgccggcagacttcccgacctcaagagtagtgtcaaagcggagtcgccggcggagtggaatctgcagagctgggcccccaaagcatctccggtgtactgcccggccagcctggggagttgtttcgctgagataaggaacgatagggtatctgagattacattcccacactctgaaatttccaatgctgtaaagagaactgacctgacaattaactgcctggcagagggggcctcttcacctagcccaaagacaaacaatgcatttccacaacaaagaatactccgagaggctaggaaatgcctacaaacaactcctactacacactgtgcagataacaacacaatagctgctaggttcttaaataatgattcttcaggagcagaagcaaattcagaaaaatattccaaaatccttcattgtcctgaatttgctacggatttgccctcttcgcagactgatcctgaagtgaacgctgcaggagcagcagcaactaaagccgagaatccctgcactgacacaggcgacaagacattgccatttctgcacaatattaaaatcaaagtagaagacagtagtgctaatgaagaatatgaacctcacctttttacaaataagctaaagtgcgagtgcaatgatacaaagggtgagttttacagtgtgactgagagtaaagaggaggacgccttgttaaccacagccaaggaaggttttgcatgccctgaaaaagaaactccttccttaaatccactggctcaaagtcagggcctttcatgcactttaggttctccaaaacctgaggatggggaatataaatttggtgccagggtgagaaaaaattaccggacactagtactgggaaagcgacctgtccttcagacacctccagtcaaaccaaatttgaaatcagctagaagccctcgtcctacaggtaaaactgagacaaatgaaggaacactggatgattttacagttataaacagacgcaaaaaggtagccagcaatgtagcatcagcagtgaaaaggccatttcatttcatggcaaattttccttgtccaccatcactcattattgggagagatggggatttgtggccggcgtattccttaaacaccactaaggattctcaaactcctcacaaggcccatcctatatggaaatggcagctgggcggttctgcaatacctcttccacctagtcacaaattcaggaaatttaattcataaaaatgttttggaagatattttcttgaaccatattaccttccttttgttgtaaactgcacaggatggtttgtacaagtccattaatgtgttacaccccctttggagtcctggtttatcgcattttgaagacagaaatcggattactttttttccgttgcgggtttttttttttttttctggagtagggtgggggcggggtgggagaagggttggtttacattccacagactacttcaggctaaagactcaagtaaaactcagttattacggtagagctggaacactttactgtttcgatgctaataatgcacccggtacctcaattcaactgctacaaataaatgtcaaaaggttgaataataaatattacaatgagccattaagtttatgcactagatttcagagctgaaagtgtaactgttaattcagtgaaagtttgttaggttacatggttacacagtgaggtgaggtgaggtagcaagaagtttctgtgagcccaaaatgttattttctggagctcttgtttgtggggtatctttttcttttgactccccttattccctctccaagagtagttgcacttaactttttttttttttttttagtggaaagattggggtgtgagtcctgattaaatgctagtaaaagctgcctcatacatactgagtaaaataaatacggaattgtattttttttgtaaagggtgtgattttacttttaaagccactcctttgcaacaggaaaagtctgttttgtgttctcacccaaaggttttaaataaggtgactcttactattgtcctgcttatcttgtggtctgaacatgactcttcaaactcccaaaacaattgaaatatttctttttttttttttttttttttttggagagagtctcgctgtgtcgcccaggctggagtgcagtggcacaatcttggctcactgcaacctccacctcctgggttcaaacgattctgctgcctcagcctcctgagtagctgggattacgggcgcgtgccaccatgtccggctaatttttgtatttttagtagagacggggtttcaccatgttgaccaggctggtcccgaactcctgacctcaggtgatccgcctgtctcggcctcccaaagtgctgggattaaaggtgtgatccaccatgcccgggctgaaatatttctcgtaatagcagaatatttcatggccgaactcttgatagtgacaaatcagtaaatacaaccaagaaaaagaaaatgaggggtcagagttgcaataccccaaatgaaaaataacagttttttcagggctttttggtaccagaactcaggcacttggattttatgaccttatactttttctgcatctctctaaaacttgtgttttcagaccatcctgtgtatagagcaggagagtttctactgcaagtgacaatcagaggtgactatctatatttgcacttaaaatcaaagtagttcaacatgcaaatgctagggtctagccctgggtaagggccatgctggtgtactgtgttgtgatgatggaagcagtaaatcaaaattatggaaatttgcactgttgaaaagcatgctttagctttattttcaattaaaaacactgtttaaaa

SEQ ID NO: 181947 - DNA, 2667 bp, Homo sapiens
  Payload ID: 15830
  Gene Symbol: SKIDA1
  Gene Name: SKI/DACH domain containing 1
  ENST ID: ENST00000444772
  CDS Start-End: 98-2587
acacgcagcatctggctgaggattaacatacatacatgtgtatgtatgcgtcacgtatatatttactgcaaatggtggggatcatttagtgcccgagatgggagacctgaagtcaggttttgaagaggtggatggcgtgaggctcggctacctcatcattaaagggaagcaaatgtttgccctctcccaagtcttcacagatctgctgaaaaacatcccgaggacgaccgtgcacaagcgcatggatcatctgaaagtgaagaagcaccactgcgatctggaggagttgcggaaactcaaggcaattaacagcatcgccttccacgccgccaaatgcacgctcatctcccgggaagacgtggaagcgctctacacctcctgcaaaaccgagcgcgtcctcaagaccaagcgcaggcgggtcggccgggccctggccacaaaggcgccgccgccagagcgcgccgctgccgccagcccccgcccgggattttggaaggacaagcaccaactttggcggggcctgagcggagccgcgcggcccctgccaatcagcgcgcagtcccagcgcccgggcgccgccgccgcgcgccccgccgcccatctacctcagatttttagcaaataccccggctcgcactacccggagatcgtgcgctcgccgtgcaaaccccctctaaactatgaaactgccccgctccagggaaactacgtcgccttcccctcggaccctgcttattttcggagcctgctgtgcagcaaacacccggcggcggcggcggcggcggcggcggcagcggcggcggcggccgccgcgggggccacttgcctggagaggtttcatctggtcaacggcttctgcccgcctccgcaccaccaccaccaccaccaccatcaccaccaccaccaccaccaccgggcccagccgccgcagcagagtcaccacccccctcaccaccaccggccgcagccccatctgggcagctttcccgagagctgcagcagcgactccgagtccagctcctactcggaccacgcggccaacgactcggattttggctccagtttgtccagctccagcaattctgtgtcctcagaggaagaggaggaggagggagaggaggaggaggaggaagaggaggaggaggggggcagcggggcctcggattccagtgaagtcagctcggaggaggaggactcgtccaccgagtcggactccagctccggctccagccaagtgtcagtgcagagcatccgattcaggcgcaccagcttctgcaagcctcccagcgtgcaggcgcaggccaacttcttgtaccatctggcctccgccgccgctgcaaccaaacccgctgctttcgaggatgccggcagacttcccgacctcaagagtagtgtcaaagcggagtcgccggcggagtggaatctgcagagctgggcccccaaagcatctccggtgtactgcccggccagcctggggagttgtttcgctgagataaggaacgatagggtatctgagattacattcccacactctgaaatttccaatgctgtaaagagaactgacctgacaattaactgcctggcagagggggcctcttcacctagcccaaagacaaacaatgcatttccacaacaaagaatactccgagaggctaggaaatgcctacaaacaactcctactacacactgtgcagataacaacacaatagctgctaggttcttaaataatgattcttcaggagcagaagcaaattcagaaaaatattccaaaatccttcattgtcctgaatttgctacggatttgccctcttcgcagactgatcctgaagtgaacgctgcaggagcagcagcaactaaagccgagaatccctgcactgacacaggcgacaagacattgccatttctgcacaatattaaaatcaaagtagaagacagtagtgctaatgaagaatatgaacctcacctttttacaaataagctaaagtgcgagtgcaatgatacaaagggtgagttttacagtgtgactgagagtaaagaggaggacgccttgttaaccacagccaaggaaggttttgcatgccctgaaaaagaaactccttccttaaatccactggctcaaagtcagggcctttcatgcactttaggttctccaaaacctgaggatggggaatataaatttggtgccagggtgagaaaaaattaccggacactagtactgggaaagcgacctgtccttcagacacctccagtcaaaccaaatttgaaatcagctagaagccctcgtcctacaggtaaaactgagacaaatgaaggaacactggatgattttacagttataaacagacgcaaaaaggtagccagcaatgtagcatcagcagtgaaaaggccatttcatttcatggcaaattttccttgtccaccatcactcattattgggagagatggggatttgtggccggcgtattccttaaacaccactaaggattctcaaactcctcacaaggcccatcctatatggaaatggcagctgggcggttctgcaatacctcttccacctagtcacaaattcaggaaatttaattcataaaaatgttttggaagatattttcttgaaccatattaccttccttttgttgtaaactgcacaggatggtttgtacaagtcca

SEQ ID NO: 181948 - DNA, 3894 bp, Homo sapiens
  Payload ID: 15831
  Gene Symbol: SKIV2L
  Gene Name: SKI2 homolog, superkiller viralicidic activity 2-like
  Uniprot ID: Q15477
  ENST ID: ENST00000375394
  CDS Start-End: 114-3854
ggcggggctgtaccggaagttgcctctacttccgcccgttccggggcggggcttacttcgcagcgactacttgccgcacttccgggctgccaggcagctgctgtggctccaggatgatggagacagagcgacttgtgctaccccctccagatcccctggacctaccccttcgggccgtggagctcggatgcacggggcactgggagctgctgaacttgcctggagctccagagagtagccttccccatggcctccctccttgtgccccagatctgcagcaagaagcagaacagttgtttctgtcatccccagcctggctgcctctgcatggtgtggagcactcagcccgaaaatggcagaggaagacggatccctggtctcttttggctgtcctgggagccccagtcccatccgacctacaggcccaaagacacccaaccacaggccagatactgggttacaaagaggtcttgctggagaacacaaatctctcggctacaacctccttgtctcttcgccggcctccagggccagcctcccagtccttatggggaaatccaactcagtatcccttctggccaggggggatggatgaacccaccataacagatctgaacacacgggaggaggctgaggaggagatagactttgagaaagatcttcttactattccacctggtttcaagaaaggcatggactttgcaccaaaagattgtccaactccagctcctggactactaagccttagctgtatgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaacggcatgactctgtctttgtcgcagctcacacatctgcaggaaaaacagttgtggctgaatatgccattgccctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattgggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaagggccttgtgaccacaccgtggtcaagctccagccaggagatatggctgccatcaccaccaaggtgctccgggtgaatggggagaagatcttggaggacttcagcaagaggcagcagccaaaattcaagaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagtacctgaagctgcgggagcgaatgcagatacagaaggagatggagcggctgcgcttcctactgtcggatcagtcattgctgctgcttcctgagtaccatcagcgagtagaggtgctccgaaccctgggttatgtggacgaggcgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatgcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagcaaagcac

SEQ ID NO: 181949 - DNA, 3890 bp, Homo sapiens
  Payload ID: 15831
  Gene Symbol: SKIV2L
  Gene Name: SKI2 homolog, superkiller viralicidic activity 2-like
  Uniprot ID: Q15477
  ENST ID: ENST00000383336
  CDS Start-End: 114-3854
ggcggggctgtaccggaagttgcctctacttccgcccgttccggggcggggcttacttcgcagcgactacttgccgcacttccgggctgccaggcagctgctgtggctccaggatgatggagacagagcgacttgtgctaccccctccagatcccctggacctaccccttcgggccgtggagctcggatgcacggggcactgggagctgctgaacttgcctggagctccagagagtagccttccccatggcctccctccttgtgccccagatctgcagcaagaagcagaacagttgtttctgtcatccccagcctggctgcctctgcatggtgtggagcactcagcccgaaaatggcagaggaagacggatccctggtctcttttggctgtcctgggagccccagtcccatccgacctacaggcccaaagacacccaaccacaggccagatactgggttacaaagaggtcttgctggagaacacaaatctctcggctacaacctccttgtctcttcgccggcctccagggccagcctcccagtccttatggggaaatccaactcagtatcccttctggccaggggggatggatgaacccaccataacagatctgaacacacgggaggaggctgaggaggagatagactttgagaaagatcttcttactattccacctggtttcaagaaaggcatggactttgcaccaaaagattgtccaactccagctcctggactactaagccttagctgtctgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaacggcatgactctgtctttgtcgcagctcacacatctgcaggaaaaacagttgtggctgaatatgccattgccctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattgggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaagggccttgtgaccacaccgtggtcaagctccagccaggagatatggctgccatcaccaccaaggtgctccgggtgaatggggagaagatcttggaggacttcagcaagaggcagcagccaaaattcaagaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagtacctgaagctgcgggagcgaatgcagatacagaaggagatggagcggctgcgcttcctactgtcggatcagtcattgctgctgcttcctgagtaccatcagcgagtagaggtgctccgaaccctgggttacgtggacgaggcgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatgcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagcaaa

SEQ ID NO: 181950 - DNA, 3890 bp, Homo sapiens
  Payload ID: 15831
  Gene Symbol: SKIV2L
  Gene Name: SKI2 homolog, superkiller viralicidic activity 2-like
  Uniprot ID: Q15477
  ENST ID: ENST00000448219
  CDS Start-End: 114-3854
ggcggggctgtaccggaagttgcctctacttccgcccgttccggggcggggcttacttcgcagcgactacttgccgcacttccgggctgccaggcagctgctgtggctccaggatgatggagacagagcgacttgtgctaccccctccagatcccctggacctaccccttcgggccgtggagctcggatgcacggggcactgggagctgctgaacttgcctggagctccagagagtagccttccccatggcctccctccttgtgccccagatctgcagcaagaagcagaacagttgtttctgtcatccccagcctggctgcctctgcatggtgtggagcactcagcccgaaaatggcagaggaagacggatccctggtctcttttggctgtcctgggagccccagtcccatccgacctacaggcccaaagacacccaaccacaggccagatactgggttacaaagaggtcttgctggagaacacaaatctctcggctacaacctccttgtctcttcgccggcctccagggccagcctcccagtccttatggggaaatccaactcagtatcccttctggccaggggggatggatgaacccaccataacagatctgaacacacgggaggaggctgaggaggagatagactttgagaaagatcttcttactattccacctggtttcaagaaaggcatggactttgcaccaaaagattgtccaactccagctcctggactactaagccttagctgtatgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaacggcatgactctgtctttgtcgcagctcacacatctgcaggaaaaacagttgtggctgaatatgccattgccctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattgggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaagggccttgtgaccacaccgtggtcaagctccagccaggagatatggctgccatcaccaccaaggtgctccgggtgaatggggagaagatcttggaggacttcagcaagaggcagcagccaaaattcaagaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagtacctgaagctgcgggagcgaatgcagatacagaaggagatggagcggctgcgcttcctactgtcggatcagtcattgctgctgcttcctgagtaccatcagcgagtagaggtgctccgaaccctgggttatgtggacgaggcgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatgcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagcaaa

SEQ ID NO: 181951 - DNA, 3890 bp, Homo sapiens; identical to SEQ ID NO: 181949
  Payload ID: 15831
  Gene Symbol: SKIV2L
  Gene Name: SKI2 homolog, superkiller viralicidic activity 2-like
  Uniprot ID: Q15477
  ENST ID: ENST00000421789
  CDS Start-End: 114-3854

SEQ ID NO: 181952 - DNA, 3890 bp, Homo sapiens; identical to SEQ ID NO: 181949
  Payload ID: 15831
  Gene Symbol: SKIV2L
  Gene Name: SKI2 homolog, superkiller viralicidic activity 2-like
  Uniprot ID: Q15477
  ENST ID: ENST00000412823
  CDS Start-End: 114-3854

SEQ ID NO: 181953 - DNA, 3890 bp, Homo sapiens
  Payload ID: 15831
  Gene Symbol: SKIV2L
  Gene Name: SKI2 homolog, superkiller viralicidic activity 2-like
  Uniprot ID: Q15477
  ENST ID: ENST00000429465
  CDS Start-End: 114-3854
ggcggggctgtaccggaagttgcctctacttccgcccgttccggggcggggcttacttcgcagcgactacttgccgcacttccgggctgccaggcagctgctgtggctccaggatgatggagacagagcgacttgtgctaccccctccagatcccctggacctaccccttcgggccgtggagctcggatgcacggggcactgggagctgctgaacttgcctggagctccagagagtagccttccccatggcctccctccttgtgccccagatctgcagcaagaagcagaacagttgtttctgtcatccccagcctggctgcctctgcatggtgtggagcactcagcccgaaaatggcagaggaagacggatccctggtctcttttggctgtcctgggagccccagtcccatccgacctacaggcccaaagacacccaaccacaggccagatactgggttacaaagaggtcttgctggagaacacaaatctctcggctacaacctccttgtctcttcgccggcctccagggccagcctcccagtccttatggggaaatccaactcagtatcccttctggccaggggggatggatgaacccaccataacagatctgaacacacgggaggaggctgaggaggagatagactttgagaaagatcttcttactattccacctggtttcaagaaaggcatggactttgcaccaaaagattgtccaactccagctcctggactactaagccttagctgtctgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaacggcatgactctgtctttgtcgcagctcacacatctgcaggaaaaacagttgtggctgaatatgccattgctctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattgggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaagggccttgtgaccacaccgtggtcaagctccagccaggagatatggctgccatcaccaccaaggtgctccgggtgaatggggagaagatcttggaggacttcagcaagaggcagcagccaaaattcaagaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagtacctgaagctgcgggagcgaatgcagatacagaaggagatggagcggctgcgcttcctactgtcggatcagtcattgctgctgcttcctgagtaccatcagcgagtagaggtgctccgaaccctgggttacgtggacgaggcgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatgcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagcaaa

SEQ ID NO: 181954 - DNA, 866 bp, Homo sapiens
  Payload ID: 15831
  Gene Symbol: SKIV2L
  Gene Name: SKI2 homolog, superkiller viralicidic activity 2-like
  ENST ID: ENST00000491994
  CDS Start-End: 1-547
ccggaagctggaggagctgatccagggggctcagtgtgtacacagcccccgttttcctgcccagtacctgaagctgcgggagcgaatgcagatacagaaggagatggagcggctgcgcttcctactgtcggatcagtcattgctgctgcttcctgagtaccatcagcgagtagaggtgctccgaaccctgggttatgtggacgaggcgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatggtgagtacctgaggtttgggattttgcagacggctggctggggagaacctgcccaggctgagtgcatccagtcctcaccctactttccccacagcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagcaaa

SEQ ID NO: 181955 - DNA, 1157 bp, Homo sapiens
  Payload ID: 15831
  Gene Symbol: SKIV2L
  Gene Name: SKI2 homolog, superkiller viralicidic activity 2-like
  ENST ID: ENST00000461073
  CDS Start-End: 37-729
acttccgggctgccaggcagctgctgtggctccaggatgatggagacagagcgacttgtgctaccccctccagatcccctggacctaccccttcgggccgtggagctcggatgcacggggcactgggagctgctgaacttgcctggagctccagagagtagccttccccatggcctccctccttgtgccccagatctgcagcaagaagcagaacagttgtttctgtcatccccagcctggctgcctctgcatggtgtggagcactcagcccgaaaatggcagaggaagacggatccctggtctcttttggctgtcctgggagccccagtcccatccgacctacaggcccaaagacacccaaccacaggccagatactgggttacaaagaggtcttgctggagaacacaaatctctcggctacaacctccttgtctcttcgccggcctccagggccagcctcccagtccttatggggaaatccaactcagtatcccttctggccaggggggatggatgaacccaccataacagatctgaacacacgggaggaggctgaggaggagatagactttgagaaagatcttcttactattccacctggtttcaagaaaggcatggactttgcaccaaaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaacggcatgactctgtctttgtcgcagctcacacatctgcaggaaaaacagttgtggctgaatatgccattgccctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcgctccatgctgtacagtggctcagatgttattcgggacctggagtgggtcatctttgatgaggttcactatatcaacgatgtcgaggtaagggccatgggct

SEQ ID NO: 181956 - DNA, 1307 bp, Homo sapiens
  Payload ID: 15831
  Gene Symbol: SKIV2L
  Gene Name: SKI2 homolog, superkiller viralicidic activity 2-like
  ENST ID: ENST00000483553
  CDS Start-End: 1-469
gtgtgataagcccttgtcccaggacccacaggacagggggccagccactgcagaggtgccctatccagatgacctcgtgggattcaagctgttcctgcctgaagggccttgtgaccacaccgtggtcaagctccagccaggagatatggctgccatcaccaccaaggtgctccgggtgaatggggagaagatcttggaggacttcagcaagaggcagcagccaaaattcaagaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagcccttgtcctcagtgcacccctgctaaggggcaaggagaaggctgacgggtggctctctgcagtacctgaagctgcgggagcgaatgcagatacagaaggagatggagcggctgcgcttcctactgtcggatcagtcattgctgctgcttcctgagtaccatcagcgagtagaggtgctccgaaccctgggttatgtggacgaggcgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatggtgagtacctgaggtttgggattttgcagacggctggctggggagaacctgcccaggctgagtgcatccagtcctcaccctactttccccacagcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagcaaa

SEQ ID NO: 181957 - DNA, 3378 bp, Homo sapiens
  Payload ID: 15831
  Gene Symbol: SKIV2L
  Gene Name: SKI2 homolog, superkiller viralicidic activity 2-like
  ENST ID: ENST00000474839
  CDS Start-End: 23-232
aggcagctgctgtggctccaggatgatggagacagagcgacttgtgctaccccctccagatcccctggacctaccccttcgggccgtggagctcggatgcacggggcactgggagctgctgaacttgcctggagctccagagagtagcatcttcttactattccacctggtttcaagaaaggcatggactttgcaccaaaagattgtccaactccagctcctggactactaagccttagctgtatgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaacggcatgactctgtctttgtcgcagctcacacatctgcaggaaaaacagttgtggctgaatatgccattgccctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattgggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaagggccttgtgaccacaccgtggtcaagctccagccaggagatatggctgccatcaccaccaaggtgctccgggtgaatggggagaagatcttggaggacttcagcaagaggcagcagccaaaattcaagaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagtacctgaagctgcgggagcgaatgcagatacagaaggagatggagcggctgcgcttcctactgtcggatcagtcattgctgctgcttcctgagtaccatcagcgagtagaggtgctccgaaccctgggttatgtggacgaggcgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatgcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagc

SEQ ID NO: 181958 - DNA, 210 bp, Homo sapiens
  Payload ID: 15831
  Gene Symbol: SKIV2L
  Gene Name: SKI2 homolog, superkiller viralicidic activity 2-like
  ENST ID: ENST00000628157
  CDS Start-End: 1-210
atgatggagacagagcgacttgtgctaccccctccagatcccctggacctaccccttcgggccgtggagctcggatgcacggggcactgggagctgctgaacttgcctggagctccagagagtagcatcttcttactattccacctggtttcaagaaaggcatggactttgcaccaaaagattgtccaactccagctcctggactactaa

SEQ ID NO: 181959 - DNA, 210 bp, Homo sapiens; identical to SEQ ID NO: 181958
  Payload ID: 15831
  Gene Symbol: SKIV2L
  Gene Name: SKI2 homolog, superkiller viralicidic activity 2-like
  ENST ID: ENST00000627041
  CDS Start-End: 1-210

SEQ ID NO: 181960 - DNA, 210 bp, Homo sapiens; identical to SEQ ID NO: 181958
  Payload ID: 15831
  Gene Symbol: SKIV2L
  Gene Name: SKI2 homolog, superkiller viralicidic activity 2-like
  ENST ID: ENST00000627683
  CDS Start-End: 1-210

SEQ ID NO: 181961 - DNA, 210 bp, Homo sapiens; identical to SEQ ID NO: 181958
  Payload ID: 15831
  Gene Symbol: SKIV2L
  Gene Name: SKI2 homolog, superkiller viralicidic activity 2-like
  ENST ID: ENST00000626050
  CDS Start-End: 1-210

SEQ ID NO: 181962 - DNA, 210 bp, Homo sapiens; identical to SEQ ID NO: 181958
  Payload ID: 15831
  Gene Symbol: SKIV2L
  Gene Name: SKI2 homolog, superkiller viralicidic activity 2-like
  ENST ID: ENST00000627011
  CDS Start-End: 1-210

SEQ ID NO: 181963 - DNA, 210 bp, Homo sapiens; identical to SEQ ID NO: 181958
  Payload ID: 15831
  Gene Symbol: SKIV2L
  Gene Name: SKI2 homolog, superkiller viralicidic activity 2-like
  ENST ID: ENST00000626668
  CDS Start-End: 1-210

SEQ ID NO: 181964 - DNA, 3057 bp, Homo sapiens
  Payload ID: 15832
  Gene Symbol: SKIL
  Gene Name: SKI-like proto-oncogene
  Uniprot ID: P12757
  ENST ID: ENST00000259119
  CDS Start-End: 672-2726
gagcgggcgagcggcgacggcggcggcggcgggcacagattaattaaaagaagaatgaactataatccttgaagataactgggcaattttttaagtcggaggctgttcttactggtgtgaggatttacacacgtcttcagtttttcagcacagaccagcagaccatcatttttagaggaaatactccctctgccctcctttttggtttccttggtggtaaagattaaatttggttgcatcattttgacttgtgtttgagtctagattttatggcacaaggaatggcataaacttttcatgtgttttggttaaaacaaaccagaccattgcattgaccctggacatctttaattgagaaattggtaactttattttaatatgtatatctgaagaattcaagaaaacaaaggcatcctcagaggtgtgcctcttttctttattattagaggcaaaacgaacaattttataggatttgtagtgaaattataccagattataaggagaaccaaaactaagtcgcaaaatttattaatttaaggggctctcgctttgaaagtttgagagtaagttacgataggcatttgtatccattcattactttcctcttttcaaataagcaactaaatagaaatgctaatctcagacttaattatttaacagaagagtgtaccatggaaaacctccagacaaatttctccttggttcagggctcaactaaaaaactgaatgggatgggagatgatggcagccccccagcgaaaaaaatgataacggacattcatgcaaatggaaaaacgataaacaaggtgccaacagttaagaaggaacacttggatgactatggagaagcaccagtggaaactgatggagagcatgttaagcgaacctgtacttctgttcctgaaactttgcatttaaatcccagtttgaaacacacattggcacaattccatttaagtagtcagagctcgctgggtggaccagcagcattttctgctcggcattcccaagaaagcatgtcgcctactgtatttctgcctcttccatcacctcaggttcttcctggcccattgctcatcccttcagatagctccacagaactcactcagactgtgttggaaggggaatctatttcttgttttcaagttggaggagaaaagagactctgtttgccccaagtcttaaattctgttctccgagaatttacactccagcaaataaatacagtgtgtgatgaactgtacatatattgttcaaggtgtacttcagaccagcttcatatcttaaaggtactgggcatacttccattcaatgccccatcctgtgggctgattacattaactgatgcacaaagattatgtaatgctttattgcggccacgaacttttcctcaaaatggtagcgtacttcctgctaaaagctcattggcccagttaaaggaaactggcagtgcctttgaagtggagcatgaatgcctaggcaaatgtcagggtttatttgcaccccagttttatgttcagcctgatgctccgtgtattcaatgtctggagtgttgtggaatgtttgcaccccagacgtttgtgatgcattctcacagatcacctgacaaaagaacttgccactggggctttgaatcagctaaatggcattgctatcttcatgtgaaccaaaaatacttaggaacacctgaagaaaagaaactgaagataattttagaagaaatgaaggagaagtttagcatgagaagtggaaagagaaatcaatccaagacagatgcaccatcaggaatggaattacagtcatggtatcctgttataaagcaggaaggtgaccatgtttctcagacacattcatttttacaccccagctactacttatacatgtgtgataaagtggttgccccaaatgtgtcacttacttctgctgtatcccagtctaaagagctcacaaagacagaggcaagtaagtccatatcaagacagtcagagaaggctcacagtagtggtaaacttcaaaaaacagtgtcttatccagatgtctcacttgaggaacaggagaaaatggatttaaaaacaagtagagaattatgtagccgtttagatgcatcaatctcaaataattctacaagtaaaaggaaatctgagtctgccacttgcaacttagtcagagacataaacaaagtgggaattggccttgttgctgccgcttcatctccgcttcttgtgaaagatgtcatttgtgaggatgataagggaaaaatcatggaagaagtaatgagaacttatttaaaacaacaggaaaaactaaacttgattttgcaaaagaagcaacaacttcagatggaagtaaaaatgttgagtagttcaaaatctatgaaggaactcactgaagaacagcagaatttacagaaagagcttgaatctttgcagaatgaacatgctcaaagaatggaagaattttatgttgaacagaaagacttagagaaaaaattggagcagataatgaagcaaaaatgtacctgtgactcaaatttagaaaaagacaaagaggctgaatatgcaggacagttggcagaactgaggcagagattggaccatgctgaggccgataggcaagaactccaagatgaactcagacaggaacgggaagcaagacagaagttagagatgatgataaaagagctaaagctgcaaattctgaaatcatcaaagactgctaaagaatagaaactgttaaagagattcatctgtgtattactgacaaggttttttttgtttgttgcttgctttggtaattgaattctgaagaatttatctgcatgacgataactaggcattctatccatttgtagatcagagaaagtgaagagattatatattagtacttaaatttttacattttccaaatgaatgaaaatgtatgtttctttgtacttttttaaaaaaatcagcttagtaacaatactatatggtttcaactagtaggtaatctgcttatatttctaatgcaaacttaacaattgtgtactttttaaaagctgcaatatgtgttggaaaa

SEQ ID NO: 181965 - DNA, 2702 bp, Homo sapiens
  Payload ID: 15832
  Gene Symbol: SKIL
  Gene Name: SKI-like proto-oncogene
  Uniprot ID: P12757
  ENST ID: ENST00000413427
  CDS Start-End: 710-2626
ggtttcaaattggccctttggcctctggagcaaattcaaatgtaactcttccccaaccccccttctcttcttccagattaattaaaagaagaatgaactataatccttgaagataactgggcaattttttaagtcggaggctgttcttactggtgtgaggatttacacacgtcttcagtttttcagcacagaccagcagaccatcatttttagaggaaatactccctctgccctcctttttggtttccttggtggtaaagattaaatttggttgcatcattttgacttgtgtttgagtctagattttatggcacaaggaatggcataaacttttcatgtgttttggttaaaacaaaccagaccattgcattgaccctggacatctttaattgagaaattggtaactttattttaatatgtatatctgaagaattcaagaaaacaaaggcatcctcagaggtgtgcctcttttctttattattagaggcaaaacgaacaattttataggatttgtagtgaaattataccagattataaggagaaccaaaactaagtcgcaaaatttattaatttaaggggctctcgctttgaaagtttgagagtaagttacgataggcatttgtatccattcattactttcctcttttcaaataagcaactaaatagaaatgctaatctcagacttaattatttaacagaagagtgtaccatggaaaacctccagacaaatttctccttggttcagggctcaactaaaaaactgaatgggatgggagatgatggcagccccccagcgaaaaaaatgataacggacattcatgcaaatggaaaaacgataaacaaggtgccaacagttaagaaggaacacttggatgactatggagaagcaccagtggaaactgatggagagcatgttaagcgaacctgtacttctgttcctgaaactttgcatttaaatcccagtttgaaacacacattggcacaattccatttaagtagtcagagctcgctgggtggaccagcagcattttctgctcggcattcccaagaaagcatgtcgcctactgtatttctgcctcttccatcacctcaggttcttcctggcccattgctcatcccttcagatagctccacagaactcactcagactgtgttggaaggggaatctatttcttgttttcaagttggaggagaaaagagactctgtttgccccaagtcttaaattctgttctccgagaatttacactccagcaaataaatacagtgtgtgatgaactgtacatatattgttcaaggtgtacttcagaccagcttcatatcttaaaggtactgggcatacttccattcaatgccccatcctgtgggctgattacattaactgatgcacaaagattatgtaatgctttattgcggccacgaacttttcctcaaaatggtagcgtacttcctgctaaaagctcattggcccagttaaaggaaactggcagtgcctttgaagtggagcatgaatgcctaggcaaatgtcagggtttatttgcaccccagttttatgttcagcctgatgctccgtgtattcaatgtctggagtgttgtggaatgtttgcaccccagacgtttgtgatgcattctcacagatcacctgacaaaagaacttgccactggggctttgaatcagctaaatggcattgctatcttcatgtgaaccaaaaatacttaggaacacctgaagaaaagaaactgaagataattttagaagaaatgaaggagaagtttagcatgagaagtggaaagagaaatcaatccaagacagatgcaccatcaggaatggaattacagtcatggtatcctgttataaagcaggaaggtgaccatgtttctcagacacattcatttttacaccccagctactacttatacatgtgtgataaagtggttgccccaaatgtgtcacttacttctgctgtatcccagtctaaagagctcacaaagacagaggcaaatgcatcaatctcaaataattctacaagtaaaaggaaatctgagtctgccacttgcaacttagtcagagacataaacaaagtgggaattggccttgttgctgccgcttcatctccgcttcttgtgaaagatgtcatttgtgaggatgataagggaaaaatcatggaagaagtaatgagaacttatttaaaacaacaggaaaaactaaacttgattttgcaaaagaagcaacaacttcagatggaagtaaaaatgttgagtagttcaaaatctatgaaggaactcactgaagaacagcagaatttacagaaagagcttgaatctttgcagaatgaacatgctcaaagaatggaagaattttatgttgaacagaaagacttagagaaaaaattggagcagataatgaagcaaaaatgtacctgtgactcaaatttagaaaaagacaaagaggctgaatatgcaggacagttggcagaactgaggcagagattggaccatgctgaggccgataggcaagaactccaagatgaactcagacaggaacgggaagcaagacagaagttagagatgatgataaaagagctaaagctgcaaattctgaaatcatcaaagactgctaaagaatagaaactgttaaagagattcatctgtgtattactgacaaggttttttttgtttgttgcttgctttggtaattgaattc

SEQ ID NO: 181966 - DNA, 2757 bp, Homo sapiens
  Payload ID: 15832
  Gene Symbol: SKIL
  Gene Name: SKI-like proto-oncogene
  Uniprot ID: P12757
  ENST ID: ENST00000426052
  CDS Start-End: 233-2227
gagcggcgacggcggcggcggcgggcacagattaattaaaagaagaatgaactataatccttgaagataactgggcaattttttaagtcggaggctgttcttactggtgtgaggatttacacacgtcttcagtttttcagcacagaccagcagaccatcatttttagaggaaatactccctctgccctcctttttggtttccttggtgggctcaactaaaaaactgaatgggatgggagatgatggcagccccccagcgaaaaaaatgataacggacattcatgcaaatggaaaaacgataaacaaggtgccaacagttaagaaggaacacttggatgactatggagaagcaccagtggaaactgatggagagcatgttaagcgaacctgtacttctgttcctgaaactttgcatttaaatcccagtttgaaacacacattggcacaattccatttaagtagtcagagctcgctgggtggaccagcagcattttctgctcggcattcccaagaaagcatgtcgcctactgtatttctgcctcttccatcacctcaggttcttcctggcccattgctcatcccttcagatagctccacagaactcactcagactgtgttggaaggggaatctatttcttgttttcaagttggaggagaaaagagactctgtttgccccaagtcttaaattctgttctccgagaatttacactccagcaaataaatacagtgtgtgatgaactgtacatatattgttcaaggtgtacttcagaccagcttcatatcttaaaggtactgggcatacttccattcaatgccccatcctgtgggctgattacattaactgatgcacaaagattatgtaatgctttattgcggccacgaacttttcctcaaaatggtagcgtacttcctgctaaaagctcattggcccagttaaaggaaactggcagtgcctttgaagtggagcatgaatgcctaggcaaatgtcagggtttatttgcaccccagttttatgttcagcctgatgctccgtgtattcaatgtctggagtgttgtggaatgtttgcaccccagacgtttgtgatgcattctcacagatcacctgacaaaagaacttgccactggggctttgaatcagctaaatggcattgctatcttcatgtgaaccaaaaatacttaggaacacctgaagaaaagaaactgaagataattttagaagaaatgaaggagaagtttagcatgagaagtggaaagagaaatcaatccaagacagatgcaccatcaggaatggaattacagtcatggtatcctgttataaagcaggaaggtgaccatgtttctcagacacattcatttttacaccccagctactacttatacatgtgtgataaagtggttgccccaaatgtgtcacttacttctgctgtatcccagtctaaagagctcacaaagacagaggcaagtaagtccatatcaagacagtcagagaaggctcacagtagtggtaaacttcaaaaaacagtgtcttatccagatgtctcacttgaggaacaggagaaaatggatttaaaaacaagtagagaattatgtagccgtttagatgcatcaatctcaaataattctacaagtaaaaggaaatctgagtctgccacttgcaacttagtcagagacataaacaaagtgggaattggccttgttgctgccgcttcatctccgcttcttgtgaaagatgtcatttgtgaggatgataagggaaaaatcatggaagaagtaatgagaacttatttaaaacaacaggaaaaactaaacttgattttgcaaaagaagcaacaacttcagatggaagtaaaaatgttgagtagttcaaaatctatgaaggaactcactgaagaacagcagaatttacagaaagagcttgaatctttgcagaatgaacatgctcaaagaatggaagaattttatgttgaacagaaagacttagagaaaaaattggagcagataatgaagcaaaaatgtacctgtgactcaaatttagaaaaagacaaagaggctgaatatgcaggacagttggcagaactgaggcagagattggaccatgctgaggccgataggcaagaactccaagatgaactcagacaggaacgggaagcaagacagaagttagagatgatgataaaagagctaaagctgcaaattctgaaatcatcaaagactgctaaagaatagaaactgttaaagagattcatctgtgtattactgacaaggttttttttgtttgttgcttgctttggtaattgaattctgaagaatttatctgcatgacgataactaggcattctatccatttgtagatcagagaaagtgaagagattatatattagtacttaaatttttacattttccaaatgaatgaaaatgtatgtttctttgtacttttttaaaaaaatcagcttagtaacaatactatatggtttcaactagtaggtaatctgcttatatttctaatgcaaacttaacaattgtgtactttttaaaagctgcaatatgtgttggaaaatagctgtggtcaattttgttatccatatttcagactcaattttagatacaatggtggctttatattttaagtatatagagctactcaaggagttgaatctccccttttctcattaacacaatttttctaagttgatatggtgtactcattaacatacaccaaatttacttttactttgttcagattgtggaatgaattt

SEQ ID NO: 181967 - DNA, 7182 bp, Homo sapiens
  Payload ID: 15832
  Gene Symbol: SKIL
  Gene Name: SKI-like proto-oncogene
  Uniprot ID: P12757
  ENST ID: ENST00000458537
  CDS Start-End: 710-2764
ggtttcaaattggccctttggcctctggagcaaattcaaatgtaactcttccccaaccccccttctcttcttccagattaattaaaagaagaatgaactataatccttgaagataactgggcaattttttaagtcggaggctgttcttactggtgtgaggatttacacacgtcttcagtttttcagcacagaccagcagaccatcatttttagaggaaatactccctctgccctcctttttggtttccttggtggtaaagattaaatttggttgcatcattttgacttgtgtttgagtctagattttatggcacaaggaatggcataaacttttcatgtgttttggttaaaacaaaccagaccattgcattgaccctggacatctttaattgagaaattggtaactttattttaatatgtatatctgaagaattcaagaaaacaaaggcatcctcagaggtgtgcctcttttctttattattagaggcaaaacgaacaattttataggatttgtagtgaaattataccagattataaggagaaccaaaactaagtcgcaaaatttattaatttaaggggctctcgctttgaaagtttgagagtaagttacgataggcatttgtatccattcattactttcctcttttcaaataagcaactaaatagaaatgctaatctcagacttaattatttaacagaagagtgtaccatggaaaacctccagacaaatttctccttggttcagggctcaactaaaaaactgaatgggatgggagatgatggcagccccccagcgaaaaaaatgataacggacattcatgcaaatggaaaaacgataaacaaggtgccaacagttaagaaggaacacttggatgactatggagaagcaccagtggaaactgatggagagcatgttaagcgaacctgtacttctgttcctgaaactttgcatttaaatcccagtttgaaacacacattggcacaattccatttaagtagtcagagctcgctgggtggaccagcagcattttctgctcggcattcccaagaaagcatgtcgcctactgtatttctgcctcttccatcacctcaggttcttcctggcccattgctcatcccttcagatagctccacagaactcactcagactgtgttggaaggggaatctatttcttgttttcaagttggaggagaaaagagactctgtttgccccaagtcttaaattctgttctccgagaatttacactccagcaaataaatacagtgtgtgatgaactgtacatatattgttcaaggtgtacttcagaccagcttcatatcttaaaggtactgggcatacttccattcaatgccccatcctgtgggctgattacattaactgatgcacaaagattatgtaatgctttattgcggccacgaacttttcctcaaaatggtagcgtacttcctgctaaaagctcattggcccagttaaaggaaactggcagtgcctttgaagtggagcatgaatgcctaggcaaatgtcagggtttatttgcaccccagttttatgttcagcctgatgctccgtgtattcaatgtctggagtgttgtggaatgtttgcaccccagacgtttgtgatgcattctcacagatcacctgacaaaagaacttgccactggggctttgaatcagctaaatggcattgctatcttcatgtgaaccaaaaatacttaggaacacctgaagaaaagaaactgaagataattttagaagaaatgaaggagaagtttagcatgagaagtggaaagagaaatcaatccaagacagatgcaccatcaggaatggaattacagtcatggtatcctgttataaagcaggaaggtgaccatgtttctcagacacattcatttttacaccccagctactacttatacatgtgtgataaagtggttgccccaaatgtgtcacttacttctgctgtatcccagtctaaagagctcacaaagacagaggcaagtaagtccatatcaagacagtcagagaaggctcacagtagtggtaaacttcaaaaaacagtgtcttatccagatgtctcacttgaggaacaggagaaaatggatttaaaaacaagtagagaattatgtagccgtttagatgcatcaatctcaaataattctacaagtaaaaggaaatctgagtctgccacttgcaacttagtcagagacataaacaaagtgggaattggccttgttgctgccgcttcatctccgcttcttgtgaaagatgtcatttgtgaggatgataagggaaaaatcatggaagaagtaatgagaacttatttaaaacaacaggaaaaactaaacttgattttgcaaaagaagcaacaacttcagatggaagtaaaaatgttgagtagttcaaaatctatgaaggaactcactgaagaacagcagaatttacagaaagagcttgaatctttgcagaatgaacatgctcaaagaatggaagaattttatgttgaacagaaagacttagagaaaaaattggagcagataatgaagcaaaaatgtacctgtgactcaaatttagaaaaagacaaagaggctgaatatgcaggacagttggcagaactgaggcagagattggaccatgctgaggccgataggcaagaactccaagatgaactcagacaggaacgggaagcaagacagaagttagagatgatgataaaagagctaaagctgcaaattctgaaatcatcaaagactgctaaagaatagaaactgttaaagagattcatctgtgtattactgacaaggttttttttgtttgttgcttgctttggtaattgaattctgaagaatttatctgcatgacgataactaggcattctatccatttgtagatcagagaaagtgaagagattatatattagtacttaaatttttacattttccaaatgaatgaaaatgtatgtttctttgtacttttttaaaaaaatcagcttagtaacaatactatatggtttcaactagtaggtaatctgcttatatttctaatgcaaacttaacaattgtgtactttttaaaagctgcaatatgtgttggaaaatagctgtggtcaattttgttatccatatttcagactcaattttagatacaatggtggctttatattttaagtatatagagctactcaaggagttgaatctccccttttctcattaacacaatttttctaagttgatatggtgtactcattaacatacaccaaatttacttttactttgttcagattgtggaatgaatttccaccagttctcttctttttaatgtgtaccctaggaggaattttactgaggttatagcataccccatgagcacagtggggaagaagaatgtgttgttatgtgctgctgctaaacagaagcagcagttgtaatttgtttttcagtttaaatgtggttatagttagatttttttttaagcagcaacttttcaaaaataaaatgtgataatttctgaacttttgtttgtgttgttaatagtggtgtgaaaatattaacgttcttgagaaaaactgataccactgttgtgtatcagtttctatacaatccataatcctcctgtacagtttttacatgtagttatgagtcttactaaaatttatataatggacttgttttcctttaagttgtaaaatgttaaacaccttgaaggttattttggacttctgtatgtttaaatgttgtcttaccaaaatttgcacgaatggaccattttcatttactacttaatatcaaaatcaggaatttacagtcaactgatagtacatgataggtgcatataggacagtttagttacctgctactaaaagatttttagataagttttagaagataaaggaattccatagtttcaggagggacaacatcttctgcactttttttttgcacagaaaagtctgtcattctctaatggcaaatttcatatttgttaattcttggctcaaaatatattaggtaaaattcttagatctgtttttaaagggagtttcctgaaactatcattaattgacattattaccccatggattttatgggataataaatgtttttcatgttctcttataagatactatgtatgaaattacttcagagagctatatttattttaaaataaattagctagggttaaggttatattctatttccagcatagaaggtagataatctaatggtgtagaaagaatcactaggttgtcatttaaccagttattttcatattttgcttaatagtacatatccaaaaagaattttgtacttccccaaatgtaatttatttactaaattgagtataacctaaatgtgtgttttctattttccatttaaattttgctatattaagactaatttaattcgttgagtcttggaatcttctcaaggaggaacaaatattaaaatgacatgtagaaacaaatttttttttttttttttttttttttttttttgagacagagtctcgctgtctcccaggctggagttcagtggtgcaatctcggctcactgcaagctctgcctcctgggttcaagccattctcctgcctcagcctcccgagtagctgggactacaggcacccaccaccactcccggctaatttttagaaacaaatatttaaaatgacatattctcccaatacaatctatttagatctggagaaggaaaaatcagatatttatgatatagttttattttaattttgaattatttgtgtcacagctcagctttttggaagacaaactcaaacacctataatttcatttatatttctaattcacttggaacctttctgctttatgttacctagaaaatgataatttgtttaacccaaaacttctaaaataaattgcttaatccttgaaatatgttattggaaaattttaagcagtgcttaaacaccattaaattattatgaacttgtaattcagaattgagtaaagaaatattttttctagtccttcatatattgaaaacttgccacatgacattgtatcgtcttcattttccagaagatgcgttggtgtgccataggtttctaacttccttgaaaatagttttttaagtcaattgtaaatatacgtattattgttaaaagtaactttaaactgcaacacatagcttcaaaacaatatagagattttgtaataccttataagtggagttggctaaaataccttatccatataaaacttattctattctttgcatgcttattttgtgtgttggttgctagcttaaagtttgatttgttgttactctttgtgtgccaaattcactaggcaagcggatttttcctcagacttcaaaaaataattcttttaagaaaaaatgtaaaaatgtttattctaaaaagctgcattaaagggacaacctataaaaagttttgctagctcatctttagaaggaagaaagaatattagcttgggtgatgtttaatttgggtggcgatagtttctgtaggctaaactttatgagaaaagtgtacctactctataaaggtaataaatgtaaaacctcttgctgttattgaggaagctcttcaactaccctaaatttcacaaatgtaacttataacactatgaaaagatttgaccaacaatttacgtttgctgtgtgctttagtttttgtttaagcatattcttttgcttgaatttctgtgttcatgagagttagggtgttttatgcttcttgaactaattttataacatatttaatatattaccagttaagatataaaatcatttgtacatagcgaattgtaaagcagctattaaagtaggtgaaataaagtatatatttgccggttatccatatcttttagaagtcctgacagaacaaccagtttatttgcacataggtagcttctgtttgaaggaaggtaaagttataaggaaactcaaatactataagatgtgtcaaggtatttctccagaattaattgcaaagctagtgctgaaggattttaatcagcttctaaaattttcttctcaataaggcatatgttttgattacttagggaagattcctcatttttatttgccctttatgcatttaatccacatgataggacattaaaaattaatataaagaaaaatcgtgctcatactgtacatctgtttctgtgcttggaactacttgttaatagtttttatcgaagctgtcagcaataagggacataaaactgctgtattatacattgtggaattgaataaacagcctaattttttttttctagtatagggtacttaagcatttccacttttggaagaaaagtgtattagtattttatattgcatttcatttaaaaggacagttttttttttttttttgtaaatccattcattgaaatggtttctaaactgtataatgtaatttggagcctatttagtaatagaattaaatgtcctatgtagtgctacaatttttgaattagaaagtgatcaaatgtaagaaaaaaatttaaaaattcagcccagaaaacaaaatagtgtattaaattagtttaatgtaaaaggaatttataagatttttttcctcaatatagatacctcacttgaaaagaaagcacagcatacttaaagtagttctagtaaacatgtcctagaaaacagttgctaaatgtaggacatcttttgaggaattagtttatgagaaataaaattttacttgtttttactatcctgttagaagtatttgtttatcctgataattttaagccaacatagtagtcttaaattacttttgaatttctaatctgtgaaggcagtaaatgaaatatctgttctgcaactgttgaaacaaataattggctacattgaccataattaaagttaaaattttgccaatgatgtacagttttatggttaaagttgctgtggttggttgcattacatgacacagaaaactgtcctctacctcacgtgaaataaatattttatatggttttactaaaaataagactcatgtatctggtcacctagtttacaaattttgaattatatttattgaaacatgacatactgtgctctgagcttatacctcaattgtattttgtgctgttttccattttcatgccttgtaaataacttgtatagattgtggatcaaatactaaataaaaacttttaatgccaattaaa

SEQ ID NO: 181968 - DNA, 607 bp, Homo sapiens
  Payload ID: 15832
  Gene Symbol: SKIL
  Gene Name: SKI-like proto-oncogene
  ENST ID: ENST00000476188
  CDS Start-End: 239-607
acagccgaagggagcgggcgagcggcgacggcggcggcggcgggcacagattaattaaaagaagaatgaactataatccttgaagataactgggcaattttttaagtcggaggctgttcttactggtgtgaggatttacacacgtcttcagtttttcagcacagaccagcagaccatcatttttagaggaaatactccctctgccctcctttttggtttccttggtgaagagtgtaccatggaaaacctccagacaaatttctccttggttcagggctcaactaaaaaactgaatgggatgggagatgatggcagccccccagcgaaaaaaatgataacggacattcatgcaaatggaaaaacgataaacaaggtgccaacagttaagaaggaacacttggatgactatggagaagcaccagtggaaactgatggagagcatgttaagcgaacctgtacttctgttcctgaaactttgcatttaaatcccagtttgaaacacacattggcacaattccatttaagtagtcagagctcgctgggtggaccagcagcattttctgctcggcattcccaagaaagcatgtcgcctactgtatttctgcct

SEQ ID NO: 181969 - DNA, 710 bp, Homo sapiens
  Payload ID: 15832
  Gene Symbol: SKIL
  Gene Name: SKI-like proto-oncogene
  ENST ID: ENST00000470571
  CDS Start-End: 1-335
gttgtggaatgtttgcaccccagacgtttgtgatgcattctcacagatcacctgacaaaagaacttgccactggggctttgaatcagctaaatggcattgctatcttcatgtgaaccaaaaatacttaggaacacctgaagaaaagaaactgaagataattttagaagaaatgaaggagaagtttagcatgagaagtggaaagagaaatcaatccaagacagatgcaccatcaggaatggaattacagtcatggtatcctgttataaagcaggaaggtgaccatgtttctcagacacattcatttttacaccccagatgcatcaatctcaaataattctacaagtaaaaggaaatctgagtctgccacttgcaacttagtcagagacataaacaaagtgggaattggccttgttgctgccgcttcatctccgcttcttgtgaaagatgtcatttgtgaggatgataagggaaaaatcatggaagaagtaatgagaacttatttaaaacaacaggaaaaactaaacttgattttgcaaaagaagcaacaacttcagatggaagtaaaaatgttgagtagttcaaaatctatgaaggaactcactgaagaacagcagaatttacagaaagagcttgaatctttgcagaatgaacatgctcaaagaatggaagaattttatgttgaacagaaagacttagagaaaaaattgga

SEQ ID NO: 181970 - DNA, 2090 bp, Homo sapiens
  Payload ID: 15833
  Gene Symbol: SLAIN1
  Gene Name: SLAIN motif family, member 1
  ENST ID: ENST00000267219
  CDS Start-End: 32-1081
tagacatgtcctagataacccaactcctgagatggaagcagcgagacgttccctgtgctttagactggagcaaggttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaatccccacaccgaacaaagctgcagcttctgggataatgggtcgcagtgcactcccaagaccttcgttggcaataaatgggagtaacctgcctcgaagcaaaattgcacaacctgttagaagttttcttcagcctccaaagcctctgtcttcactcagcactctgagggatggaaattggagagatggttgctactaatgcagttttatgtacccttgaaaaatgggaaagaagtaaaaatgagggttgtgttacctagctggctgggtagcagtggatgttgggatattctttcccttttgtgttttaatatatttactgcattgtttctcaatggaccagtcaccagagactaattattgcacttaaatatttgcctgagatactgcaacattctcaaacccatggttgcagtattgtgacacttagatctaggaagtttttgtagaactgctctgtacctgaatactttttgagagaattaagatgtatcaataatgctttgccatatgagttttttaaagtaacttgttcaatttactcacgtgttctaaacatctttccattacatgttctgtattttaatacattgcatattgacaactaggttctataatgtatgctttgaaatttacttttttatagtttacaggaattttattttttgtgcctatttctttttacacctatgtgaaccactatggaacaacttaaattttgtgccataaaaatatttttgtggtaaggtactatttttttagctctagggatatatcagcaaaaacacatcatgcaatttgagacacataattttgtgttgaatgagcacaacataatttgaagcattgcaaggagataaccagacagcagaattaaatggtcctgtctttttcatttttaatttattgtcatacatgggtttcatatttataacggcatcatgagctcattgcacttaatacctgcaatgtttgctactgtaccacaattgattttcaatactttattacgaaggatgaaactgtaatgttttattaacaatgcttctggaaatgaatgcattttaaagcaaataaatctttttgatagaccttttacaaaatccatttgcactaatgaatgctttcttatggcatataacttaatatttgttactgtgtacactgctgttttggaatgttcagaaataaagactctatttcagcaa

SEQ ID NO: 181971 - DNA, 2118 bp, Homo sapiens
  Payload ID: 15833
  Gene Symbol: SLAIN1
  Gene Name: SLAIN motif family, member 1
  Uniprot ID: Q8ND83
  ENST ID: ENST00000314070
  CDS Start-End: 521-1096
gtaatttgcctggcaagtgatcagactggtataaaataacatcatctgttaggcaagatagcagtcacaaagaactattggtcttttaaaatatagaatttttaatgagaaactttgaataatagagattgaacatgtgagaacagctacctagtgtgtgttgcattattaacccctagtttgtagtgtattctggagtcaagttgacctacatagaagagaaggaactggaagtgcatgtctgtgttctggctccgattgggaaaagctgcttaaccactctagccgatggcggagtctcttctcttcaactgcctcactggcttttccttatagtcctgttgcaagactcagcccttatagcaatggcattaatactcccagcttctctaaaacctcaaataaagcaatactaacacctgaaaaaacaggttacacttccaggggctccccactcagtccccagtcatctatcgacagtgagctgagtacttcagaattggaggatgattctatctccatgggatataaattacaggacctcactgatgttcagatcatggctcgtctgcaagaagaaaataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaatccccacaccgaacaaagctgcagcttctgggataatgggtcgcagtgcactcccaagaccttcgttggcaataaatgggagtaacctgcctcgaagcaaaattgcacaacctgttagaagttttcttcagcctccaaagcctctgtcttcactcagcactctgagggatggaaattggagagatggttgctactaatgcagttttatgtacccttgaaaaatgggaaagaagtaaaaatgagggttgtgttacctagctggctgggtagcagtggatgttgggatattctttcccttttgtgttttaatatatttactgcattgtttctcaatggaccagtcaccagagactaattattgcacttaaatatttgcctgagatactgcaacattctcaaacccatggttgcagtattgtgacacttagatctaggaagtttttgtagaactgctctgtacctgaatactttttgagagaattaagatgtatcaataatgctttgccatatgagttttttaaagtaacttgttcaatttactcacgtgttctaaacatctttccattacatgttctgtattttaatacattgcatattgacaactaggttctataatgtatgctttgaaatttacttttttatagtttacaggaattttattttttgtgcctatttctttttacacctatgtgaaccactatggaacaacttaaattttgtgccataaaaatatttttgtggtaaggtactatttttttagctctagggatatatcagcaaaaacacatcatgcaatttgagacacataattttgtgttgaatgagcacaacataatttgaagcattgcaaggagataaccagacagcagaattaaatggtcctgtctttttcatttttaatttattgtcatacatgggtttcatatttataacggcatcatgagctcattgcacttaatacctgcaatgtttgctactgtaccacaattgattttcaatactttattacgaaggatgaaactgtaatgttttattaacaatgcttctggaaatgaatgcattttaaagcaaataaatctttttgatagaccttttacaaaatccatttgcactaatgaatgctttcttatggcatataacttaatatttgttactgtgtacactgctgttttggaatgttcagaaataaagactctatttcagcaatatcaggtcatgc

SEQ ID NO: 181972 - DNA, 2394 bp, Homo sapiens
  Payload ID: 15833
  Gene Symbol: SLAIN1
  Gene Name: SLAIN motif family, member 1
  ENST ID: ENST00000351546
  CDS Start-End: 458-1372
gtaatttgcctggcaagtgatcagactggtataaaataacatcatctgttaggcaagatagcagtcacaaagaactattggtcttttaaaatatagaatttttaatgagaaactttgaataatagagattgaacatgtgagaacagctacctagtgtgtgttgcattattaacccctagtttgtagtgtattctggagtcaagttgacctacatagaagagaaggaactggaagtgcatgtctgtgttctggctccgattgggaaaagctgcttaaccactgttacacttccaggggctccccactcagtccccagtcatctatcgacagtgagctgagtacttcagaattggaggatgattctatctccatgggatataaattacaggacctcactgatgttcagatcatggctcgtctgcaagaagaaagtatgtgttctttctaaactagcaaaatgaggcttccacttggaatatacaggcagagggggaggttcaggcatttctctccaggtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaatccccacaccgaacaaagctgcagcttctgggataatgggtcgcagtgcactcccaagaccttcgttggcaataaatgggagtaacctgcctcgaagcaaaattgcacaacctgttagaagttttcttcagcctccaaagcctctgtcttcactcagcactctgagggatggaaattggagagatggttgctactaatgcagttttatgtacccttgaaaaatgggaaagaagtaaaaatgagggttgtgttacctagctggctgggtagcagtggatgttgggatattctttcccttttgtgttttaatatatttactgcattgtttctcaatggaccagtcaccagagactaattattgcacttaaatatttgcctgagatactgcaacattctcaaacccatggttgcagtattgtgacacttagatctaggaagtttttgtagaactgctctgtacctgaatactttttgagagaattaagatgtatcaataatgctttgccatatgagttttttaaagtaacttgttcaatttactcacgtgttctaaacatctttccattacatgttctgtattttaatacattgcatattgacaactaggttctataatgtatgctttgaaatttacttttttatagtttacaggaattttattttttgtgcctatttctttttacacctatgtgaaccactatggaacaacttaaattttgtgccataaaaatatttttgtggtaaggtactatttttttagctctagggatatatcagcaaaaacacatcatgcaatttgagacacataattttgtgttgaatgagcacaacataatttgaagcattgcaaggagataaccagacagcagaattaaatggtcctgtctttttcatttttaatttattgtcatacatgggtttcatatttataacggcatcatgagctcattgcacttaatacctgcaatgtttgctactgtaccacaattgattttcaatactttattacgaaggatgaaactgtaatgttttattaacaatgcttctggaaatgaatgcattttaaagcaaataaatctttttgatagaccttttacaaaatccatttgcactaatgaatgctttcttatggcatataacttaatatttgttactgtgtacactgctgttttggaatgttcagaaataaagactctatttcagcaatatcaggtcatgc

SEQ ID NO: 181973 - DNA, 2075 bp, Homo sapiens
  Payload ID: 15833
  Gene Symbol: SLAIN1
  Gene Name: SLAIN motif family, member 1
  Uniprot ID: Q8ND83
  ENST ID: ENST00000358679
  CDS Start-End: 151-1068
attaatactcccagcttctctaaaacctcaaataaagcaatactaacacctgaaaaaacaggttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaatccccacaccgaacaaagctgcagcttctgggataatgggtcgcagtgcactcccaagaccttcgttggcaataaatgggagtaacctgcctcgaagcaaaattgcacaacctgttagaagttttcttcagcctccaaagcctctgtcttcactcagcactctgagggatggaaattggagagatggttgctactaatgcagttttatgtacccttgaaaaatgggaaagaagtaaaaatgagggttgtgttacctagctggctgggtagcagtggatgttgggatattctttcccttttgtgttttaatatatttactgcattgtttctcaatggaccagtcaccagagactaattattgcacttaaatatttgcctgagatactgcaacattctcaaacccatggttgcagtattgtgacacttagatctaggaagtttttgtagaactgctctgtacctgaatactttttgagagaattaagatgtatcaataatgctttgccatatgagttttttaaagtaacttgttcaatttactcacgtgttctaaacatctttccattacatgttctgtattttaatacattgcatattgacaactaggttctataatgtatgctttgaaatttacttttttatagtttacaggaattttattttttgtgcctatttctttttacacctatgtgaaccactatggaacaacttaaattttgtgccataaaaatatttttgtggtaaggtactatttttttagctctagggatatatcagcaaaaacacatcatgcaatttgagacacataattttgtgttgaatgagcacaacataatttgaagcattgcaaggagataaccagacagcagaattaaatggtcctgtctttttcatttttaatttattgtcatacatgggtttcatatttataacggcatcatgagctcattgcacttaatacctgcaatgtttgctactgtaccacaattgattttcaatactttattacgaaggatgaaactgtaatgttttattaacaatgcttctggaaatgaatgcattttaaagcaaataaatctttttgatagaccttttacaaaatccatttgcactaatgaatgctttcttatggcatataacttaatatttgttactgtgtacactgctgttttggaatgttcagaaataaagactctatttcagc

SEQ ID NO: 181974 - DNA, 572 bp, Homo sapiens
  Payload ID: 15833
  Gene Symbol: SLAIN1
  Gene Name: SLAIN motif family, member 1
  ENST ID: ENST00000377236
  CDS Start-End: 335-572
gtgctgctcttttccccagtgttttcggagggatgacgggggatggtaggggttggcctctgtctgcgactgttactgttctttcgttttaaacgaacgctggacaggatttgcgtgctcttcctcctcgggtggcatcggaagccgcgcagtgatggatctctctttatagagaggttcgttcttgctgtttgaattttgcagtcgtgtgcccttttgcgttgcattttcattgaaatcttattttcagagactgacttgctttttaaaatggggtgacctcactggctttcccataaatagtgccaataaagaggacttttcttggagtggaatgaacaggttatacattggctcttcaaagacgttcacctcatcagagaaatccctgactcctttgcagtggtgtagacatgtcctagataacccaactcctgagatggaagcagcgagacgttccctgtgctttagactggagcaaggttacacttccaggggctccccactcagtccccagtcatctatcgacagtgagctgagtacttcagaattggaggatgattctatctcca

SEQ ID NO: 181975 - DNA, 472 bp, Homo sapiens
  Payload ID: 15833
  Gene Symbol: SLAIN1
  Gene Name: SLAIN motif family, member 1
  ENST ID: ENST00000422114
  CDS Start-End: 139-472
cggccgcggcgccctcggggcccacgatgatggcggagcaggttatacattggctcttcaaagacgttcacctcatcagagaaatccctgactcctttgcagtggtgtagacatgtcctagataacccaactcctgagatggaagcagcgagacgttccctgtgctttagactggagcaaggttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatc

SEQ ID NO: 181976 - DNA, 829 bp, Homo sapiens
  Payload ID: 15833
  Gene Symbol: SLAIN1
  Gene Name: SLAIN motif family, member 1
  ENST ID: ENST00000442759
  CDS Start-End: 215-829
gacgccgccaggggcagctgcagcgccgccctcgccgccccccacgctgctggacgaggtggaattgctggatctggagagcgtagccgcctggcgggacgaggacgactacacctggttatacattggctcttcaaagacgttcacctcatcagagaaatccctgactcctttgcagtggtgtagacatgtcctagataacccaactcctgagatggaagcagcgagacgttccctgtgctttagactggagcaaggttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggagataagctccgaagaagtatgcctaacctagcccggatgccaagtacaactgccattagtagcaacattagttctccggtc

SEQ ID NO: 181977 - DNA, 2855 bp, Homo sapiens
  Payload ID: 15833
  Gene Symbol: SLAIN1
  Gene Name: SLAIN motif family, member 1
  ENST ID: ENST00000418532
  CDS Start-End: 61-1833
ccgaggagccggcgcggcggcgcgcactccccggcggccgcggcgccctcggggcccacgatgatggcggagcaggtgaaatgcgcctcggcaggggtcagctctggagcgggctccgggccggtggtgaacgcggagctggaggtgaagaagctgcaggagctggtgcgcaagctggagaagcagaacgagcagctgcggagtcgagcggccagcgcggccgccgccccgcacctgctgctgctgccgccgccgccgcccgccgcgccgccccccgctggcctgcagcctttgggtcctcggagccccccggccgccacggccaccgccgcggcctcagggggcctggggctcgggctggcgctgggcgcggggggcggtggcggcagcggtagtggcagcggcggtggctccagccccgcgttcccgggcaccttctgcctgcctagccccgcgccctccctgctttgcagcctggcgcagccacccgaggcgcccttcgtctacttcaagccggcagcaggcttcttcggcgcgggcggtggcgggccggagccggggggcgcggggacgccgccaggggcagctgcagcgccgccctcgccgccccccacgctgctggacgaggtggaattgctggatctggagagcgtagccgcctggcgggacgaggacgactacacctggttatacattggctcttcaaagacgttcacctcatcagagaaatccctgactcctttgcagtggtgtagacatgtcctagataacccaactcctgagatggaagcagcgagacgttccctgtgctttagactggagcaaggttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaatccccacaccgaacaaagctgcagcttctgggataatgggtcgcagtgcactcccaagaccttcgttggcaataaatgggagtaacctgcctcgaagcaaaattgcacaacctgttagaagttttcttcagcctccaaagcctctgtcttcactcagcactctgagggatggaaattggagagatggttgctactaatgcagttttatgtacccttgaaaaatgggaaagaagtaaaaatgagggttgtgttacctagctggctgggtagcagtggatgttgggatattctttcccttttgtgttttaatatatttactgcattgtttctcaatggaccagtcaccagagactaattattgcacttaaatatttgcctgagatactgcaacattctcaaacccatggttgcagtattgtgacacttagatctaggaagtttttgtagaactgctctgtacctgaatactttttgagagaattaagatgtatcaataatgctttgccatatgagttttttaaagtaacttgttcaatttactcacgtgttctaaacatctttccattacatgttctgtattttaatacattgcatattgacaactaggttctataatgtatgctttgaaatttacttttttatagtttacaggaattttattttttgtgcctatttctttttacacctatgtgaaccactatggaacaacttaaattttgtgccataaaaatatttttgtggtaaggtactatttttttagctctagggatatatcagcaaaaacacatcatgcaatttgagacacataattttgtgttgaatgagcacaacataatttgaagcattgcaaggagataaccagacagcagaattaaatggtcctgtctttttcatttttaatttattgtcatacatgggtttcatatttataacggcatcatgagctcattgcacttaatacctgcaatgtttgctactgtaccacaattgattttcaatactttattacgaaggatgaaactgtaatgttttattaacaatgcttctggaaatgaatgcattttaaagcaaataaatctttttgatagaccttttacaaaatccatttgcactaatgaatgctttcttatggcatataacttaatatttgttactgtgtacactgctgttttggaatgttcagaaataaagactctatttcagcaatatcaggtcatgc

SEQ ID NO: 181978 - DNA, 899 bp, Homo sapiens
  Payload ID: 15833
  Gene Symbol: SLAIN1
  Gene Name: SLAIN motif family, member 1
  ENST ID: ENST00000446759
  CDS Start-End: 215-899
gacgccgccaggggcagctgcagcgccgccctcgccgccccccacgctgctggacgaggtggaattgctggatctggagagcgtagccgcctggcgggacgaggacgactacacctggttatacattggctcttcaaagacgttcacctcatcagagaaatccctgactcctttgcagtggtgtagacatgtcctagataacccaactcctgagatggaagcagcgagacgttccctgtgctttagactggagcaagctagccgatggcggagtctcttctcttcaactgcctcactggcttttccttatagtcctgttgcaagactcagcccttatagcaatggcattaatactcccagcttctctaaaacctcaaataaagcaatactaacacctgaaaaaacaggttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggag

SEQ ID NO: 181979 - DNA, 1033 bp, Homo sapiens
  Payload ID: 15833
  Gene Symbol: SLAIN1
  Gene Name: SLAIN motif family, member 1
  ENST ID: ENST00000441784
  CDS Start-End: 312-1033
agcagtcacaaagaactattggtcttttaaaatatagaatttttaatgagaaactttgaataatagagattgaacatgtgagaacagctacctagtgtgtgttgcattattaacccctagtttgtagtgtattctggagtcaagttgacctacatagaagagaaggaactggaagtgcatgtctgtgttctggctccgattgggaaaagctgcttaaccactgttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaat

SEQ ID NO: 181980 - DNA, 531 bp, Homo sapiens
  Payload ID: 15833
  Gene Symbol: SLAIN1
  Gene Name: SLAIN motif family, member 1
  ENST ID: ENST00000481614
  CDS Start-End: 496-531
gcttttccttatagtcctgttgcaagactcagcccttatagcaatggcattaatactcccagcttctctaaaacctcaaataaagcaatactaacacctgaaaaaacaggtaatattttaacttcttgactagctgcttgctttgtaattcagttactaaacacggcttaaatattcatctttcatttgaaaagcttgagaataatcttaagagtggagagtttgtgctgcacacttactttgggtacaaaaggcctagcactaatttgtactctaacaccattgatctactgctctcaattttatgtagcagacagtcttccctctttagcaaaagtatatgcatgcagttctgtatttccaaatgcttatgtgcttttaaaattaaatgtcaaacacaattaaggttacacttccaggggctccccactcagtccccagtcatctatcgacagtgagctgagtacttcagaattggaggatgattctatctccatgggatataaattacaggacctcactgatgttcag

SEQ ID NO: 181981 - DNA, 1461 bp, Homo sapiens
  Payload ID: 15833
  Gene Symbol: SLAIN1
  Gene Name: SLAIN motif family, member 1
  Uniprot ID: Q8ND83
  ENST ID: ENST00000488699
  CDS Start-End: 44-1324
agtgctgctcttttccccagtgttttcggagggatgacgggggatggtaggggttggcctctgtctgcgactgttactgttctttcgttttaaacgaacgctggacaggatttgcgtgctcttcctcctcgggtggcatcggaagccgcgcagtgatggatctctctttatagagaggttatacattggctcttcaaagacgttcacctcatcagagaaatccctgactcctttgcagtggtgtagacatgtcctagataacccaactcctgagatggaagcagcgagacgttccctgtgctttagactggagcaaggttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaatccccacaccgaacaaagctgcagcttctgggataatgggtcgcagtgcactcccaagaccttcgttggcaataaatgggagtaacctgcctcgaagcaaaattgcacaacctgttagaagttttcttcagcctccaaagcctctgtcttcactcagcactctgagggatggaaattggagagatggttgctactaatgcagttttatgtacccttgaaaaatgggaaagaagtaaaaatgagggttgtgttacctagctggctgggtagcagtggatgttgggatattctttcccttttgtgttttaatatatttactgcattgtttctcaat

SEQ ID NO: 181982 - DNA, 570 bp, Homo sapiens
  Payload ID: 15833
  Gene Symbol: SLAIN1
  Gene Name: SLAIN motif family, member 1
  ENST ID: ENST00000474663
  CDS Start-End: 129-570
aattttcattattatacaggcatgttggctttaatcaaagttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggagataagctccgaagaagtatgcctaacctagcccggatgc

SEQ ID NO: 181983 - DNA, 2637 bp, Homo sapiens
  Payload ID: 15833
  Gene Symbol: SLAIN1
  Gene Name: SLAIN motif family, member 1
  Uniprot ID: Q8ND83
  ENST ID: ENST00000466548
  CDS Start-End: 27-1733
cggccgcggcgccctcggggcccacgatgatggcggagcaggtgaaatgcgcctcggcaggggtcagctctggagcgggctccgggccggtggtgaacgcggagctggaggtgaagaagctgcaggagctggtgcgcaagctggagaagcagaacgagcagctgcggagtcgagcggccagcgcggccgccgccccgcacctgctgctgctgccgccgccgccgcccgccgcgccgccccccgctggcctgcagcctttgggtcctcggagccccccggccgccacggccaccgccgcggcctcagggggcctgggccccgcgttcccgggcaccttctgcctgcctagccccgcgccctccctgctttgcagcctggcgcagccacccgaggcgcccttcgtctacttcaagccggcagcaggcttcttcggcgcgggcggtggcgggccggagccggggggcgcggggacgccgccaggggcagctgcagcgccgccctcgccgccccccacgctgctggacgaggtggaattgctggatctggagagcgtagccgcctggcgggacgaggacgactacacctggttatacattggctcttcaaagacgttcacctcatcagagaaatccctgactcctttgcagtggtgtagacatgtcctagataacccaactcctgagatggaagcagcgagacgttccctgtgctttagactggagcaaggttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaatccccacaccgaacaaagctgcagcttctgggataatgggtcgcagtgcactcccaagaccttcgttggcaataaatgggagtaacctgcctcgaagcaaaattgcacaacctgttagaagttttcttcagcctccaaagcctctgtcttcactcagcactctgagggatggaaattggagagatggttgctactaatgcagttttatgtacccttgaaaaatgggaaagaagtaaaaatgagggttgtgttacctagctggctgggtagcagtggatgttgggatattctttcccttttgtgttttaatatatttactgcattgtttctcaatggaccagtcaccagagactaattattgcacttaaatatttgcctgagatactgcaacattctcaaacccatggttgcagtattgtgacacttagatctaggaagtttttgtagaactgctctgtacctgaatactttttgagagaattaagatgtatcaataatgctttgccatatgagttttttaaagtaacttgttcaatttactcacgtgttctaaacatctttccattacatgttctgtattttaatacattgcatattgacaactaggttctataatgtatgctttgaaatttacttttttatagtttacaggaattttattttttgtgcctatttctttttacacctatgtgaaccactatggaacaacttaaattttgtgccataaaaatatttttgtggtaaggtactatttttttagctctagggatatatcagcaaaaacacatcatgcaatttgagacacataattttgtgttgaatgagcacaacataatttgaagcattgcaaggagataaccagacagcagaattaaatggtcctgtctttttcatttttaatttattgtcatacatgggtttcatatttataacggcatcatgagctcattgcacttaatacctgcaatgtttgctactgtaccacaattgattttcaatactttattacgaaggatgaaactgtaatgttttattaacaatgcttctggaaatgaatgcattttaaagcaaataaatctttttgatagaccttttacaaaa

SEQ ID NO: 181984 - DNA, 622 bp, Homo sapiens
  Payload ID: 15833
  Gene Symbol: SLAIN1
  Gene Name: SLAIN motif family, member 1
  ENST ID: ENST00000462234
  CDS Start-End: 325-622
agtcaagttgacctacatagaagagaaggaactggaagtgcatgtctgtgttctggctccgattgggaaaagctgcttaaccactctagccgatggcggagtctcttctcttcaactgcctcactggcttttccttatagtcctgttgcaagactcagcccttatagcaatggcattaatactcccagcttctctaaaacctcaaataaagcaatactaacacctgaaaaaacaggttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtagga

SEQ ID NO: 181985 - DNA, 576 bp, Homo sapiens
  Payload ID: 15833
  Gene Symbol: SLAIN1
  Gene Name: SLAIN motif family, member 1
  ENST ID: ENST00000496045
  CDS Start-End: 171-576
attgcgaatgtggtttccttgcctagttcttccacatacttaaggaaaagatatttttaatgtaattgttagaatgtgttggttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggaggta

SEQ ID NO: 181986 - DNA, 6299 bp, Homo sapiens
  Payload ID: 15834
  Gene Symbol: SLAIN2
  Gene Name: SLAIN motif family, member 2
  Uniprot ID: Q9P270
  ENST ID: ENST00000264313
  CDS Start-End: 419-2164
aatccccgcccctcaagcaccggccccgccccataggccccgtccgtggccccgccccgccgcgagctggcgccgggtcctctcagcgcccgccggcggccgcgtccacccccgacgctctgaggtcaccgactgggccggcccgcggggggcggagggacggagggaagatggcggcaggggccggatattggcgccgcctcccccaatcccggagccggcgcagatgaggcagttcggctggggccagcggcgctttggaacccgaggtggggggaccctggcggtggggcctggtcctgctatatgccggcgcctcggctagagtgagcggcggcgacgcctctttcctccgtctctttccctgtcgctgcgagagcgagcgggcggcggaggcggcggcggcggcggggccgggatggaggacgttaactccaacgtgaacgcggaccaggaggtgcggaagctgcaggagctggtgaagaagctggagaagcagaacgaacagctgaggagccgctcgggggccgtgcagggcgccggctcccttgggcccggcagcccggttcgggccggcgcgtccattccctcctccggcgcggcgtctcctcggggcttccccttgggcctcagcgccaagtcgggcggcgggcccgggtcgggcccgaggcggacgagtagcgaagagctgcgggacgccacctccttgctagcggcgggcgagggcggcttgctggacgaggtggagccgctgcggcccgacgagctggagcgcctgtcaggctgggaggaggaggaggagagctggctgtattcatcaccaaagaaaaaacttacaccaatgcagaaatcggttagtccattagtttggtgcaggcaagttttggattacccaagtcctgatgttgagtgtgctaaaaaatctcttatccacaaacttgatcaaactatgtcagctctcaagaggcagaatttatataataatcctttcaactctatgagttacaccagtccttacagtccaaatgccagtagcccatacagcagtggcttcaattctccatcctcaaccccagtgcgacctcctatagtcaaacagcttatacttcctggaaattcaggtaacttgaaaagctcagacagaaatcctccactcagtcctcagtcctctatagatagtgagttaagtgcttcagaattagatgaagattcaattggatccaattataagctaaatgatgtaactgatgtacagattctagcccggatgcaggaagaaagtctccggcaagaatatgcagccaccacgtctcggcgcagttctggttcatcttgcaattctacaagacggggtacttttagtgatcaggaacttgatgcacaaagtttagatgatgaagatgacaatatgcatcatgcagtataccctgctgttaacaggttttcaccatcaccacgcaattcacctcgaccgtcacctaagcagtcacccagaaattcacctcgttcacgatctcctgctcggggaatagaatatagtagagtgtccccacagcctatgattagccgcttacagcaacctcgcctttcacttcaaggccatcccacagatttacagacaagcaatgttaaaaatgaagaaaaactaagacgcagtcttccaaacctgtcccgaacatctaatacacaagttgactcagtgaaaagcagcagaagtgactcaaattttcaagtgccaaacggaggaatacctcgtatgcaacctcaggcttcagccataccttctccaggcaaattccgttcccctgcagcaccatctcctttggctcttcggcaaccagtgaaagcatttagtaaccatggctctggttctcctggtagccaagaaataacacagctcacacaaaccacctcctcacctgggcctcctatggttcagagcacagtctcagcaaatcctcccagcaatatcaacagcgctactctaaccagacctgcagggacaactgcaatgagaagtggcttgcccagacccagtgccccttctgctgggggcataccagtgcctcgcagcaaacttgcacagcctgttcgcagatccttgccagctcctaaaacctatggtagcatgaaagatgacagttggaaagatggctgttactgaccagcaaagacaagaatgcagaagtccacggcttcatggatacccttcaccaggctaaaaaacaacttttatatgcagactgttcagataagactcttgggatttataaaatcccagccctctctgtcttaattagcacaaaccgacagagatcatcaaacagcactttaatgacatttaacatcagatgtgtttggtaatcatacaatcactctccatagaatcacttttagttttgtttaatagaaactaggttgatttttaaaaaatatttgacagaggccaatatctgggcaaatacctaatggatgccaaagagaaatgcccatttgtaaatgagaaaaatgcccatttgtgcacaagaaaatggtgaattcaggctatccaaaacttcacattcaacctaatttactgtataaatagtatcaataaatatttgtgttaatgagaactaatattctgactaattatctaaagtgtttcactagtacaccaggaaactacagattgagattagggggtgggaggaaagaaacctgggctagagattaaaacattcctaaatttagcagaatttcagaaatgatttttgcagattcattagaaaagaaaaattgtcatttaatcttaagttttggatgtagctcacatgtcaccaccaccagatagtgttacagcatgtatccatcatgttgcattgacacatcaaacttgtgtgtgtttgttttgattgccaaaagggcttaatatcagttgtacaatctttctgaactttatagttcctggctcaggaaagatggcctttgctattgaagccaacttcttcacatgctgttatctttacagaactaagagatcttgtttctattagcaggttttcatgataggaaagaacaagtagtgtgtgtctttattcttgatacaacaccacctcggtgcttgcaacctggaacaaaaccataccatgagagagagggggaaaaaaatctatgcacttaacctacaaaatctctggtgatgacagttgtattgttgctattacatggcataacggtctattatgtggtaggaaaatatagcctgctaaatcctacttaagttgatccactttaaactgagtaactgtataaaacatctattgaaaattcttttccttttgacttagattctgccttacatcaatttttgcatttttggtaaaaaaaaaaccctactacgtatgactctaacctgatacttgctctctaatggctcttaatatatccttgaaatcggctatttcaattttatcagacttttaccagagtaaaacttgcttctgtagcaggcctctcattttttattatgaggtctgtttttaaatacttaatttgaacagctctaagatattgtcacttaggtcatctaaaagcttttagagatttgaacataagttcatttcctgttaatcaaagacattccgtaagttggcaaaagaaattgggagagagaaatagaaggcttgatattctggacagcattaaggttgataggttgatgataaaaacttaaaaccaggacctccattctgtcatgactgacaccatggtagtctgtcagcttgaccagtggagagtcattcatttagcacaagcagctggagatttaaactgccagtactatgtatttggtgtataatgcaaggaagaaactttatccttgaatttgagggtgatggggtgggtcaggaaaggatggcgccagaattctacatgataatgaactaaaaaatgttgcttttcagaggaagataaagcatcttcttttgggaggggggtatctcatgtctaagtaagtaaaagaaagaagtagctactgtctcttttaaaaaccacgtacaaaacagaacaagtctcagttttcagtgcaacatttcaaaaaatatatatgctgcaatctaataattaaaaggaattttacctattatgaaacatattacattttttaagttagataatcagtttcaaaaggagtattcaggttatttaactttgtttttaaatggctgcatcagaaaaaaatgtctatttttttttattaaaatatttcatcacttgttaaaacatatttttgatctgagtttggtaaagtattattttacctgctgttgtactaccacagactgttgacttttagtttcttaaagagaaaaattgcctttttactagaaagcctttgtatattgcaatttttctgtttgggaaaatctaaggatttactgtggttagtcttacagaagaaatgtggatttgataaactagtgcctatgattttaacttatgtttgatatatagtagtaagggttttatgaatgttgattattttgtgccaacagcccagaattgtcacttatatgtaagcagaaaacaatgagctctgcttccaaagttatttaattttctcagtgtttgaatgttattttttgtaagtgtgttaataaaagtgtaaagaattggaaaaaatataaatattcttaactcaagcatttgctggatcatttttctacaaaacttgtttgtacaatataaaacactctctgaagagttgactttttttcagtttcgtatcctggaaatcacattttgtaaaactggggaccattcataattgtcagatactttttaaaattatctcaatacatcacttttataaaaaaaaaaagtttttttgaaagaaaattagatacatatgtggccccagatgtttgtataactctagaatgatctagactatgtatgtttaaattaactttttattgaatgtacaggtgtccatttttgacgttaagcatggtcctttaaggtcacatgacgtttgatttgcaaacatttctatagccgaacttgtatatgtggttgcctccttaataaacagcctgaccataatgtttattattaaatttatattctttaagtgtttaattaatctctggatatggtaagattccttttttcctctcagttgcctacacttggttttaataaattactcagttgagtttttctttaaccacagaaacccaaatcatattgccctttcagatttagtcttcatggggttggattatgtcttatattttctctgtcagagttatttcatatatggattttacttgaaggaaatttacagtttactctaaattgatttgttcttggaacttttttacctgctgtgaattgatacctagttataaaaagctagcatttgcctagatcataactatgtatggtatctagttagaaaaaaacaagcaaaaagctattatgagtttccaagagggacaattaatgcattttcataccaaatgcgaatatttaggtgatcacgtgcatcttttcttgtatggatggaaaaatcaagaattgtacactgtttaatgagttctccatattcctttaggagatatttgctttgcaattacatgttacaattagaataattacaattaaaataatattacatgttacaattagattaatagtgatgagagggaaaaaagacacccttctgtttttttctctcaagccagtctaaaaacttgaagagccatttaaaattaaatgtcactatacttgtattataaatcaatacataagtttaaacctgttatatactcagtgcaacagaaaaacccatatggaggttcaaccactgatgtattttgaatgatcctaaatataagtcttgggtggctaaatggccctctgcttaccagtctgaaaatgaaaccgattatactcatcggccttatttactgtaatacaaactggttaaaactatgttaactgaatgctagtttgaaacaaattatctacattaagtcatcttaatgttttctctttaaaagaaataaaaaaatctgtttcttctgatttcgaaagtaatagaaactctgctgtagaacataaactaaaaatattaaaaagtataaaggtaaaaaatgatagttgtctgcaatcccataatccggaaatattgaagtactgtccgtaacatggttatgacatgttaagtggaagggtagaaggtctttttttttttaaggagaaaatgtttcttttaaataaatgtttcttatgtaaaaatgttgacatga

SEQ ID NO: 181987 - DNA, 550 bp, Homo sapiens
  Payload ID: 15834
  Gene Symbol: SLAIN2
  Gene Name: SLAIN motif family, member 2
  ENST ID: ENST00000510595
  CDS Start-End: 1-508
ccgaacatctaatacacaagttgactcagtgaaaagcagcagaagtgactcaaattttcaagtgccaaacggaggaatacctcgtatgcaacctcaggcttcagccacttcgcaaaggctgaaaaatttgcctcgcacttccctcaaagccaaacagttgcttcaaacttcatctacaaaaagagtaccttctccaggcaaattccgttcccctgcagcaccatctcctttggctcttcggcaaccagtgaaagcatttagtaaccatggctctggttctcctggtagccaagaaataacacagctcacacaaaccacctcctcacctgggcctcctatggttcagagcacagtctcagcaaatcctcccagcaatatcaacagcgctactctaaccagacctgcagggacaactgcaatgagaagtggcttgcccagacccagtgccccttctgctgggggcataccagtgcctcgcagcaaacttgcacagcctgttcgcaggtaagtggcagatgttctgtttcagcattcttgagtgcctgaaagt

SEQ ID NO: 181988 - DNA, 4219 bp, Homo sapiens
  Payload ID: 15834
  Gene Symbol: SLAIN2
  Gene Name: SLAIN motif family, member 2
  ENST ID: ENST00000512093
  CDS Start-End: 37-1281
aagaggcagaatttatataataatcctttcaactctatgagttacaccagtccttacagtccaaatgccagtagcccatacagcagtggcttcaattctccatcctcaaccccagtgcgacctcctatagtcaaacagcttatacttcctggaaattcaggtaacttgaaaagctcagacagaaatcctccactcagtcctcagtcctctatagatagtgagttaagtgcttcagaattagatgaagattcaattggatccaattataagctaaatgatgtaactgatgtacagattctagcccggatgcaggaagaaagtctccggcaagaatatgcagccaccacgtctcggcgcagttctggttcatcttgcaattctacaagacggggtacttttagtgatcaggaacttgatgcacaaagtttagatgatgaagatgacaatatgcatcatgcagtataccctgctgttaacaggttttcaccatcaccacgcaattcacctcgaccgtcacctaagcagtcacccagaaattcacctcgttcacgatctcctgctcggggaatagaatatagtagagtgtccccacagcctatgattagccgcttacagcaacctcgcctttcacttcaaggccatcccacagatttacagacaagcaatgttaaaaatgaagaaaaactaagacgcagtcttccaaacctgtcccgaacatctaatacacaagttgactcagtgaaaagcagcagaagtgactcaaattttcaagtgccaaacggaggaatacctcgtatgcaacctcaggcttcagccacttcgcaaaggctgaaaaatttgcctcgcacttccctcaaagccaaacagttgcttcaaacttcatctacaaaaagagtaccttctccaggcaaattccgttcccctgcagcaccatctcctttggctcttcggcaaccagtgaaagcatttagtaaccatggctctggttctcctggtagccaagaaataacacagctcacacaaaccacctcctcacctgggcctcctatggttcagagcacagtctcagcaaatcctcccagcaatatcaacagcgctactctaaccagacctgcagggacaactgcaatgagaagtggcttgcccagacccagtgccccttctgctgggggcataccagtgcctcgcagcaaacttgcacagcctgttcgcagatccttgccagctcctaaaacctatggtagcatgaaagatgacagttggaaagatggctgttactgaccagcaaagacaagaatgcagaagtccacggcttcatggatacccttcaccaggctaaaaaacaacttttatatgcagactgttcagataagactcttgggatttataaaatcccagccctctctgtcttaattagcacaaaccgacagagatcatcaaacagcactttaatgacatttaacatcagatgtgtttggtaatcatacaatcactctccatagaatcacttttagttttgtttaatagaaactaggttgatttttaaaaaatatttgacagaggccaatatctgggcaaatacctaatggatgccaaagagaaatgcccatttgtaaatgagaaaaatgcccatttgtgcacaagaaaatggtgaattcaggctatccaaaacttcacattcaacctaatttactgtataaatagtatcaataaatatttgtgttaatgagaactaatattctgactaattatctaaagtgtttcactagtacaccaggaaactacagattgagattagggggtgggaggaaagaaacctgggctagagattaaaacattcctaaatttagcagaatttcagaaatgatttttgcagattcattagaaaagaaaaattgtcatttaatcttaagttttggatgtagctcacatgtcaccaccaccagatagtgttacagcatgtatccatcatgttgcattgacacatcaaacttgtgtgtgtttgttttgattgccaaaagggcttaatatcagttgtacaatctttctgaactttatagttcctggctcaggaaagatggcctttgctattgaagccaacttcttcacatgctgttatctttacagaactaagagatcttgtttctattagcaggttttcatgataggaaagaacaagtagtgtgtgtctttattcttgatacaacaccacctcggtgcttgcaacctggaacaaaaccataccatgagagagagggggaaaaaaatctatgcacttaacctacaaaatctctggtgatgacagttgtattgttgctattacatggcataacggtctattatgtggtaggaaaatatagcctgctaaatcctacttaagttgatccactttaaactgagtaactgtataaaacatctattgaaaattcttttccttttgacttagattctgccttacatcaatttttgcatttttggtaaaaaaaaaaccctactacgtatgactctaacctgatacttgctctctaatggctcttaatatatccttgaaatcggctatttcaattttatcagacttttaccagagtaaaacttgcttctgtagcaggcctctcattttttattatgaggtctgtttttaaatacttaatttgaacagctctaagatattgtcacttaggtcatctaaaagcttttagagatttgaacataagttcatttcctgttaatcaaagacattccgtaagttggcaaaagaaattgggagagagaaatagaaggcttgatattctggacagcattaaggttgataggttgatgataaaaacttaaaaccaggacctccattctgtcatgactgacaccatggtagtctgtcagcttgaccagtggagagtcattcatttagcacaagcagctggagatttaaactgccagtactatgtatttggtgtataatgcaaggaagaaactttatccttgaatttgagggtgatggggtgggtcaggaaaggatggcgccagaattctacatgataatgaactaaaaaatgttgcttttcagaggaagataaagcatcttcttttgggaggggggtatctcatgtctaagtaagtaaaagaaagaagtagctactgtctcttttaaaaaccacgtacaaaacagaacaagtctcagttttcagtgcaacatttcaaaaaatatatatgctgcaatctaataattaaaaggaattttacctattatgaaacatattacattttttaagttagataatcagtttcaaaaggagtattcaggttatttaactttgtttttaaatggctgcatcagaaaaaaatgtctatttttttttattaaaatatttcatcacttgttaaaacatatttttgatctgagtttggtaaagtattattttacctgctgttgtactaccacagactgttgacttttagtttcttaaagagaaaaattgcctttttactagaaagcctttgtatattgcaatttttctgtttgggaaaatctaaggatttactgtggttagtcttacagaagaaatgtggatttgataaactagtgcctatgattttaacttatgtttgatatatagtagtaagggttttatgaatgttgattattttgtgccaacagcccagaattgtcacttatatgtaagcagaaaacaatgagctctgcttccaaagttatttaattttctcagtgtttgaatgttattttttgtaagtgtgttaataaaagtgtaaagaattggaaaaaatataaatattcttaactcaagcatttgctggatcatttttctacaaaacttgtttgtacaatataaaacactctctgaagagttgactttttttcagtttcgtatcctggaaatcacattttgtaaaactggggaccattcataattgtcagatactttttaaaattatctcaatacatcacttttataaaaaaaaaaagtttttttgaaagaaaattagatacatatgtggccccagatgtttgtataactctagaatgatctagactatgtatgtttaaattaactttttattgaatgtacaggtgtccatttttgacgttaagcatggtcctttaaggtcacatgacgtttgatttgcaaacatttctatagccgaacttgtatatgtggttgcctccttaataaacagcctgaccataatgtttattattaaa

SEQ ID NO: 181989 - DNA, 588 bp, Homo sapiens
  Payload ID: 15834
  Gene Symbol: SLAIN2
  Gene Name: SLAIN motif family, member 2
  ENST ID: ENST00000505131
  CDS Start-End: 10-186
ctagcccggatgcaggaagaaagtctccggcaagaatatgcagccaccacgtctcggcgcagttctggttcatcttgcaattctacaagacggggttttcaccatcaccacgcaattcacctcgaccgtcacctaagcagtcacccagaaattcacctcgttcacgatctcctgctcggggaatagaatatagtagagtgtccccacagcctatgattagccgcttacagcaacctcgcctttcacttcaaggccatcccacagatttacagacaagcaatgttaaaaatgaagaaaaactaagacgcagtcttccaaacctgtcccgaacatctaatacacaagttgactcagtgaaaagcagcagaagtgactcaaattttcaagtgccaaacggaggaatacctcgtatgcaacctcaggcttcagccagtgaattacttttcctttttttcccagaagttgataattaaggaatatatatagggaaaacacaatgggattccaatcattgatttacttttaagtggaaacttcgcaaaggctgaaaaatttgcctcgcacttccctcaaagccaaacagttgct

SEQ ID NO: 181990 - DNA, 730 bp, Homo sapiens
  Payload ID: 15835
  Gene Symbol: SLAMF6
  Gene Name: SLAM family member 6
  Uniprot ID: Q96DU3
  ENST ID: ENST00000368055
  CDS Start-End: 51-716
aaacattgactgcctcaaggtctcaagcaccagtcttcaccgcggaaagcatgttgtggctgttccaatcgctcctgtttgtcttctgctttggcccaggacaactgaggaacatacaagttaccaatcacagtcagctatttcagaatatgacctgtgagctccatctgacttgctctgtggaggatgcagatgacaatgtctcattcagatgggaggccttgggaaacacactttcaagtcagccaaacctcactgtctcctgggaccccaggatttccagtgaacaggactacacctgcatagcagagaatgctgtcagtaatttatccttctctgtctctgcccagaagctttgcgaagatgttaaaattcaatatacagataccaaaatgattctgtttatggtttctgggatatgcatagtcttcggtttcatcatactgctgttacttgttttgaggaaaagaagagattccctatctttgtctactcagcgaacacagggccccgcagagtccgcaaggaacctagagtatgtttcagtgtctccaacgaacaacactgtgtatgcttcagtcactcattcaaacagggaaacagaaatctggacacctagagaaaatgatactatcacaatttactccacaattaatcattccaaagagagtaaacccactttttccagggcaactgcccttgacaatgtcgtgtaagttgctgaaaggcc

SEQ ID NO: 181991 - DNA, 2712 bp, Homo sapiens
  Payload ID: 15835
  Gene Symbol: SLAMF6
  Gene Name: SLAM family member 6
  Uniprot ID: Q96DU3
  ENST ID: ENST00000368057
  CDS Start-End: 62-1060
cagaagggcaaaaacattgactgcctcaaggtctcaagcaccagtcttcaccgcggaaagcatgttgtggctgttccaatcgctcctgtttgtcttctgctttggcccagggaatgtagtttcacaaagcagcttaaccccattgatggtgaacgggattctgggggagtcagtaactcttcccctggagtttcctgcaggagagaaggtcaacttcatcacttggcttttcaatgaaacatctcttgccttcatagtaccccatgaaaccaaaagtccagaaatccacgtgactaatccgaaacagggaaagcgactgaacttcacccagtcctactccctgcaactcagcaacctgaagatggaagacacaggctcttacagagcccagatatccacaaagacctctgcaaagctgtccagttacactctgaggatattaagacaactgaggaacatacaagttaccaatcacagtcagctatttcagaatatgacctgtgagctccatctgacttgctctgtggaggatgcagatgacaatgtctcattcagatgggaggccttgggaaacacactttcaagtcagccaaacctcactgtctcctgggaccccaggatttccagtgaacaggactacacctgcatagcagagaatgctgtcagtaatttatccttctctgtctctgcccagaagctttgcgaagatgttaaaattcaatatacagataccaaaatgattctgtttatggtttctgggatatgcatagtcttcggtttcatcatactgctgttacttgttttgaggaaaagaagagattccctatctttgtctactcagcgaacacagggccccgcagagtccgcaaggaacctagagtatgtttcagtgtctccaacgaacaacactgtgtatgcttcagtcactcattcaaacagggaaacagaaatctggacacctagagaaaatgatactatcacaatttactccacaattaatcattccaaagagagtaaacccactttttccagggcaactgcccttgacaatgtcgtgtaagttgctgaaaggcctcagaggaattcgggaatgacacgtcttctgatcccatgagacagaacaaagaacaggaagcttggttcctgttgttcctggcaacagaatttgaatatctaggataggatgatcacctccagtccttcggacttaaacctgcctacctgagtcaaacacctaaggataacatcatttccagcatgtggttcaaataatattttccaatccacttcaggccaaaacatgctaaagataacacaccagcacattgactctctctttgataactaagcaaatggaattatggttgacagagagtttatgatccagaagacaaccacttctctccttttagaaagcagcaggattgacttattgagaaataatgcagtgtgttggttacatgtgtagtctctggagttggatgggcccatcctgatacaagttgagcatcccttgtctgaaatgcttgggattagaaatgtttcagatttcaattttttttcagattttggaatatttgcattatatttagcggttgagtatccaaatccaaaaatccaaaattcaaaatgctccaataagcatttcccttgagtttcattgatgtcgatgcagtgctcaaaatctcagattttggagcattttggatattggatttttggatttgggatgctcaacttgtacaatgtttattagacacatctcctgggacatactgcctaaccttttggagccttagtctcccagactgaaaaaggaagaggatggtattacatcagctccattgtttgagccaagaatctaagtcatccctgactccagtgtctttgtcaccaggccctttggactctacctcagaaatatttcttggaccttccacttctcctccaactccttgaccaccatcctgtatccaaccatcaccacctctaacctgaatcctaccttaagatcagaacagttgtcctcacttttgttcttgtccctctccaacccactctccacaagatggccagagtaatgtttttaatataaattggatccttcagtttcctgcttaaaaccctgcaggtttcccaatgcactcagaaagaaatccagtttccatggccctggatggtctggcccacctccagcctcagctagcattacccttctgacactctctatgtagcctccctgatcttctttcagctcctctattaaaggaaaagttctttatgttaattatttacatcttcctgcaggcccttcctctgcctgctggggtcctcctattctttaggtttaattttaaatatgtcacctcctaagagaaaccttcccagaccactctttctaaaatgaatcttctaggctgggcatggtggctcacacctgtaatccctgtactttgggaggccaaggggggagatcacttgaggtcaggagttcaagaccagcctggccaacttggtgaaaccccgtctttactaaaaatacaaaaaaattagccaggcgtggtggtgcacccctaaaatcccagctacttgagagactgaggcaggagaatcgcttgaacccaggaggtggaggttccagtgagccaaaatcatgccaatgtattccagtctgggtgacagagtgagactctgtctcaaaaaataaataaa

SEQ ID NO: 181992 - DNA, 2743 bp, Homo sapiens
  Payload ID: 15835
  Gene Symbol: SLAMF6
  Gene Name: SLAM family member 6
  Uniprot ID: Q96DU3
  ENST ID: ENST00000368059
  CDS Start-End: 71-1066
agtttatgacagaagggcaaaaacattgactgcctcaaggtctcaagcaccagtcttcaccgcggaaagcatgttgtggctgttccaatcgctcctgtttgtcttctgctttggcccagggaatgtagtttcacaaagcagcttaaccccattgatggtgaacgggattctgggggagtcagtaactcttcccctggagtttcctgcaggagagaaggtcaacttcatcacttggcttttcaatgaaacatctcttgccttcatagtaccccatgaaaccaaaagtccagaaatccacgtgactaatccgaaacagggaaagcgactgaacttcacccagtcctactccctgcaactcagcaacctgaagatggaagacacaggctcttacagagcccagatatccacaaagacctctgcaaagctgtccagttacactctgaggatattaagacaactgaggaacatacaagttaccaatcacagtcagctatttcagaatatgacctgtgagctccatctgacttgctctgtggaggatgcagatgacaatgtctcattcagatgggaggccttgggaaacacactttcaagtcagccaaacctcactgtctcctgggaccccaggatttccagtgaacaggactacacctgcatagcagagaatgctgtcagtaatttatccttctctgtctctgcccagaagctttgcgaagatgttaaaattcaatatacagataccaaaatgattctgtttatggtttctgggatatgcatagtcttcggtttcatcatactgctgttacttgttttgaggaaaagaagagattccctatctttgtctactcagcgaacacagggccccgagtccgcaaggaacctagagtatgtttcagtgtctccaacgaacaacactgtgtatgcttcagtcactcattcaaacagggaaacagaaatctggacacctagagaaaatgatactatcacaatttactccacaattaatcattccaaagagagtaaacccactttttccagggcaactgcccttgacaatgtcgtgtaagttgctgaaaggcctcagaggaattcgggaatgacacgtcttctgatcccatgagacagaacaaagaacaggaagcttggttcctgttgttcctggcaacagaatttgaatatctaggataggatgatcacctccagtccttcggacttaaacctgcctacctgagtcaaacacctaaggataacatcatttccagcatgtggttcaaataatattttccaatccacttcaggccaaaacatgctaaagataacacaccagcacattgactctctctttgataactaagcaaatggaattatggttgacagagagtttatgatccagaagacaaccacttctctccttttagaaagcagcaggattgacttattgagaaataatgcagtgtgttggttacatgtgtagtctctggagttggatgggcccatcctgatacaagttgagcatcccttgtctgaaatgcttgggattagaaatgtttcagatttcaattttttttcagattttggaatatttgcattatatttagcggttgagtatccaaatccaaaaatccaaaattcaaaatgctccaataagcatttcccttgagtttcattgatgtcgatgcagtgctcaaaatctcagattttggagcattttggatattggatttttggatttgggatgctcaacttgtacaatgtttattagacacatctcctgggacatactgcctaaccttttggagccttagtctcccagactgaaaaaggaagaggatggtattacatcagctccattgtttgagccaagaatctaagtcatccctgactccagtgtctttgtcaccaggccctttggactctacctcagaaatatttcttggaccttccacttctcctccaactccttgaccaccatcctgtatccaaccatcaccacctctaacctgaatcctaccttaagatcagaacagttgtcctcacttttgttcttgtccctctccaacccactctccacaagatggccagagtaatgtttttaatataaattggatccttcagtttcctgcttaaaaccctgcaggtttcccaatgcactcagaaagaaatccagtttccatggccctggatggtctggcccacctccagcctcagctagcattacccttctgacactctctatgtagcctccctgatcttctttcagctcctctattaaaggaaaagttctttatgttaattatttacatcttcctgcaggcccttcctctgcctgctggggtcctcctattctttaggtttaattttaaatatgtcacctcctaagagaaaccttcccagaccactctttctaaaatgaatcttctaggctgggcatggtggctcacacctgtaatccctgtactttgggaggccaaggggggagatcacttgaggtcaggagttcaagaccagcctggccaacttggtgaaaccccgtctttactaaaaatacaaaaaaattagccaggcgtggtggtgcacccctaaaatcccagctacttgagagactgaggcaggagaatcgcttgaacccaggaggtggaggttccagtgagccaaaatcatgccaatgtattccagtctgggtgacagagtgagactctgtctcaaaaaataaataaataaaataaaatgaaatagatcttat

SEQ ID NO: 181993 - DNA, 2559 bp, Homo sapiens
  Payload ID: 15836
  Gene Symbol: SLAMF7
  Gene Name: SLAM family member 7
  Uniprot ID: Q9NQ25
  ENST ID: ENST00000359331
  CDS Start-End: 12-902
cagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgctgctgatgacccagattcctccatggtcctcctgtgtctcctgttggtgcccctcctgctcagtctctttgtactggggctatttctttggtttctgaagagagagagacaagaagagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctataaaaatgtaaatgcaaggtcacacatattaatgacagcctgttgtattaatgatggctccaggtcagtgtctggagtttcattccatcccagggcttggatgtcaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacatgctgtctgccctcatgaaattggctccaaatgaatgaactactttcatgagcagttgtagcaggcctgaccacagattcccagagggccaggtgtggatccacaggacttgaaggtcaaagttcacaaagatgaagaatcagggtagctgaccatgtttggcagatactataatggagacacagaagtgtgcatggcccaaggacaaggacctccagccaggcttcatttatgcacttgtgctgcaaaagaaaagtctaggttttaaggctgtgccagaacccatcccaataaagagaccgagtctgaagtcacattgtaaatctagtgtaggagacttggagtcaggcagtgagactggtggggcacggggggcagtgggtacttgtaaacctttaaagatggttaattcattcaatagatatttattaagaacctatgcggcccggcatggtggctcacacctgtaatcccagcactttgggaggccaaggtgggtgggtcatctgaggtcaggagttcaagaccagcctggccaacatggtgaaaccccatctctactaaagatacaaaaatttgctgagcgtggtggtgtgcacctgtaatcccagctactcgagaggccaaggcatgagaatcgcttgaacctgggaggtggaggttgcagtgagctgagatggcaccactgcactccggcctaggcaacgagagcaaaactccaatacaaacaaacaaacaaacacctgtgctaggtcagtctggcacgtaagatgaacatccctaccaatacagagctcaccatctcttatacttaagtgaaaaacatggggaaggggaaaggggaatggctgcttttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgagccagatctctctccctactgcaaaaccctattgtagtaaaaaagtcttctttactatcttaataaaacagatattgtgagattcacatacaaaaa

SEQ ID NO: 181994 - DNA, 2365 bp, Homo sapiens
  Payload ID: 15836
  Gene Symbol: SLAMF7
  Gene Name: SLAM family member 7
  Uniprot ID: Q9NQ25
  ENST ID: ENST00000368042
  CDS Start-End: 35-721
gcttcatttcagtggctgacttccagagagcaatatggctggttccccaacatgcctcaccctcatctatatcctttggcagctcacagagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgctgctgatgacccagattcctccatggtcctcctgtgtctcctgttggtgcccctcctgctcagtctctttgtactggggctatttctttggtttctgaagagagagagacaagaagagtacattgaagagaagaagagagtggacatttgtcgggaaactcctaacatatgcccccattctggagagaacacagagtacgacacaatccctcacactaatagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctataaaaatgtaaatgcaaggtcacacatattaatgacagcctgttgtattaatgatggctccaggtcagtgtctggagtttcattccatcccagggcttggatgtcaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacatgctgtctgccctcatgaaattggctccaaatgaatgaactactttcatgagcagttgtagcaggcctgaccacagattcccagagggccaggtgtggatccacaggacttgaaggtcaaagttcacaaagatgaagaatcagggtagctgaccatgtttggcagatactataatggagacacagaagtgtgcatggcccaaggacaaggacctccagccaggcttcatttatgcacttgtgctgcaaaagaaaagtctaggttttaaggctgtgccagaacccatcccaataaagagaccgagtctgaagtcacattgtaaatctagtgtaggagacttggagtcaggcagtgagactggtggggcacggggggcagtgggtacttgtaaacctttaaagatggttaattcattcaatagatatttattaagaacctatgcggcccggcatggtggctcacacctgtaatcccagcactttgggaggccaaggtgggtgggtcatctgaggtcaggagttcaagaccagcctggccaacatggtgaaaccccatctctactaaagatacaaaaatttgctgagcgtggtggtgtgcacctgtaatcccagctactcgagaggccaaggcatgagaatcgcttgaacctgggaggtggaggttgcagtgagctgagatggcaccactgcactccggcctaggcaacgagagcaaaactccaatacaaacaaacaaacaaacacctgtgctaggtcagtctggcacgtaagatgaacatccctaccaatacagagctcaccatctcttatacttaagtgaaaaacatggggaaggggaaaggggaatggctgcttttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgagccagatctctctccctactgcaaaaccctattgtagtaaaaaagtcttctttactatcttaataaaacagatattgtgagattcacatacaaaaa

SEQ ID NO: 181995 - DNA, 2689 bp, Homo sapiens
  Payload ID: 15836
  Gene Symbol: SLAMF7
  Gene Name: SLAM family member 7
  Uniprot ID: Q9NQ25
  ENST ID: ENST00000368043
  CDS Start-End: 38-1045
gtggcttcatttcagtggctgacttccagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgctgctgatgacccagattcctccatggtcctcctgtgtctcctgttggtgcccctcctgctcagtctctttgtactggggctatttctttggtttctgaagagagagagacaagaagagtacattgaagagaagaagagagtggacatttgtcgggaaactcctaacatatgcccccattctggagagaacacagagtacgacacaatccctcacactaatagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctataaaaatgtaaatgcaaggtcacacatattaatgacagcctgttgtattaatgatggctccaggtcagtgtctggagtttcattccatcccagggcttggatgtcaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacatgctgtctgccctcatgaaattggctccaaatgaatgaactactttcatgagcagttgtagcaggcctgaccacagattcccagagggccaggtgtggatccacaggacttgaaggtcaaagttcacaaagatgaagaatcagggtagctgaccatgtttggcagatactataatggagacacagaagtgtgcatggcccaaggacaaggacctccagccaggcttcatttatgcacttgtgctgcaaaagaaaagtctaggttttaaggctgtgccagaacccatcccaataaagagaccgagtctgaagtcacattgtaaatctagtgtaggagacttggagtcaggcagtgagactggtggggcacggggggcagtgggtacttgtaaacctttaaagatggttaattcattcaatagatatttattaagaacctatgcggcccggcatggtggctcacacctgtaatcccagcactttgggaggccaaggtgggtgggtcatctgaggtcaggagttcaagaccagcctggccaacatggtgaaaccccatctctactaaagatacaaaaatttgctgagcgtggtggtgtgcacctgtaatcccagctactcgagaggccaaggcatgagaatcgcttgaacctgggaggtggaggttgcagtgagctgagatggcaccactgcactccggcctaggcaacgagagcaaaactccaatacaaacaaacaaacaaacacctgtgctaggtcagtctggcacgtaagatgaacatccctaccaatacagagctcaccatctcttatacttaagtgaaaaacatggggaaggggaaaggggaatggctgcttttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgagccagatctctctccctactgcaaaaccctattgtagtaaaaaagtcttctttactatcttaataaaacagatattgtgagattcacatacaaaaa

SEQ ID NO: 181996 - DNA, 2345 bp, Homo sapiens
  Payload ID: 15836
  Gene Symbol: SLAMF7
  Gene Name: SLAM family member 7
  ENST ID: ENST00000458104
  CDS Start-End: 246-695
agctaaaatataaaatgggaatataccaaatgctgatgaagatggggagcaaatagatctctcatagattgctggtggcaaggtaaaatgctctattcactctgaaaataatttagcaattactcaatctcacatgtctgcggcgtgacccctcctgcttctttaaatatcagctggggaagaggtctgagtaatacctaagagggaagtggcttcatttcagtggctgacttccagagagcaatatggctggttccccaacatgcctcaccctcatctatatcctttggcagctcacagagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaagagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctataaaaatgtaaatgcaaggtcacacatattaatgacagcctgttgtattaatgatggctccaggtcagtgtctggagtttcattccatcccagggcttggatgtcaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacatgctgtctgccctcatgaaattggctccaaatgaatgaactactttcatgagcagttgtagcaggcctgaccacagattcccagagggccaggtgtggatccacaggacttgaaggtcaaagttcacaaagatgaagaatcagggtagctgaccatgtttggcagatactataatggagacacagaagtgtgcatggcccaaggacaaggacctccagccaggcttcatttatgcacttgtgctgcaaaagaaaagtctaggttttaaggctgtgccagaacccatcccaataaagagaccgagtctgaagtcacattgtaaatctagtgtaggagacttggagtcaggcagtgagactggtggggcacggggggcagtgggtacttgtaaacctttaaagatggttaattcattcaatagatatttattaagaacctatgcggcccggcatggtggctcacacctgtaatcccagcactttgggaggccaaggtgggtgggtcatctgaggtcaggagttcaagaccagcctggccaacatggtgaaaccccatctctactaaagatacaaaaatttgctgagcgtggtggtgtgcacctgtaatcccagctactcgagaggccaaggcatgagaatcgcttgaacctgggaggtggaggttgcagtgagctgagatggcaccactgcactccggcctaggcaacgagagcaaaactccaatacaaacaaacaaacaaacacctgtgctaggtcagtctggcacgtaagatgaacatccctaccaatacagagctcaccatctcttatacttaagtgaaaaacatggggaaggggaaaggggaatggctgcttttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgagccagatctctctccctactgcaaaaccctattgtagtaaaaaagtcttctttactatcttaataaaacagatattgtgagattcacat

SEQ ID NO: 181997 - DNA, 2497 bp, Homo sapiens
  Payload ID: 15836
  Gene Symbol: SLAMF7
  Gene Name: SLAM family member 7
  Uniprot ID: Q9NQ25
  ENST ID: ENST00000441662
  CDS Start-End: 246-860
agctaaaatataaaatgggaatataccaaatgctgatgaagatggggagcaaatagatctctcatagattgctggtggcaaggtaaaatgctctattcactctgaaaataatttagcaattactcaatctcacatgtctgcggcgtgacccctcctgcttctttaaatatcagctggggaagaggtctgagtaatacctaagagggaagtggcttcatttcagtggctgacttccagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagtacattgaagagaagaagagagtggacatttgtcgggaaactcctaacatatgcccccattctggagagaacacagagtacgacacaatccctcacactaatagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctataaaaatgtaaatgcaaggtcacacatattaatgacagcctgttgtattaatgatggctccaggtcagtgtctggagtttcattccatcccagggcttggatgtcaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacatgctgtctgccctcatgaaattggctccaaatgaatgaactactttcatgagcagttgtagcaggcctgaccacagattcccagagggccaggtgtggatccacaggacttgaaggtcaaagttcacaaagatgaagaatcagggtagctgaccatgtttggcagatactataatggagacacagaagtgtgcatggcccaaggacaaggacctccagccaggcttcatttatgcacttgtgctgcaaaagaaaagtctaggttttaaggctgtgccagaacccatcccaataaagagaccgagtctgaagtcacattgtaaatctagtgtaggagacttggagtcaggcagtgagactggtggggcacggggggcagtgggtacttgtaaacctttaaagatggttaattcattcaatagatatttattaagaacctatgcggcccggcatggtggctcacacctgtaatcccagcactttgggaggccaaggtgggtgggtcatctgaggtcaggagttcaagaccagcctggccaacatggtgaaaccccatctctactaaagatacaaaaatttgctgagcgtggtggtgtgcacctgtaatcccagctactcgagaggccaaggcatgagaatcgcttgaacctgggaggtggaggttgcagtgagctgagatggcaccactgcactccggcctaggcaacgagagcaaaactccaatacaaacaaacaaacaaacacctgtgctaggtcagtctggcacgtaagatgaacatccctaccaatacagagctcaccatctcttatacttaagtgaaaaacatggggaaggggaaaggggaatggctgcttttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgagccagatctctctccctactgcaaaaccctattgtagtaaaaaagtcttctttactatcttaataaaacagatattgtgagattcacat

SEQ ID NO: 181998 - DNA, 2449 bp, Homo sapiens
  Payload ID: 15836
  Gene Symbol: SLAMF7
  Gene Name: SLAM family member 7
  Uniprot ID: Q9NQ25
  ENST ID: ENST00000458602
  CDS Start-End: 246-812
agctaaaatataaaatgggaatataccaaatgctgatgaagatggggagcaaatagatctctcatagattgctggtggcaaggtaaaatgctctattcactctgaaaataatttagcaattactcaatctcacatgtctgcggcgtgacccctcctgcttctttaaatatcagctggggaagaggtctgagtaatacctaagagggaagtggcttcatttcagtggctgacttccagagagcaatatggctggttccccaacatgcctcaccctcatctatatcctttggcagctcacagagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaagagtacattgaagagaagaagagagtggacatttgtcgggaaactcctaacatatgcccccattctggagagaacacagagtacgacacaatccctcacactaatagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctataaaaatgtaaatgcaaggtcacacatattaatgacagcctgttgtattaatgatggctccaggtcagtgtctggagtttcattccatcccagggcttggatgtcaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacatgctgtctgccctcatgaaattggctccaaatgaatgaactactttcatgagcagttgtagcaggcctgaccacagattcccagagggccaggtgtggatccacaggacttgaaggtcaaagttcacaaagatgaagaatcagggtagctgaccatgtttggcagatactataatggagacacagaagtgtgcatggcccaaggacaaggacctccagccaggcttcatttatgcacttgtgctgcaaaagaaaagtctaggttttaaggctgtgccagaacccatcccaataaagagaccgagtctgaagtcacattgtaaatctagtgtaggagacttggagtcaggcagtgagactggtggggcacggggggcagtgggtacttgtaaacctttaaagatggttaattcattcaatagatatttattaagaacctatgcggcccggcatggtggctcacacctgtaatcccagcactttgggaggccaaggtgggtgggtcatctgaggtcaggagttcaagaccagcctggccaacatggtgaaaccccatctctactaaagatacaaaaatttgctgagcgtggtggtgtgcacctgtaatcccagctactcgagaggccaaggcatgagaatcgcttgaacctgggaggtggaggttgcagtgagctgagatggcaccactgcactccggcctaggcaacgagagcaaaactccaatacaaacaaacaaacaaacacctgtgctaggtcagtctggcacgtaagatgaacatccctaccaatacagagctcaccatctcttatacttaagtgaaaaacatggggaaggggaaaggggaatggctgcttttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgagccagatctctctccctactgcaaaaccctattgtagtaaaaaagtcttctttactatcttaataaaacagatattgtgagattcacat

SEQ ID NO: 181999 - DNA, 2393 bp, Homo sapiens
  Payload ID: 15836
  Gene Symbol: SLAMF7
  Gene Name: SLAM family member 7
  Uniprot ID: Q9NQ25
  ENST ID: ENST00000444090
  CDS Start-End: 246-743
agctaaaatataaaatgggaatataccaaatgctgatgaagatggggagcaaatagatctctcatagattgctggtggcaaggtaaaatgctctattcactctgaaaataatttagcaattactcaatctcacatgtctgcggcgtgacccctcctgcttctttaaatatcagctggggaagaggtctgagtaatacctaagagggaagtggcttcatttcagtggctgacttccagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctataaaaatgtaaatgcaaggtcacacatattaatgacagcctgttgtattaatgatggctccaggtcagtgtctggagtttcattccatcccagggcttggatgtcaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacatgctgtctgccctcatgaaattggctccaaatgaatgaactactttcatgagcagttgtagcaggcctgaccacagattcccagagggccaggtgtggatccacaggacttgaaggtcaaagttcacaaagatgaagaatcagggtagctgaccatgtttggcagatactataatggagacacagaagtgtgcatggcccaaggacaaggacctccagccaggcttcatttatgcacttgtgctgcaaaagaaaagtctaggttttaaggctgtgccagaacccatcccaataaagagaccgagtctgaagtcacattgtaaatctagtgtaggagacttggagtcaggcagtgagactggtggggcacggggggcagtgggtacttgtaaacctttaaagatggttaattcattcaatagatatttattaagaacctatgcggcccggcatggtggctcacacctgtaatcccagcactttgggaggccaaggtgggtgggtcatctgaggtcaggagttcaagaccagcctggccaacatggtgaaaccccatctctactaaagatacaaaaatttgctgagcgtggtggtgtgcacctgtaatcccagctactcgagaggccaaggcatgagaatcgcttgaacctgggaggtggaggttgcagtgagctgagatggcaccactgcactccggcctaggcaacgagagcaaaactccaatacaaacaaacaaacaaacacctgtgctaggtcagtctggcacgtaagatgaacatccctaccaatacagagctcaccatctcttatacttaagtgaaaaacatggggaaggggaaaggggaatggctgcttttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgagccagatctctctccctactgcaaaaccctattgtagtaaaaaagtcttctttactatcttaataaaacagatattgtgagattcacat

SEQ ID NO: 182000 - DNA, 708 bp, Homo sapiens
  Payload ID: 15836
  Gene Symbol: SLAMF7
  Gene Name: SLAM family member 7
  ENST ID: ENST00000495334
  CDS Start-End: 1-708
ggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaagagaacaatcctaaaggaagatccagcaaatacggtttactccactgtggaaataccgaaaa

SEQ ID NO: 182001 - DNA, 2608 bp, Homo sapiens
  Payload ID: 15836
  Gene Symbol: SLAMF7
  Gene Name: SLAM family member 7
  ENST ID: ENST00000621377
  CDS Start-End: 246-971
agctaaaatataaaatgggaatataccaaatgctgatgaagatggggagcaaatagatctctcatagattgctggtggcaaggtaaaatgctctattcactctgaaaataatttagcaattactcaatctcacatgtctgcggcgtgacccctcctgcttctttaaatatcagctggggaagaggtctgagtaatacctaagagggaagtggcttcatttcagtggctgacttccagagagcaatatggctggttccccaacatgcctcaccctcatctatatcctttggcagctcacagagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgactgcctctcccctctccacaggagactctgcccaggtgctgctgatgacccagattcctccatggtcctcctgtgtctcctgttggtgcccctcctgctcagtctctttgtactggggctatttctttggtttctgaagagagagagacaagaagagtacattgaagagaagaagagagtggacatttgtcgggaaactcctaacatatgcccccattctggagagaacacagagtacgacacaatccctcacactaatagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctataaaaatgtaaatgcaaggtcacacatattaatgacagcctgttgtattaatgatggctccaggtcagtgtctggagtttcattccatcccagggcttggatgtcaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacatgctgtctgccctcatgaaattggctccaaatgaatgaactactttcatgagcagttgtagcaggcctgaccacagattcccagagggccaggtgtggatccacaggacttgaaggtcaaagttcacaaagatgaagaatcagggtagctgaccatgtttggcagatactataatggagacacagaagtgtgcatggcccaaggacaaggacctccagccaggcttcatttatgcacttgtgctgcaaaagaaaagtctaggttttaaggctgtgccagaacccatcccaataaagagaccgagtctgaagtcacattgtaaatctagtgtaggagacttggagtcaggcagtgagactggtggggcacggggggcagtgggtacttgtaaacctttaaagatggttaattcattcaatagatatttattaagaacctatgcggcccggcatggtggctcacacctgtaatcccagcactttgggaggccaaggtgggtgggtcatctgaggtcaggagttcaagaccagcctggccaacatggtgaaaccccatctctactaaagatacaaaaatttgctgagcgtggtggtgtgcacctgtaatcccagctactcgagaggccaaggcatgagaatcgcttgaacctgggaggtggaggttgcagtgagctgagatggcaccactgcactccggcctaggcaacgagagcaaaactccaatacaaacaaacaaacaaacacctgtgctaggtcagtctggcacgtaagatgaacatccctaccaatacagagctcaccatctcttatacttaagtgaaaaacatggggaaggggaaaggggaatggctgcttttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgagccagatctctctccctactgcaaaaccctattgtagtaaaaaagtcttctttactatcttaataaaacagatattgtgagattcacat

SEQ ID NO: 182002 - DNA, 2996 bp, Homo sapiens
  Payload ID: 15837
  Gene Symbol: SLAMF8
  Gene Name: SLAM family member 8
  Uniprot ID: Q9P0V8
  ENST ID: ENST00000289707
  CDS Start-End: 150-1007
acttttgggacatcctgttctgagtcaagattcctccttctgaacatgggactttccagaaggaccacagctcctcccgtgcatccactcggcctgggaggttctggattttggctgtcgagggagtttgcctgcctctccagagaaagatggtcatgaggcccctgtggagtctgcttctctgggaagccctacttcccattacagttactggtgcccaagtgctgagcaaagtcgggggctcggtgctgctggtggcagcgcgtccccctggcttccaagtccgtgaggctatctggcgatctctctggccttcagaagagctcctggccacgtttttccgaggctccctggagactctgtaccattcccgcttcctgggccgagcccagctacacagcaacctcagcctggagctcgggccgctggagtctggagacagcggcaacttctccgtgttgatggtggacacaaggggccagccctggacccagaccctccagctcaaggtgtacgatgcagtgcccaggcccgtggtacaagtgttcattgctgtagaaagggatgctcagccctccaagacctgccaggttttcttgtcctgttgggcccccaacatcagcgaaataacctatagctggcgacgggagacaaccatggactttggtatggaaccacacagcctcttcacagacggacaggtgctgagcatttccctgggaccaggagacagagatgtggcctattcctgcattgtctccaaccctgtcagctgggacttggccacagtcacgccctgggatagctgtcatcatgaggcagcaccagggaaggcctcctacaaagatgtgctgctggtggtggtgcctgtctcgctgctcctgatgctggttactctcttctctgcctggcactggtgcccctgctcagggaaaaagaaaaaggatgtccatgctgacagagtgggtccagagacagagaacccccttgtgcaggatctgccataaaggacaatatgaactgatgcctggactatcagtaaccccactgcacaggcacacgatgctctgggacataactggtgcctggaaatcaccatggtcctcatatctcccatgggaatcctgtcctgcctcgaaggagcagcctgggcagccatcacaccacgaggacaggaagcaccagcacgtttcacacctcccccttccctctcccatcttctcatatcctggctcttctctgggcaagatgagccaagcagaacattccatccaggacactggaagttctccaggatccagatccatggggacattaatagtccaaggcattccctcccccaccactattcataaagtattaaccaactggcaccaaggaattgcctccagcctgagtcctaggctctaaaagatattacatatttgaactaatagaggaactctgagtcacccatgccagcatcagcttcagccccagaccctgcagtttgagatctgatgcttcctgagggccaaggcattgctgtaagaaaaggtctagaaataggtgaaagtgagaggtgggggacaggggtttctctttctggcctaaggactttcaggtaatcagagttcatgggccctcaaaggtaaattgcagttgtagacaccgaggatggttgacaacccatggttgagatgggcaccgttttgcaggaaacaccatattaatagacatcctcaccatctccatccgctctcacgcctcctgcaggatctgggagtgagggtggagagtctttcctcacgctccagcacagtggccaggaaaagaaatactgaatttgccccagccaacaggacgttcttgcacaacttcaagaaaagcagctcagctcaggatgagtcttcctgcctgaaactgagagagtgaagaaccataaaacgctatgcagaaggaacattatggagagaaagggtactgaggcactctagaatctgccacattcattttcaaatgcaaatgcagaagacttaccttagttcaaggggaggggacaaagaccccacagcccaacagcaggactgtagaggtcactctgactccatcaaactttttattgtggccatcttaggaaaatacattctgcccctgaatgattctgtctagaaaagctctggagtattgatcactactggaaaaacacttaaggagctaaacttaccttcggggattattagctgataaggttcacagtttctctcacccaggtgtaactggattttttctggggcctcaatccagtcttgataacagcgaggaaagaggtattgaagaaacaggggtgggtttgaagtactattttcccagggtggcttcaatctccccacctaggatgtcagccctgtccaaggaccttccctcttctccccagttcctgggcaatcacttcaccttggacaaaggatcagcacagctggcctccagatccacatcaccactcttccactcgattgttcccagatcctccctgcctggcctgctcagaggttccctgttggtaacctggctttatcaaattctcatccctttcccacacccacttctctcctatcaccttcccccaagattacctgaacagggtccatggccactcaacctgtcagcttgcaccatccccacctgccacctacagtcaggccacatgcctggtcactgaatcatgcaaaactggcctcagtccctaaaaatgatgtggaaaggaaagcccaggatctgacaatgagccctggtggatttgtggggaaaaaatacacagcactccccacctttctttcgttcatctccagggccccacctcagatcaaagcagctctggatgagatgggacctgcagctctccctccacaaggtgactcttagcaacctcatttcgacagtggtttgtagcgtggtgcaccagggccttgttgaacagatccacactgctctaataaagttcccatccttaatga

SEQ ID NO: 182003 - DNA, 1038 bp, Homo sapiens
  Payload ID: 15837
  Gene Symbol: SLAMF8
  Gene Name: SLAM family member 8
  Uniprot ID: Q9P0V8
  ENST ID: ENST00000368104
  CDS Start-End: 89-619
ggaccacagctcctcccgtgcatccactcggcctgggaggttctggattttggctgtcgagggagtttgcctgcctctccagagaaagatggtcatgaggcccctgtggagtctgcttctctgggaagatgcagtgcccaggcccgtggtacaagtgttcattgctgtagaaagggatgctcagccctccaagacctgccaggttttcttgtcctgttgggcccccaacatcagcgaaataacctatagctggcgacgggagacaaccatggactttggtatggaaccacacagcctcttcacagacggacaggtgctgagcatttccctgggaccaggagacagagatgtggcctattcctgcattgtctccaaccctgtcagctgggacttggccacagtcacgccctgggatagctgtcatcatgaggcagcaccagggaaggcctcctacaaagatgtgctgctggtggtggtgcctgtctcgctgctcctgatgctggttactctcttctctgcctggcactggtgcccctgctcagggaaaaagaaaaaggatgtccatgctgacagagtgggtccagagacagagaacccccttgtgcaggatctgccataaaggacaatatgaactgatgcctggactatcagtaaccccactgcacaggcacacgatgctctgggacataactggtgcctggaaatcaccatggtcctcatatctcccatgggaatcctgtcctgcctcgaaggagcagcctgggcagccatcacaccacgaggacaggaagcaccagcacgtttcacacctcccccttccctctcccatcttctcatatcctggctcttctctgggcaagatgagccaagcagaacattccatccaggacactggaagttctccaggatccagatccatggggacattaatagtccaaggcattccctcccccaccactattcataaagtattaaccaactggcaccaaggaattgcctccagcctgagtcctaggctctaaaagatattacatattt

SEQ ID NO: 182004 - DNA, 849 bp, Homo sapiens
  Payload ID: 15838
  Gene Symbol: SLAMF9
  Gene Name: SLAM family member 9
  Uniprot ID: Q96A28
  ENST ID: ENST00000368092
  CDS Start-End: 84-680
ctaggagcctcctaatgcagtcttctgcacagtcctggggactgactgactgaatcacacctctggggctgggggctgctgacatgtgtgcctttccttggctgcttcttctcctgctgctccaggagggcagccaaaggagactctggagatggtgtggatccgaggaagtggttgcggtccttcaggagtccatcagcctccccctggaaataccaccagatgaagaggttgagaacatcatctggtcctctcacaaaagtcttgccactgtggtgccagggaaagagggacatccagctaccatcatggtgaccaatccacactaccagggccaagtgagcttcctggaccccagctattccctgcatatcagcaatctgagctgggaggattcagggctttaccaagctcaagtcaacctgagaacatcccagatctctaccatgcagcagtacaatatatgtgtctaccatcctaactatgcttctgagaagccttcaacagccttctgcctcctggccaagggattgctcatcttcttgctcttggtaattctggccatgggactctgggtcatccgagtccagaaaagacacaaaatgccaaggatgaagaaactcatgagaaacagaatgaaattgaggaaggaggcaaagcctggctccagccctgcctgactgctccttgggaaccccagtcctgagcttggtttcttcccagcacccagagaatccttcctcagctctcttctttccaggggaaggaggtgctcaggggtgggtatccagagagccatacttctgagggaagactggctggcaataaagtcaaattaagtgaccacaa

SEQ ID NO: 182005 - DNA, 1156 bp, Homo sapiens
  Payload ID: 15838
  Gene Symbol: SLAMF9
  Gene Name: SLAM family member 9
  Uniprot ID: Q96A28
  ENST ID: ENST00000368093
  CDS Start-End: 118-987
cttttctcaggaccatcagtcaggctctttgtgtctaggagcctcctaatgcagtcttctgcacagtcctggggactgactgactgaatcacacctctggggctgggggctgctgacatgtgtgcctttccttggctgcttcttctcctgctgctccaggagggcagccaaaggagactctggagatggtgtggatccgaggaagtggttgcggtccttcaggagtccatcagcctccccctggaaataccaccagatgaagaggttgagaacatcatctggtcctctcacaaaagtcttgccactgtggtgccagggaaagagggacatccagctaccatcatggtgaccaatccacactaccagggccaagtgagcttcctggaccccagctattccctgcatatcagcaatctgagctgggaggattcagggctttaccaagctcaagtcaacctgagaacatcccagatctctaccatgcagcagtacaatatatgtgtctaccgatggctgtcagagccccagatcactgtgaactttgagagttctggggaaggtgcctgcagtatgtccctggtgtgctctgtggagaaggcaggcatggatatgacctacagctggctctcccggggggatagcacttatacattccatgaaggccctgtcctcagcacatcctggaggccgggggacagtgccctctcctacacctgcagagccaacaaccccatcagcaacgtcagttcttgccccatccctgatgggcccttctatgcagatcctaactatgcttctgagaagccttcaacagccttctgcctcctggccaagggattgctcatcttcttgctcttggtaattctggccatgggactctgggtcatccgagtccagaaaagacacaaaatgccaaggatgaagaaactcatgagaaacagaatgaaattgaggaaggaggcaaagcctggctccagccctgcctgactgctccttgggaaccccagtcctgagcttggtttcttcccagcacccagagaatccttcctcagctctcttctttccaggggaaggaggtgctcaggggtgggtatccagagagccatacttctgagggaagactggctggcaataaagtcaaattaagtgaccacaa

SEQ ID NO: 182006 - DNA, 1731 bp, Homo sapiens
  Payload ID: 15839
  Gene Symbol: SLC2A4RG
  Gene Name: SLC2A4 regulator
  Uniprot ID: Q9NR83
  ENST ID: ENST00000266077
  CDS Start-End: 53-1216
gtcctgagagtcagccctcgccgctgcagcctcggcgcccggccggccggccatggagcgccccccgccccgcgccgccggccgggaccccagtgcgctgcgggccgaggcgccgtggctgcgcgcggagggtccggggccgcgcgccgcgcccgtgacggtgcccacgccgccgcagggctcttccgtgggcggcggcttcgcgggcttggagttcgcgcggccgcaggagtcggagccgcgggcctcggacctgggggccccccggacgtggacgggggcggcggcggggccccggactccgtcggcgcacatccccgtcccagcgcagagagccaccccaggaaaagcccggctggacgaggtcatggctgccgctgcccttacaagcctgtccaccagccctctccttctgggggccccggttgcagccttcagcccagagcctggcctggagccctggaaggaggccctggtgcggcccccaggcagctacagcagcagcagcaacagtggagactggggatgggacctggccagtgaccagtcctctccgtccaccccgtcacccccactgccccccgaggcagcccactttctgtttggggagcccaccctgagaaaaaggaagagcccggcccaggtcatgttccagtgtctgtggaagagctgcgggaaggtgctgagcacggcgtcggcgatgcagagacacatccgcctggtgcacctggggaggcaggcagagcctgagcagagtgatggtgaggaggacttctactacacagagctggatgttggtgtggacacgctgaccgacgggctgtccagcctgactccagtgtcccccacggcctccatgccgcctgccttcccccgcctggagctgccagagctgctggagcccccagccctgcctagtcccctgcggccgcctgccccgcccctgcccccgccccctgtcctgagcaccgttgctaacccccagtcctgtcacagtgaccgtgtctaccagggctgcctgacgcccgcccgcctggagccgcagcccacggaggtcggagcctgcccacccgccttgtcctccaggatcggagtcaccctgaggaagccccgcggcgacgcgaagaagtgccggaaggtgtatggcatggagcgccgggacctctggtgcacagcctgccgctggaagaaagcctgccagcggttcctggactaagtccggctcgttcaagaacataagctaccaccttctccctccccaccccctccaggcccggggctgaaacagcccgaggacagccccaggggctggctttcaccagctgcagggtctgcttttacttggggtgggggggcggggctgaccctgaaccctcccccccgccaggtcggggaggggtcccaccactcaaagtgcctctaaagaaaccagctttttgcactaaagccaaaccacaccgctgtccccttagccccaagggccctgggggcagccaccctcccgcctgtcggcccgtagatttatcaagggtgttatgggcccagctttggggggccagtcccgatgcactttgaggggtgttggagaggggactcccccactcgcacttaactcaacggctctcgggccctggggctgtttttaccatgtttgtttttgaagctcaggtgtctcacgtctgggctgcaccaggcgaagagagaaattaaagatttgaggtttttccagaa

SEQ ID NO: 182007 - DNA, 13040 bp, Homo sapiens
  Payload ID: 15840
  Gene Symbol: SSH1
  Gene Name: slingshot protein phosphatase 1
  Uniprot ID: Q8WYL5
  ENST ID: ENST00000326495
  CDS Start-End: 95-3244
cggctccaggaggccccgggcccggcccgggcggcggtggcggtggcggctctagctcgagacgtctgtggcgccctcgcaccgcgccgcagccatggccctggtgaccctgcagcgctcgcccacgcccagcgccgcctcctcctcggccagcaacagcgagttggaggctggcagcgaagaagatcgaaaattaaacctcagcttaagtgagagctttttcatggtgaaaggcgcagccctcttcttacaacagggaagcagccctcaaggccagcggagtcttcagcacccccacaagcatgcaggtgatctgcctcaacatcttcaggtgatgatcaaccttctgcgttgcgaagacagaatcaagctggcagtgcgcctggagagcgcctgggcggaccgggtccggtacatggtggtggtgtacagcagcgggcgccaggacaccgaggagaatatcttgctgggagtggacttttccagtaaggaaagtaaaagctgcaccattgggatggttctccgactgtggagcgacacgaaaatccaccttgatggagatggtgggttcagcgtgagcacagcaggaaggatgcacatatttaagcctgtgtctgtccaggccatgtggtctgccctgcaggtgcttcacaaggcctgcgaagtggcccggaggcacaactacttccccgggggtgtagctctcatctgggctacctactatgagagctgcatcagctccgagcagagctgcatcaacgagtggaacgccatgcaggacctggagtctacgcggcccgactcccccgcgctatttgtggacaagcccactgaaggggaaaggaccgagcgcctcatcaaagccaagctccgaagcatcatgatgagccaggatctagaaaatgtgacttccaaagagattcgtaatgaattagagaaacagatgaattgtaacttgaaggaactcaaggaatttatagacaatgagatgctacttatcttgggacagatggacaagccctcccttatcttcgatcatctttatctcggctctgaatggaatgcatccaatctggaggaactgcagggctcaggggttgattacattttaaatgttaccagagaaatcgataatttttttcctggcttatttgcatatcataacatccgagtctacgatgaagagaccacagacctcctcgcccactggaatgaagcgtatcattttataaacaaagcgaagaggaaccattccaagtgcctggtgcattgcaaaatgggcgtgagtcgctcggcctccacagtcatagcctatgcaatgaaggaattcggctggcctctggaaaaagcatataactatgtaaagcagaagcgcagcatcacgcgccccaacgcgggctttatgaggcagctgtctgagtatgaaggcatcttggatgcaagcaaacagcggcacaacaagctgtggcgtcagcagacagacagcagcctccagcagcctgtggatgaccctgcaggacctggcgacttcttgccagagaccccagatggcaccccggaaagccagctgcccttcttggatgatgccgcccagcccggcttagggccccccctcccctgctgtttccggcgactctcagacccccttctgccttcccctgaggatgaaactggcagcttggtccacctggaggatccggagagggaggctctgttggaggaagctgctccacctgcagaggtgcacaggccggccagacagccccagcaaggttccggactctgtgagaaggatgtgaagaagaaactagagtttgggagtcccaaaggtcggagcggctccttgctgcaggtggaggagacggaaagggaggagggcctgggagcagggaggtgggggcagcttccaacccagctcgatcaaaacctgctcaactcggagaacctaaacaacaacagcaagaggagctgtcccaacggcatggaggatgatgctatatttgggatccttaacaaagtgaagccttcctataaatcctgtgccgactgcatgtaccctacagccagcggggctcctgaggcctccagggagcgatgtgaggaccccaatgctcccgccatctgcacccagccagccttcctaccccacatcacgtcctcccctgtggcccacttggccagcaggtcccgtgttccggagaagccagcctctggcccaaccgaacctcccccgttcctaccaccagcaggctccaggagggcagacaccagtggccctggggctggagctgccctagagccaccagccagccttttggaaccttccagagagaccccaaaagtcctgccaaagtccctccttttgaagaattctcactgtgataagaaccctcccagcacagaagtggtaataaaggaagaatcgtcacccaagaaagatatgaagccagccaaggacctgaggcttctgttcagtaatgaatctgagaagccgacaaccaacagctacctgatgcagcaccaggagtccatcattcagctgcagaaggcaggcttggtccgcaagcacaccaaagagctagagcggctgaagagcgtgcctgcagacccagcacctccctccagggatggccctgccagcaggctggaggccagcatccccgaggagagccaggatccagccgcgctccacgagctgggccccctggttatgcccagccaggccgggagtgatgagaagtcagaggccgcccccgcttcattggaaggaggctcactgaagagcccccctcctttcttctaccgcctggaccacaccagtagtttctcaaaagactttctgaagaccatctgctacacccccacctcctcttccatgagctccaacctgacccggagctccagcagcgatagcatccacagtgtccgtgggaagcccgggctggtgaagcagcggacacaggagattgagacccggctccggctggcgggcctcaccgtctcttccccactgaagcgctcacactctcttgccaagctggggagtctcaccttctcaacggaagacctgtccagtgaggctgacccgtccaccgtcgctgactcccaggacaccactttgagtgaatcttccttcttgcatgagccccagggaaccccgagggacccagctgcaacctccaaaccatcagggaaacccgccccagaaaacttaaagagcccttcgtggatgagcaaaagctgacccgccttttgctgcgtcaggctgggcggatattttcatatgatccctccctcactttcactgtggatttggatcgaccccttacatcttgatttcccttaaacgagtgaagtcatcctaacttttcccctactcttgccatagagaggaggagaagaaactaaccaacatgcagcacaagaaggggagctgtcagtcgtgtggcctgggagaaccaggagccgccggccaggagacacaaaactccgctcccaccgtgtcttcaagaagaaccatgttttaggaagaacgtgcacacataggcgcacacatccagactgttcccttcgcatcctgcagaagagtcctggtggtggcagcctcaccgcggcacacgttctagctcattcttggcctcgcagaaaactctcggatggcaacattaagtcctacctctgttctcgctgcgctttttatttttaaaacacacgaatgaccaaggcttgttccagggaataatgctctgtctgaaagcgtttttccaaaaaaagaatttttcgttttgtgttttggttgggaccccagacgtgtcaagacttttaacccgacagccccaagcactgctgagtaaagtcatcagatgagtagtcccacgctgttgttgagctgactctgtgcccgaatggtggtgcaggcgccctgtcctggttgtgttgttacgtgtttgaccagcacaggggtccggtggggaaaatgtatgggttgttctcagttgttgctaatgctgaagtttaaatctcaaggggaagggcccacctgcattgttgagtgtctgctgctgaaacacatgattgtgtttaggtttgaaattgctcaagtgtctggctcaggtggtggttctgagacacatcgtcctgctgagagcccagatgcttaggtccactagggcccatctagggaagggaaaggagatttcagcggcttccccgaaaggaacgggactgtcgggatgcttcccggatgtctacagttgccccttcctgcagtgagattactgcttcctgtttccctccagctcttcccagcagcagtgagggagtataagagggatctgtagtcgctgcctggctctgtgggcggcccctttaagactcaggtgagctcagccagtcccgctgcgccaggcttgaatcaaaggtgtcagcaagctagatgtcaaaacatttcgagagagaggcagcttgcagaaaagcagaaaggttgaattcaggggtcagcaaactatggcatgtggccccgtgagctaggaatggtttttcctctttaagacagggcctggctctgtcacctaggctggagtacagtagtgcaatcatgactcactgcagcatcaacctccctggctcaagcgatggcttttacctttttaaggagttgtaaaaaaaagaaataatatgtgacagaattcatgtggcccacaaagcctgaggtacttactgtcaggccctttgtagaaaaagttgctgacccctggtttgatttgccacacagggctgctcatggccctgtaggaagaaactgggtaaatgtgaagccctctgcctctctgacacctaaggccagacccttccctcctcccgaccacaagctttgccagccccgcactagcctcacctgtgcaggatggagtaggttgcgtacatgggggaaggcaggtgaacacagttggctgaagctcttccacaattccatcttgccctcagctgggtccgccagattaactcagtgaaaccagaaagccttcaaggaccagctgaattctgaaagtgagtgagtgagccatcatcttaacattggccagaactgtgttccccaaagctattctagaaagcaccccaggagggatctgcaggaacaaggctagttcatattttacctagtgagcacagtttttgcaaaaatcctccctccaggactttgtctccttggagtgatttttaaaaatacatacattactttatagggagctgttttcccactagtgtcaattaaaatcaccttaaaaggtgattatccacttattcctaaacccctgtgggttgttccccctttccctcagccaacaaaagcatagcctcaaaaaatatcaagttcggtatgttttgccaaatcaaatttcatgtggtagatcaatttttgtgtcaaaataatcttttaaatttagtgatgacaggcttttgttggttttttaaccacgtctatgtatgagaatgatatatttttgaaaactttaattttgaaagccataatttttcttatctaaagagttggggggtggggtgtggaatctggagagtacaagttggtctttggcttctggcaaacttacccattcatttttggaagcacagctagcatatcaacatccagacgagagcgctggtcccgtccacagagcagagtgaagcattctggacttgatgcttaatagcctggcctggagaaaagggtaaggtttatttttggaaacccagatcagttgcatgtaaacagatggcacatggctatttaaaatgctgtatgatggggccgggcgcggtggctcacgcctgtaatcctagcactttgggaggccgaggcaggcggatcatctgaggtcaggagttctagaccagcctggccaacatggtgaaaccccgtctctactaaaaatacaaaaacttagctgggtgtggtagtgcgtgcctgtaatcctagctacttaggaggctgaggcaggagaatcgcttgaacctgggtggcggaggttgcaatgagccgagatcgcgccactgcactccagcctgggtgcaatgaaactgggagtgaaactccgtctcaaaaaaataaaatgctgtatgaacaagatgagcattctgtcaggtgtcgggacacctgggcaaagacgaattcatgctgtctgtgaaaaggaagtttgcactgtaacatatgccatagcttggcccttgctttgtatgcaaccttagctgatggggaaaattccaaacataagtggcacaggaaagaggcaggcagaggaggcaggggtctgtgctgtgcaagtcactggttttttatgactatcattttcattgaatgcatttgttgaattgggacaaaaggaacattttctaaatcagcttgatactctttataaaaaacagctgaatcttatcttctgcctcacattaattcatgtggcatgccaaaagttagactgaacttttctacatcttcaccttgcattgatacaggaaagtcttctctttaagtcttgctaagtataagggggatagtggtcacgggaagaggagaaccggggctgctctcggatggtaattgacaatgccgatttccatttctttgtcttacggctacttccgagccttctagcaaggtccctggttgcatgtatttcctaagagcagagtttatttctctttacattccctgcttccttgctctccatgcagggaccccagccaacctctgggctgttgaatagctctctgctgggtggcaagcccttctccttggcaccctgttgcttaagcatacagattgctcaccaggtgcacacagacagctgtactgtccaagcccattctgctccaccctgtcctcttcagctaaagagcattccagtaatctaaagcccttttcccctggagaagtccagagtttgcagcagtgtggagctgagcttgaacagaacagaccctcagcacggccctggactaatgcactcttatctgagggcagtccattctagaaggttgatgaatttccctaccactctcctggggaccttttctctctagtgggaacaaatgctacataatttagtcaagatcctattaagtcatctcacctgaggcatctggagagggagttgccttccattggtgggaaattgttggtgccagaatacattttgcccaaaactcttctcattggctggccacctagcagggctcctctaaacacgcaactcagcgaggggacccccttcacctctggcaagagagctgggtagatcagaaacttggtgacacctggctagcacagagcaggctcacttgtcttggtcccactacccagattcctgcagacattgcaaaccaaatgaaggttgttgaatgacccctgtccccagccacttgttttgttatcatctgctctgcagtggaatgcctgtgtgtttgagttcactctgcatctgtatatttgagtatagaaaccgagtcaagtgatcatgtgcatccagacacactgtgtcacctgagccacagagcaaatcaccttaacgatctggaatgaaactgtgaccagtgccgccctgggtggttctggagagactgccgtcttcttgtttggccataggtgctggggccccggcttcagtcactgtctcagacaggagtcccgataagcagatcaccagtcctccactgtccttcctgtcggccttgctgcatgagaagatagctgcttcctccctcttttcctacactgtaattattgttttacaattgagtgccttaataatagtttacaaatactatgtatttatgcaaaactgttaaagtctcatctgttatgattggatacttggtcttgtcagtagtggtcagcattgggttgtgagcttgtcctactccatacgtgtttatcctgctatgcagttttacattgtgtgttcacatctattccaaggagccttgctagaaacaacactggcggttcctgcaggccaggcaggcattggcccatgctgtgtcccataggagccaatgaaagaacgtagcttggtctgctagccagccgtggggtggcgcaggccaggcagcctctgcaccagagtccagcacctgcccattccccagtcacacaatcatactcttctttcatagagattttattaccacctagaccaccctagttttcctctctgttagtgtcctgagctcttttgcaacaaaatgtaggtacagaccaatccctgtcccttccccaatcaggagctccacaccatgagttgtttggttttccagaagctgccagtgggttcccgtgaattgcgttaagatatcgatgattttttttattgtttttcttcttgtttttttaaataatatatttaaaggcagtatcttttgtactgtgaatttgcagtagaagatgcagaatgcactttttttttacttctgttggtgtgtattgtatatagtgtgtgtgcttcttgtgatgaaaataaactttttctttataaattcctgatgactgagtttatataaaaggaaactgcttcctcagcccttgccaaaacagtctgatacatcgtcatcatcatcgtcattgacatggccagtctttattgagcatctattacatgctcagttctttgctagaaaacctggacaagttacaccaaagaaaggaccacaggaagaaatgatagttcctcctggaactagtctgttttctttctaattttgtcagtaagcaagaacaggcccacctgtgggtggtcctttgtgtaccaaaaaaaaaaagttacccaccaggaaaggatttggactttgggtgggttctcttcccgtacaagtaggaaatgtaaagccagaggtgtgcactaaagaacatctaacctgctcccaccagccctggtgggagagggaggaccctggaggctaagtactgctggtttccaaggtgcatgctcatgtcccagtccacttcaccccaggcagcttttggtggctcttctcccttggacactcaggaggcagagctgcttccatttttttttttttaatttttttttttttttttttgagactgggtctggctctcttgctcaggctggagttcagtggtgccatcatagctcactgcaacctcgacttcctaggctaaagtgatcctcctgcctcaagcaatcctcccacctcagcctccccagtagctgggactacaggcgtgcaccaccttgccccgctaatttttacaatttattatagacatgaagtctcgctttgctgcccaggctggtctttaattcctgtcttcaagtgatcctcccaccttggcctcccaaagtgctgggattacaggtgtgagccacctcaacttccatcttaaaattctgcctccttagagttctttgctttctgctgtgtagtcagggaggagtcacattcactcagtctcctctgtctggatgcgatacatcatttctacttgctttccagtgggcagggcccagtcacagggtcccaatgcaacagccagggagactgggaaatgtatggggcacatgtatttggtgagcactaactgtcacaagtacctgggcgtgacccctaaattccagtgcctgcagagccaggaagtattttgttcagttcatctggacttgctctgtctctcaactggactcaaaagactgatgaataaaccagaatgcaagtttattactttaccaaaagaattataatcatcaagcagaccagattgctcacatgctgattagcacatttagtcctgctaggtaagtctttctttttttgagacagcctggagtgcagtggcagtcatggctcactgaagtgttgatctcctgggctccagcaatcctgcctcagcctcccaagtagctgggaccagagccacacactgctgcacccagctaaatttatttatttatttatttaaaagatagggtctcactatgttgcccagactggtcttgaactcctggtttctgatgatcctcctgcctcagcctcccaaagtgttgagattataggcatgagccactgtgcccagccccttctaggtaaatctctatggggtgccaaattttggttaagaattgcttattgaatattaaaagtttagtgggatgcttcttttttttttttcttttgagatggagtttagctcttgttgcccagactggagtgcaatggtgtgatctcagctcaccgcaacctctgcctcctgggttcaagtgattttcctgcctcagcctcccgagtagctgggaatacaggcatgtgccaccacgcctggctaattttgtatttttaatcgaaatggggtttctccatgttggtcaggctgttctcaaactcccaacctcaggtaatccacccgccttggcctcccaaagtgctgggattataggcatgagccaccgcgccaagccacaggatgcttctaatagtgttatcaagctataatgcagccctctctgtaaaatgttttaaaaacaaatcactgagggtcatggttcaagacactgttctctggcaaggttgaagatagctaacaaattctctttgggttccagccatgaatggggtgggatgggccccagcaatctgtatgtttctgagattccctgggaattctgatggccaagtttagaaaccatcaaaataagaatatgatgcaactgagtaggctcacgctttgctaattacattgcacacatgctttttggagacaacacccacactaccctaacaatgtgtgttcataaaactcatccgatacttatttgttcaaggccctaggacaatattcctgtaatgggctgcttttgccctgatttcctcctcagagtaactgtctcgcggttgggcacgatcccagatcacatctacagtggaggtggttttgctggggaggatccgcatgcttgtttgtgtttatgcctggggaaccccctcttggcaagatgttcgggagaggctccaaaggcagcacagaggacggcttggaacttagggggattcactttatggtaaagaagccctttctaaaggagagctccacccaggaaacaccacccacccacgcatccttgcctcctaaaaccaggttatgtttatcacataccttctatgtgctttacataaagaatcccctggaattctccaaactgggcattgtggtctgtgatgcatatctcaaaagaggtgagagggttgggcacggtggctcacgcctgtaatcccagcactttgggaagccaaggcaggtggatcacttgaggtcagaagctcaagaccagcctggctcacatggtgaaacgccgtctcaactaaaaatacaaaaattagccgggcatgatggcgggcgcctgtaatcccagctactcgggaggctgaggcaggagaatcgcttgaacccaggaggtggaggttgctgtgagccaagattgcaccactgcactccagcctgggtgacagagtgagactctgtctcaaaaaacaaaaaaaagaaaaaaaaaggtagaggagagtcctttttctaactttcttgaactctttggactaccttgggatccttctattaactgccttgttggcattattctcagtttatgaaaaaacaggcccacagagtggaagtaatttgcctacaggtacatctaaaaattgatgaagccagataggaactgctccctcatcatctgaaacccttcccagagctgtctctcccaccccagaagtagaaagaagccagacaaagatgcatcttgatctcccttgtggtttcagcaaggaagcagatgagttggagatgaagcccccagcccctgggaaattggacccacttcttgctccaaaggctattggggtgacacaaggtgtgtttctttcccgtagatcatattcaccatattttgcctttaaatggaaattgtgcatcctgaagtaccttgttaagagtccattttcaacctgaaattccttttttttgtaaaccacttcagcaaatacagtgtggcatttacattagcaacctcccagcctaggagaggatgctccagcatccgactctaaaagacaaatttgggcacggtggcttgacgcctgttatcccaacaccttgagaggccgaggcaggcagattgcttgagcccaggagttcaagaccagcccaggtaacatggtgaacccccatctctaccaataatacaaaaattagccaggcatggtggtgtgccagtggtcccagctacttgagtggctgaggtgaaggatctcctgagcctgggaggcagaggttgcagtgagccgagatcgaaccactgcactccagcttatgcaacagagcaagaccgtgtctcaaaaacaaataaaaataaaagattttaaaaagacaaattatcccacaaatggtacattgtggtggtggtggtggtggtggtggtagacctccctcttgctcttgaaattggatcagaacaaactgacaatgctacctacttcatggggtcattggtgaattcactgataatgcatgcaaatccccttctgcctggcacactacctaataaataaatggtggttgttattgttggaattggaggatatattcctagttgcaagggtttcacatgtattaccaagttaatcctcaccgcagatatgattctgttttacagaggaagcagtggatgctcagagaggttaggtaacgtgggtcagggacacacagccaggaaggggcagaggctgggagtgcctgactccaaattcatgcaatttctaccccaccatcttctccccaaggaaaatagtccctaatgcatgtgtgcaatgcttagagggcagtagatgctcaacagatgctgagagagtgagggagtaaatgagatatgccatgaaaaggagcccctgtggacttatgcgtgcgtttgtttaacttgtgggcaagtacttatagacaggtgcaaacaataaatctccttttgcaactg

SEQ ID NO: 182008 - DNA, 2432 bp, Homo sapiens
  Payload ID: 15840
  Gene Symbol: SSH1
  Gene Name: slingshot protein phosphatase 1
  Uniprot ID: Q8WYL5
  ENST ID: ENST00000326470
  CDS Start-End: 147-2258
tttttcagccaaaatatcagaggaagacaagagttccacaagagccatttgcttttcgggtaggactctgaggaggagttggctccccagccctcgtggaagcactcggcagcctcctggcttttcctgatctccatagggagcagatggccagagctcggagggcagttgtagggagcgttagagatgtgagcactgcagccacgaacctcttttattttaccgacttctgcatcttccttcagccaacccactgcttctgctgtccagaggtttccagctcaaattacttaagtgagagctttttcatggtgaaaggcgcagccctcttcttacaacagggaagcagccctcaaggccagcggagtcttcagcacccccacaagcatgcaggtgatctgcctcaacatcttcaggtgatgatcaaccttctgcgttgcgaagacagaatcaagctggcagtgcgcctggagagcgcctgggcggaccgggtccggtacatggtggtggtgtacagcagcgggcgccaggacaccgaggagaatatcttgctgggagtggacttttccagtaaggaaagtaaaagctgcaccattgggatggttctccgactgtggagcgacacgaaaatccaccttgatggagatggtgggttcagcgtgagcacagcaggaaggatgcacatatttaagcctgtgtctgtccaggccatgtggtctgccctgcaggtgcttcacaaggcctgcgaagtggcccggaggcacaactacttccccgggggtgtagctctcatctgggctacctactatgagagctgcatcagctccgagcagagctgcatcaacgagtggaacgccatgcaggacctggagtctacgcggcccgactcccccgcgctatttgtggacaagcccactgaaggggaaaggaccgagcgcctcatcaaagccaagctccgaagcatcatgatgagccaggatctagaaaatgtgacttccaaagagattcgtaatgaattagagaaacagatgaattgtaacttgaaggaactcaaggaatttatagacaatgagatgctacttatcttgggacagatggacaagccctcccttatcttcgatcatctttatctcggctctgaatggaatgcatccaatctggaggaactgcagggctcaggggttgattacattttaaatgttaccagagaaatcgataatttttttcctggcttatttgcatatcataacatccgagtctacgatgaagagaccacagacctcctcgcccactggaatgaagcgtatcattttataaacaaagcgaagaggaaccattccaagtgcctggtgcattgcaaaatgggcgtgagtcgctcggcctccacagtcatagcctatgcaatgaaggaattcggctggcctctggaaaaagcatataactatgtaaagcagaagcgcagcatcacgcgccccaacgcgggctttatgaggcagctgtctgagtatgaaggcatcttggatgcaagcaaacagcggcacaacaagctgtggcgtcagcagacagacagcagcctccagcagcctgtggatgaccctgcaggacctggcgacttcttgccagagaccccagatggcaccccggaaagccagctgcccttcttggatgatgccgcccagcccggcttagggccccccctcccctgctgtttccggcgactctcagacccccttctgccttcccctgaggatgaaactggcagcttggtccacctggaggatccggagagggaggctctgttggaggaagctgctccacctgcagaggtgcacaggccggccagacagccccagcaaggttccggactctgtgagaaggatgtgaagaagaaactagagtttgggagtcccaaaggtcggagcggctccttgctgcaggtggaggagacggaaagggaggagggcctgggagcagggaggtgggggcagcttccaacccagctcgatcaaaacctgctcaactcggagaacctaaacaacaacagcaagaggagctgtcccaacggcatggaggtaggcagagcccggcctgcagggtggcacaccccatcccttccatcccactctaattggcctacctcagcctctgtagtagggactacaggcacccgccaccacacccagctgatttttttctattgtctcctctgggcccccagctcccatctccagggacctgagggttctttcacagggtgattctgctggtgggtacgtagtgcataccttatatagcaaattgagaatctgttgggaataacacatatctctgcacaccatcttcaccccatgtaccttattcataccctgggcagggcttccaactcaatttctttttgtgtatgtaaaattaaaacatataatttatcagcc

SEQ ID NO: 182009 - DNA, 583 bp, Homo sapiens
  Payload ID: 15840
  Gene Symbol: SSH1
  Gene Name: slingshot protein phosphatase 1
  ENST ID: ENST00000546697
  CDS Start-End: 122-583
aacatggaggaggaacagctggccttgtaagtgatcacagagtgaaaccagcctagtctgttgcattgttcctttttttttccaaaggaaatataagggaaaccaaggggaatttttgctcatggtttccaaggcaaaggtcatcgttaatggttggctgtttccagcgtgcttgggtttctgcttaagtgagagctttttcatggtgaaaggcgcagccctcttcttacaacagggaagcagccctcaaggccagcggagtcttcagcacccccacaagcatgcaggtgatctgcctcaacatcttcaggtgatgatcaaccttctgcgttgcgaagacagaatcaagctggcagtgcgcctggagagcgcctgggcggaccgggtccggtacatggtggtggtgtacagcagcgggcgccaggacaccgaggagaatatcttgctgggagtggacttttccagtaaggaaagtaaaagctgcaccattgggatggttctccgactgtggagcgacacgaaaatccaccttgatggagatggtgggttcagcgtgagcacagcaggaaggatgcacatattt

SEQ ID NO: 182010 - DNA, 5621 bp, Homo sapiens
  Payload ID: 15840
  Gene Symbol: SSH1
  Gene Name: slingshot protein phosphatase 1
  ENST ID: ENST00000546433
  CDS Start-End: 1-287
acgccatgcaggacctggagtctacgcggcccgactcccccgcgctatttgtggacaagcccactgaaggggaaaggaccgagcgcctcatcaaagccaagctccgaagcatcatgatgagccaggatctagaaaatgtgacttccaaagagattcgtaatgaattagagaaacagatgaattgtaacttgaaggaactcaaggaatttatagacaatgagatgctacttatcttgggacagatggacaagccctcccttatcttcgatcatctttatctcggttgattacattttaaatgttaccagagaaatcgataatttttttcctggcttatttgcatatcataacatccgagtctacgatgaagagaccacagacctcctcgcccactggaatgaagcgtatcattttataaacaaagcgaagaggaaccattccaagtgcctggtgcattgcaaaatgggcgtgagtcgctcggcctccacagtcatagcctatgcaatgaaggaattcggctggcctctggaaaaagcatataactatgtaaagcagaagcgcagcatcacgcgccccaacgcgggctttatgaggcagctgtctgagtatgaaggcatcttggatgcaagcaaacagcggcacaacaagctgtggcgtcagcagacagacagcagcctccagcagcctgtggatgaccctgcaggacctggcgacttcttgccagagaccccagatggcaccccggaaagccagctgcccttcttggatgatgccgcccagcccggcttagggccccccctcccctgctgtttccggcgactctcagacccccttctgccttcccctgaggatgaaactggcagcttggtccacctggaggatccggagagggaggctctgttggaggaagctgctccacctgcagaggtgcacaggccggccagacagccccagcaaggttccggactctgtgagaaggatgtgaagaagaaactagagtttgggagtcccaaaggtcggagcggctccttgctgcaggtggaggagacggaaagggaggagggcctgggagcagggaggtgggggcagcttccaacccagctcgatcaaaacctgctcaactcggagaacctaaacaacaacagcaagaggagctgtcccaacggcatggaggatgatgctatatttgggatccttaacaaagtgaagccttcctataaatcctgtgccgactgcatgtaccctacagccagcggggctcctgaggcctccagggagcgatgtgaggaccccaatgctcccgccatctgcacccagccagccttcctaccccacatcacgtcctcccctgtggcccacttggccagcaggtcccgtgttccggagaagccagcctctggcccaaccgaacctcccccgttcctaccaccagcaggctccaggagggcagacaccagtggccctggggctggagctgccctagagccaccagccagccttttggaaccttccagagagaccccaaaagtcctgccaaagtccctccttttgaagaattctcactgtgataagaaccctcccagcacagaagtggtaataaaggaagaatcgtcacccaagaaagatatgaagccagccaaggacctgaggcttctgttcagtaatgaatctgagaagccgacaaccaacagctacctgatgcagcaccaggagtccatcattcagctgcagaaggcaggcttggtccgcaagcacaccaaagagctagagcggctgaagagcgtgcctgcagacccagcacctccctccagggatggccctgccagcaggctggaggccagcatccccgaggagagccaggatccagccgcgctccacgagctgggccccctggttatgcccagccaggccgggagtgatgagaagtcagaggccgcccccgcttcattggaaggaggctcactgaagagcccccctcctttcttctaccgcctggaccacaccagtagtttctcaaaagactttctgaagaccatctgctacacccccacctcctcttccatgagctccaacctgacccggagctccagcagcgatagcatccacagtgtccgtgggaagcccgggctggtgaagcagcggacacaggagattgagacccggctccggctggcgggcctcaccgtctcttccccactgaagcgctcacactctcttgccaagctggggagtctcaccttctcaacggaagacctgtccagtgaggctgacccgtccaccgtcgctgactcccaggacaccactttgagtgaatcttccttcttgcatgagccccagggaaccccgagggacccagctgcaacctccaaaccatcagggaaacccgccccagaaaacttaaagagcccttcgtggatgagcaaaagctgacccgccttttgctgcgtcaggctgggcggatattttcatatgatccctccctcactttcactgtggatttggatcgaccccttacatcttgatttcccttaaacgagtgaagtcatcctaacttttcccctactcttgccatagagaggaggagaagaaactaaccaacatgcagcacaagaaggggagctgtcagtcgtgtggcctgggagaaccaggagccgccggccaggagacacaaaactccgctcccaccgtgtcttcaagaagaaccatgttttaggaagaacgtgcacacataggcgcacacatccagactgttcccttcgcatcctgcagaagagtcctggtggtggcagcctcaccgcggcacacgttctagctcattcttggcctcgcagaaaactctcggatggcaacattaagtcctacctctgttctcgctgcgctttttatttttaaaacacacgaatgaccaaggcttgttccagggaataatgctctgtctgaaagcgtttttccaaaaaaagaatttttcgttttgtgttttggttgggaccccagacgtgtcaagacttttaacccgacagccccaagcactgctgagtaaagtcatcagatgagtagtcccacgctgttgttgagctgactctgtgcccgaatggtggtgcaggcgccctgtcctggttgtgttgttacgtgtttgaccagcacaggggtccggtggggaaaatgtatgggttgttctcagttgttgctaatgctgaagtttaaatctcaaggggaagggcccacctgcattgttgagtgtctgctgctgaaacacatgattgtgtttaggtttgaaattgctcaagtgtctggctcaggtggtggttctgagacacatcgtcctgctgagagcccagatgcttaggtccactagggcccatctagggaagggaaaggagatttcagcggcttccccgaaaggaacgggactgtcgggatgcttcccggatgtctacagttgccccttcctgcagtgagattactgcttcctgtttccctccagctcttcccagcagcagtgagggagtataagagggatctgtagtcgctgcctggctctgtgggcggcccctttaagactcaggtgagctcagccagtcccgctgcgccaggcttgaatcaaaggtgtcagcaagctagatgtcaaaacatttcgagagagaggcagcttgcagaaaagcagaaaggttgaattcaggggtcagcaaactatggcatgtggccccgtgagctaggaatggtttttcctctttaagacagggcctggctctgtcacctaggctggagtacagtagtgcaatcatgactcactgcagcatcaacctccctggctcaagcgatggcttttacctttttaaggagttgtaaaaaaaagaaataatatgtgacagaattcatgtggcccacaaagcctgaggtacttactgtcaggccctttgtagaaaaagttgctgacccctggtttgatttgccacacagggctgctcatggccctgtaggaagaaactgggtaaatgtgaagccctctgcctctctgacacctaaggccagacccttccctcctcccgaccacaagctttgccagccccgcactagcctcacctgtgcaggatggagtaggttgcgtacatgggggaaggcaggtgaacacagttggctgaagctcttccacaattccatcttgccctcagctgggtccgccagattaactcagtgaaaccagaaagccttcaaggaccagctgaattctgaaagtgagtgagtgagccatcatcttaacattggccagaactgtgttccccaaagctattctagaaagcaccccaggagggatctgcaggaacaaggctagttcatattttacctagtgagcacagtttttgcaaaaatcctccctccaggactttgtctccttggagtgatttttaaaaatacatacattactttatagggagctgttttcccactagtgtcaattaaaatcaccttaaaaggtgattatccacttattcctaaacccctgtgggttgttccccctttccctcagccaacaaaagcatagcctcaaaaaatatcaagttcggtatgttttgccaaatcaaatttcatgtggtagatcaatttttgtgtcaaaataatcttttaaatttagtgatgacaggcttttgttggttttttaaccacgtctatgtatgagaatgatatatttttgaaaactttaattttgaaagccataatttttcttatctaaagagttggggggtggggtgtggaatctggagagtacaagttggtctttggcttctggcaaacttacccattcatttttggaagcacagctagcatatcaacatccagacgagagcgctggtcccgtccacagagcagagtgaagcattctggacttgatgcttaatagcctggcctggagaaaagggtaaggtttatttttggaaacccagatcagttgcatgtaaacagatggcacatggctatttaaaatgctgtatgatggggccgggcgcggtggctcacgcctgtaatcctagcactttgggaggccgaggcaggcggatcatctgaggtcaggagttctagaccagcctggccaacatggtgaaaccccgtctctactaaaaatacaaaaacttagctgggtgtggtagtgcgtgcctgtaatcctagctacttaggaggctgaggcaggagaatcgcttgaacctgggtggcggaggttgcaatgagccgagatcgcgccactgcactccagcctgggtgcaatgaaactgggagtgaaactccgtctcaaaaaaataaaatgctgtatgaacaagatgagcattctgtcaggtgtcgggacacctgggcaaagacgaattcatgctgtctgtgaaaaggaagtttgcactgtaacatatgccatagcttggcccttgctttgtatgcaaccttagctgatggggaaaattccaaacataagtggcacaggaaagaggcaggcagaggaggcaggggtctgtgctgtgcaagtcactggttttttatgactatcattttcattgaatgcatttgttgaattgggacaaaaggaacattttctaaatcagcttgatactctttataaaaaacagctgaatctt

SEQ ID NO: 182011 - DNA, 602 bp, Homo sapiens
  Payload ID: 15840
  Gene Symbol: SSH1
  Gene Name: slingshot protein phosphatase 1
  ENST ID: ENST00000548522
  CDS Start-End: 18-131
cgcaccgcgccgcagccatggccctggtgaccctgcagcgctcgcccacgcccagcgccgcctcctcctcggccagcaacagcgagttggaggctggcagcgaagaagatcgaaaattaaacctcaggtgatctgcctcaacatcttcaggtgatgatcaaccttctgcgttgcgaagacagaatcaagctggcagtgcgcctggagagcgcctgggcggaccgggtccggtacatggtggtggtgtacagcagcgggcgccaggacaccgaggagaatatcttgctgggagtggacttttccagtaaggaaagtaaaagctgcaccattgggatggttctccgactgtggagcgacacgaaaatccaccttgatggagatggtgggttcagcgtgagcacagcaggaaggatgcacatatttaagcctgtgtctgtccaggccatgtggtctgccctgcaggtgcttcacaaggcctgcgaagtggcccggaggcacaactacttccccgggggtgtagctctcatctgggctacctactatgagagctgcatcagctccgagcagagctgcatcaacgagtggaacgccatgcaggacct

SEQ ID NO: 182012 - DNA, 2354 bp, Homo sapiens
  Payload ID: 15840
  Gene Symbol: SSH1
  Gene Name: slingshot protein phosphatase 1
  Uniprot ID: Q8WYL5
  ENST ID: ENST00000551165
  CDS Start-End: 95-2173
cggctccaggaggccccgggcccggcccgggcggcggtggcggtggcggctctagctcgagacgtctgtggcgccctcgcaccgcgccgcagccatggccctggtgaccctgcagcgctcgcccacgcccagcgccgcctcctcctcggccagcaacagcgagttggaggctggcagcgaagaagatcgaaaattaaacctcagcttaagtgagagctttttcatggtgaaaggcgcagccctcttcttacaacagggaagcagccctcaaggccagcggagtcttcagcacccccacaagcatgcaggtgatctgcctcaacatcttcaggtgatgatcaaccttctgcgttgcgaagacagaatcaagctggcagtgcgcctggagagcgcctgggcggaccgggtccggtacatggtggtggtgtacagcagcgggcgccaggacaccgaggagaatatcttgctgggagtggacttttccagtaaggaaagtaaaagctgcaccattgggatggttctccgactgtggagcgacacgaaaatccaccttgatggagatggtgggttcagcgtgagcacagcaggaaggatgcacatatttaagcctgtgtctgtccaggccatgtggtctgccctgcaggtgcttcacaaggcctgcgaagtggcccggaggcacaactacttccccgggggtgtagctctcatctgggctacctactatgagagctgcatcagctccgagcagagctgcatcaacgagtggaacgccatgcaggacctggagtctacgcggcccgactcccccgcgctatttgtggacaagcccactgaaggggaaaggaccgagcgcctcatcaaagccaagctccgaagcatcatgatgagccaggatctagaaaatgtgacttccaaagagattcgtaatgaattagagaaacagatgaattgtaacttgaaggaactcaaggaatttatagacaatgagatgctacttatcttgggacagatggacaagccctcccttatcttcgatcatctttatctcggctctgaatggaatgcatccaatctggaggaactgcagggctcaggggttgattacattttaaatgttaccagagaaatcgataatttttttcctggcttatttgcatatcataacatccgagtctacgatgaagagaccacagacctcctcgcccactggaatgaagcgtatcattttataaacaaagcgaagaggaaccattccaagtgcctggtgcattgcaaaatgggcgtgagtcgctcggcctccacagtcatagcctatgcaatgaaggaattcggctggcctctggaaaaagcatataactatgtaaagcagaagcgcagcatcacgcgccccaacgcgggctttatgaggcagctgtctgagtatgaaggcatcttggatgcaagcaaacagcggcacaacaagctgtggcgtcagcagacagacagcagcctccagcagcctgtggatgaccctgcaggacctggcgacttcttgccagagaccccagatggcaccccggaaagccagctgcccttcttggatgatgccgcccagcccggcttagggccccccctcccctgctgtttccggcgactctcagacccccttctgccttcccctgaggatgaaactggcagcttggtccacctggaggatccggagagggaggctctgttggaggaagctgctccacctgcagaggtgcacaggccggccagacagccccagcaaggttccggactctgtgagaaggatgtgaagaagaaactagagtttgggagtcccaaaggtcggagcggctccttgctgcaggtggaggagacggaaagggaggagggcctgggagcagggaggtgggggcagcttccaacccagctcgatcaaaacctgctcaactcggagaacctaaacaacaacagcaagaggagctgtcccaacggcatggaggtaggcagagcccggcctgcagggtggcacaccccatcccttccatcccactctaattggcctacctcagcctctgtagtagggactacaggcacccgccaccacacccagctgatttttttctattgtctcctctgggcccccagctcccatctccagggacctgagggttctttcacagggtgattctgctggtgggtacgtagtgcataccttatatagcaaattgagaatctgttgggaataacacatatctctgcacaccatcttcaccccatgtaccttattcataccctgggcagggcttccaactcaatttctttttgtgtatgtaaaattaaaacatataatttatcagccaacttca

SEQ ID NO: 182013 - DNA, 9327 bp, Homo sapiens
  Payload ID: 15841
  Gene Symbol: SSH2
  Gene Name: slingshot protein phosphatase 2
  Uniprot ID: Q76I76
  ENST ID: ENST00000269033
  CDS Start-End: 153-4424
gcggagtctgcggccgttcccgcggcctcctcctcctccccgttcccttcacccccaccccgcacccctttccccatcccggctccgtcaccctcccgtcccccacactcaggacaagaatgccctgcccggaacaacccagcagcgcctagatggctttggtcacggtccagcggtcacctacccccagcaccacctccagcccctgcgcctcggaggcagacagtggggaggaagaatgccggtcacagcccaggagcatcagcgagagctttctaactgtcaaaggtgctgccctttttctaccacggggaaatggctcatccacaccaagaatcagccacagacggaacaagcatgcaggcgatctccaacagcatctccaagcaatgttcattttactccgcccagaagacaacatcaggctggctgtaagactggaaagtacttaccagaatcgaacacgctatatggtagtggtttcaactaatggtagacaagacactgaagaaagcatcgtcctaggaatggatttctcctctaatgacagtagcacttgtaccatgggcttagttttgcctctctggagcgacacgctaattcatttggatggtgatggtgggttcagtgtatcgacggataacagagttcacatattcaaacctgtatctgtgcaggcaatgtggtctgcactacagagcttacacaaggcttgtgaagtcgccagagcgcataactactacccaggcagcctatttctcacttgggtgagttattatgagagccatatcaactcagatcaatcctcagtcaatgaatggaatgcaatgcaagatgtacagtcccaccggcccgactctccagctctcttcaccgacatacctactgaacgtgaacgaacagaaaggctaattaaaaccaaattaagggagatcatgatgcagaaggatttggagaatattacatccaaagagataagaacagagttggaaatgcaaatggtgtgcaacttgcgggaattcaaggaatttatagacaatgaaatgatagtgatccttggtcaaatggatagccctacacagatatttgagcatgtgttcctgggctcagaatggaatgcctccaacttagaggacttacagaaccgaggggtacggtatatcttgaatgtcactcgagagatagataacttcttcccaggagtctttgagtatcataacattcgggtatatgatgaagaggcaacggatctcctggcgtactggaatgacacttacaaattcatctctaaagcaaagaaacatggatctaaatgccttgtgcactgcaaaatgggggtgagtcgctcagcctccaccgtgattgcctatgcaatgaaggaatatggctggaatctggaccgagcctatgactatgtgaaagaaagacgaacggtaaccaagcccaacccaagcttcatgagacaactggaagagtatcaggggatcttgctggcaagcaaacagcggcataacaaactatggagatctcattcagatagtgacctctcagaccaccacgaacccatctgcaaacctgggctagaactcaacaagaaggatatcaccacctcagcagaccagattgctgaggtgaagaccatggagagtcacccacccatacctcctgtctttgtggaacatatggtcccacaagatgcaaatcagaaaggcctgtgtaccaaagaaagaatgatctgcttggagtttacttctagggaatttcatgctggacagattgaggatgaattaaacttaaatgacatcaatggatgctcatcagggtgttgtctgaatgaatcaaaatttcctcttgacaattgccatgcatccaaagccttaattcagcctggacatgtcccagaaatggccaacaagtttccagacttaacagtggaagatttggagacagatgcactgaaagcagacatgaatgtccacctactgcctatggaagaattgacatctccactgaaagacccccccatgtcccctgatcctgagtcaccaagcccccaacccagttgccagactgaaatctcagatttcagtacagatcgcattgacttttttagtgccctagagaagtttgtggagctctcccaagaaacccggtcacgatctttttcccattcaaggatggaggaactgggtggaggaaggaatgagagctgtcgactgtcagtggtagaagtagccccttccaaagtgacagctgatgaccagagaagcagctctttgagtaatactccccatgcatcagaagaatcttcaatggatgaggaacagtcaaaggcaatttcagaactggtcagcccagacatcttcatgcagtctcactcggaaaatgcaatttcagtcaaagaaattgtcactgaaattgagtccatcagtcaaggagttgggcagattcaactgaaaggagacatcttacccaacccatgccatacaccaaagaagaacagcatccatgagctgctccttgagagggcccagactccagagaacaaacctggacatatggagcaagatgaggactcctgcacagcccagcctgaactagccaaagactcagggatgtgcaacccagaaggctgcctaaccacacactcatctatagcagacttggaagaaggggaaccagctgagggggaacaagagctccagggctcagggatgcacccaggtgccaagtggtaccctgggtctgtgaggcgagccaccttggagttcgaagagcgcttacggcaggagcaagagcatcatggtgctgccccaacatgtacctcattgtccactcgtaagaattcaaagaatgattcttctgtggcagacctagcaccaaaagggaaaagtgatgaagcccccccagaacattcatttgtcctcaaggaaccagaaatgagcaaaggcaaagggaaatacagtgggtctgaggctggctcactgtcccattctgagcagaatgccactgttccagctcccagggtgctggagtttgaccacttgccagatcctcaggagggcccagggtcagatactggaacacagcaggaaggagtcctgaaggatctgaggactgtgattccataccaggagtctgaaacacaagcagtccctcttccccttcccaagagggtagaaatcattgaatatacccacatagttacatcacccaatcacactgggccagggagtgaaatagccaccagtgagaagagcggagagcaagggctgaggaaagtgaacatggaaaaatctgtcactgtgctctgcacactggatgaaaatctaaacaggactctggaccccaaccaggtttctctgcacccccaagtgctacctctgcctcattcttcctcccctgagcacaacagacccactgaccatccaacctccatcctgagtagccctgaagacagaggcagcagcctgtccacagccctggagacagcagcaccttttgtcagtcatacaacccatttactgtctgccagtttggattacctgcatccccagactatggttcacctggagggcttcacagagcagagcagcactacagatgagccctctgcagaacaggttagctgggaagaaagtcaggagagccctctctccagtggcagtgaggtgccatataaggactcccagctaagtagcgcagacctaagtttaattagcaaacttggtgacaacactggggagttacaggagaaaatggacccattgcctgtagcctgtcgactcccacatagctctagtagtgaaaacataaagagtctcagccacagccccggtgtggtgaaggagcgtgctaaagaaatcgagtctcgagtggttttccaggcagggctcaccaaaccatcccaaatgaggcgctcagcttctctcgccaaattaggttacttggacctctgtaaagactgcttaccagagagggagcctgcctcctgtgaatcccctcatctcaaactgcttcagcctttcctcagaacagactcaggcatgcacgcgatggaggaccaagagtccctagaaaacccaggtgccccccacaacccagagcccaccaagtcttttgtagaacaactcacaacaacagagtgtattgtgcagagcaagccagtggagaggccccttgtgcagtatgccaaagaatttggttctagtcagcagtatttgctccccagggcaggacttgaattgactagttctgaaggaggccttcccgtgctacagacccagggactgcagtgtgcatgcccagctccagggctggccgtggcaccccgtcagcaacacggcagaactcacccccttaggagactgaaaaaggcaaatgacaaaaaacggacaaccaaccccttctataataccatgtgattctgagcctacacatgtgactttctagaagaaatgtttgtaaaaggggcaggtgtaatatgtaaggaacatgcactttattggttaattttataatattttggtcattttactgtttctggtgcatgcagggtttgggtgtttttcagtgtgtatgtgtgtgtatatgtaaggggaaagagagattgatctggatggcaagaccgtttatcattttttatttaaaaaaatcaaacctcaaaaaagtcattttcagagaacacctttatcaaaggcaaattgctgtttttcagtcagctgccacctgcttctcattttgccctctgagaaaaggcatggtttcttaattgagggaaggaagcagattcggaggggtggagataaagctggggattggagatgttcccctgcctttgtgatgatggtttggtttccagacctgaggcatcgaatgggctaaaggtcagccagaagtcagagggctctcagccttcatccagccgcagccctttagagttcctgaaggaggcaggttccgctttgctttaaaagagggtcttccggtgttccagagtgtatcgttacagtaagacatgataatggccggctctgcaaatttatcatatagtttttttcccaagaaaattatttttgaaattaaaacaggaccccaaatgaaatccaagtggtcttctgtagaggaaagcatgataagaggaggaagacataaagttgggggtggagaggctgctgcccagaaactgctgggttggtgggatccacacagatgggcatcttggctctccctgccagaaaaatgtgctctgcagtgtcctcccaactgaaaacaacagtgacatgtttgaaaagcagcaatcgaaagtcagtgtgttcttgtaaaatgaatatgtatgtagggttttaacccttccattacttgaataattctttgggccttctgagtttaatggccatattttcttccagtttattttccttccccatgctgttgtccccatgctgcctatttttttaaatttcatagattatatttgaattgttacatatgtttaacatccattgaatgcaacgttttatttttggtattatcactgttaacacttttttttccttttcctggaaggtttgtcatttctctaaagtttgtacacagtatttatgtacataatattgtcactgtcttagtgtcttgttcatgttgtagggtaattttgatttattctttttaagaaggagtagagttgcaactggaaaacacagacaccagaaatgaaagtgttgggtgttgataggaatctgtacaatatgttgatggtggctgtagttgtttaaatggagacttccaatcaccagctcctgccaaattatgcattagtaactttttcctcagagacacccctaaaggctcccattaggtcacagcgtgactgaaagctgatttctctgtgagactgaaatcccagaacattgtttgccagtatctcaaccacagccaggaagtatatgtgagttgcccagagtggaagctcctagtagaggctgaaggccacaggggaggcctcagccaggggcaagtgcccacagtgactccatttaggatgctgtcgttttgctactgttgtggagatccttaacgcagcagcgcctgtcataaacaagcctcttgtagcttcttacagaaaacagatttagtctagcatgaaacacctctgcatctcattgaaactgaagaggcttgcagatttgctttcgttgatgtccacgttactgaggattgactgagtatagactggagacaggtttttggcttatcacagcactgaggaaaatacaaatgcacagactgtcagcatgatgtcagaggccagagtttggtgggggcagatggcagggcgacccaaaagatgcagaaaaggtagactggggccactgggtcttaagaggagctgtgaagttgtgtggaagccaaggctgggtctgacatccctgccaggaagcaggttggacagaaaccacttgctaaaagcgtctctatggtgcagtgattatgtgtaccctgtgctgttgctcagtagtctccttgaatgttcaagtatctcatccactcagttttgtgattcctggatatttgtgtgttgtaaagtgttttgttaggtggtatgaaccaatgtgaggaggcttgagacagggttatggatttccagagctcttccatgtagaataccctgccttcttgaagcagttccaccaccaatatgatggggaagggcaggaacttatggcagggtggggagagggtttgcctggaagttaagagagtggcatccacttgtggtaaccccttacgatgatgacatcccacacactaagaggtacaagcaggaccaaagttttggactgttccctcttctcccctccactgtgtttaatgttcactcactgcattaaataacaacaaagatgggacaaaacccactaatactgtggggaaaaaaaattttcaagagcagaggaaagtctttctgcctttttataattactttttttatcatttaatttacctgcctaaataaacatcttctacagaatatctgtcattcaaccatgccaaggagtttgtgccagccttttcagactcccagaattgggtgttcctgggttatttacatagctgagcagtgtccaggggaggtgcgcagtgaactgtcaaggactttccagactgtcttctcttcagacttttataatctccagtggcatctttcccttttcttttgttcatgacctgacctgaagcagcagatttgatagactggcaaagatgaataggaaaaactttgactcttgcccagtgcctgcctgcctctctctctctcctctctctctctctctttttaaaccaccatagactctcacttattttggaggagtgtatgtgcatgtgtacacatatgtacatatataaaaacagttgatgttttggtgtatggggtaaaagccccaggagcatacagaacttgagctgaacctggtcagtagaaagggaaaccccaaccctttcttgatttttggagacacccaggactaatggatactgtagtagacatgtagtactatagtaccgtaatattcatctctcctcattttagttgcctttcagattctaaatgtttgggatcattcctatcatcttagtctcttcaggatctttagtattttcctggttctgaggaggcttgagacagggttatggatttccttgttctgtgtctttatccctactgatagttcctctttctcattttgcaaactacccagagctccaaggacagcctgaagatctcagtgcctcaggctctgaggtactctgctcacaggccccagacagatgctgttgggtaaactcaaagcttcctatgagaagcttctgagatgtagcaggtcacagaagtgttcacctgtttcatctgaggatttcagttctgaagtgatctaggcatgtttggtaaaaatgtttttgtgagagttctttttttaagaaagcattatgcaaaaagtcacttttaagggcatttaaaaatttttaagtaaagccattctttggcttttttggactatttgtggatactttgtttacattttgaatattaaaatgtgcatcatcttgtcggccatgcagtcctgcaggcatcagtgccctggctgtcctgtgagtcctcatgcagagcagggccatcatggtcagcccttgtgagtaagtgggtatacgctgaagctgacttccgtctgtgtcctgccctcccatccagcactctctatggaaatagttgtcatttcctcagtgatggtgtgtcttatagtgatggttgtaatggtgaatggctagtgtcattttgtttaattttgttttgctttttgatggtggataagatgaaattttagctgtttcagcatcaatccaacttaaaagcatcttggactttgttttcccttccaaactaaaagatcaaggcatgtattagacacaagcatatttgctgcctcaactcctctgacacccatattaggaaaaggcctgccaccaaagcaggaagctgcacactcctaacccttctcccagggtgtggggtcccttgacgtcatgaagagctattgcaaggtgcttctgtacttttccagcctggaaatggagggtgactggccctggctcctgctatgagaagataaccagcctcattttctcagtgccccagaggtctaggataggatttctaaactggaatcatccttaatcaccttgaagatcccttaagaggcatttgactggtgctgccgtctgtgtcctcaaagcaatgctggtggcagcgtcctgtgtacacatgcagagctaatacccaaactaaaaactgggtaactggccctgaagtgcttcccaatcagtaagcccacagggaaatgtttgatttttatgttctgttggattttggtttgcttggcatatctaaaggtgcctttacttttctttttttttttttttctttctgctttgttttgtaggacttgttctaacatggaaaacaagtccagaagactctcctctgactgttacctttgccccaagccaccccaaacttttatgctcatgttttattaaagcaggtgctccctggaatctctgggacatttttgaggcatttgaagcagaatatagagtggtctcatctccttccttaatcttcctggtggttgggatgttccacttgtatcatagatttttttattacagatatgctccactgtttttaaatgtgaacttgtgcgcaaatgtgcagattcaatgttcttgttacagattgaataaatttttattttgaagatgaaa

SEQ ID NO: 182014 - DNA, 4538 bp, Homo sapiens
  Payload ID: 15841
  Gene Symbol: SSH2
  Gene Name: slingshot protein phosphatase 2
  ENST ID: ENST00000540801
  CDS Start-End: 94-4446
ccgcacccctttccccatcccggctccgtcaccctcccgtcccccacactcaggacaagaatgccctgcccggaacaacccagcagcgcctagatggctttggtcacggtccagcggtcacctacccccagcaccacctccagcccctgcgcctcgagctctcatttggaagacagtgaatcagcagcattactttgctgtgaatgtgaagaatcagaaatctttactgattccaatgaggcagacagtggggaggaagaatgccggtcacagcccaggagcatcagcgagagctttctaactgtcaaaggtgctgccctttttctaccacggggaaatggctcatccacaccaagaatcagccacagacggaacaagcatgcaggcgatctccaacagcatctccaagcaatgttcattttactccgcccagaagacaacatcaggctggctgtaagactggaaagtacttaccagaatcgaacacgctatatggtagtggtttcaactaatggtagacaagacactgaagaaagcatcgtcctaggaatggatttctcctctaatgacagtagcacttgtaccatgggcttagttttgcctctctggagcgacacgctaattcatttggatggtgatggtgggttcagtgtatcgacggataacagagttcacatattcaaacctgtatctgtgcaggcaatgtggtctgcactacagagcttacacaaggcttgtgaagtcgccagagcgcataactactacccaggcagcctatttctcacttgggtgagttattatgagagccatatcaactcagatcaatcctcagtcaatgaatggaatgcaatgcaagatgtacagtcccaccggcccgactctccagctctcttcaccgacatacctactgaacgtgaacgaacagaaaggctaattaaaaccaaattaagggagatcatgatgcagaaggatttggagaatattacatccaaagagataagaacagagttggaaatgcaaatggtgtgcaacttgcgggaattcaaggaatttatagacaatgaaatgatagtgatccttggtcaaatggatagccctacacagatatttgagcatgtgttcctgggctcagaatggaatgcctccaacttagaggacttacagaaccgaggggtacggtatatcttgaatgtcactcgagagatagataacttcttcccaggagtctttgagtatcataacattcgggtatatgatgaagaggcaacggatctcctggcgtactggaatgacacttacaaattcatctctaaagcaaagaaacatggatctaaatgccttgtgcactgcaaaatgggggtgagtcgctcagcctccaccgtgattgcctatgcaatgaaggaatatggctggaatctggaccgagcctatgactatgtgaaagaaagacgaacggtaaccaagcccaacccaagcttcatgagacaactggaagagtatcaggggatcttgctggcaagcaaacagcggcataacaaactatggagatctcattcagatagtgacctctcagaccaccacgaacccatctgcaaacctgggctagaactcaacaagaaggatatcaccacctcagcagaccagattgctgaggtgaagaccatggagagtcacccacccatacctcctgtctttgtggaacatatggtcccacaagatgcaaatcagaaaggcctgtgtaccaaagaaagaatgatctgcttggagtttacttctagggaatttcatgctggacagattgaggatgaattaaacttaaatgacatcaatggatgctcatcagggtgttgtctgaatgaatcaaaatttcctcttgacaattgccatgcatccaaagccttaattcagcctggacatgtcccagaaatggccaacaagtttccagacttaacagtggaagatttggagacagatgcactgaaagcagacatgaatgtccacctactgcctatggaagaattgacatctccactgaaagacccccccatgtcccctgatcctgagtcaccaagcccccaacccagttgccagactgaaatctcagatttcagtacagatcgcattgacttttttagtgccctagagaagtttgtggagctctcccaagaaacccggtcacgatctttttcccattcaaggatggaggaactgggtggaggaaggaatgagagctgtcgactgtcagtggtagaagtagccccttccaaagtgacagctgatgaccagagaagcagctctttgagtaatactccccatgcatcagaagaatcttcaatggatgaggaacagtcaaaggcaatttcagaactggtcagcccagacatcttcatgcagtctcactcggaaaatgcaatttcagtcaaagaaattgtcactgaaattgagtccatcagtcaaggagttgggcagattcaactgaaaggagacatcttacccaacccatgccatacaccaaagaagaacagcatccatgagctgctccttgagagggcccagactccagagaacaaacctggacatatggagcaagatgaggactcctgcacagcccagcctgaactagccaaagactcagggatgtgcaacccagaaggctgcctaaccacacactcatctatagcagacttggaagaaggggaaccagctgagggggaacaagagctccagggctcagggatgcacccaggtgccaagtggtaccctgggtctgtgaggcgagccaccttggagttcgaagagcgcttacggcaggagcaagagcatcatggtgctgccccaacatgtacctcattgtccactcgtaagaattcaaagaatgattcttctgtggcagacctagcaccaaaagggaaaagtgatgaagcccccccagaacattcatttgtcctcaaggaaccagaaatgagcaaaggcaaagggaaatacagtgggtctgaggctggctcactgtcccattctgagcagaatgccactgttccagctcccagggtgctggagtttgaccacttgccagatcctcaggagggcccagggtcagatactggaacacagcaggaaggagtcctgaaggatctgaggactgtgattccataccaggagtctgaaacacaagcagtccctcttccccttcccaagagggtagaaatcattgaatatacccacatagttacatcacccaatcacactgggccagggagtgaaatagccaccagtgagaagagcggagagcaagggctgaggaaagtgaacatggaaaaatctgtcactgtgctctgcacactggatgaaaatctaaacaggactctggaccccaaccaggtttctctgcacccccaagtgctacctctgcctcattcttcctcccctgagcacaacagacccactgaccatccaacctccatcctgagtagccctgaagacagaggcagcagcctgtccacagccctggagacagcagcaccttttgtcagtcatacaacccatttactgtctgccagtttggattacctgcatccccagactatggttcacctggagggcttcacagagcagagcagcactacagatgagccctctgcagaacaggttagctgggaagaaagtcaggagagccctctctccagtggcagtgaggtgccatataaggactcccagctaagtagcgcagacctaagtttaattagcaaacttggtgacaacactggggagttacaggagaaaatggacccattgcctgtagcctgtcgactcccacatagctctagtagtgaaaacataaagagtctcagccacagccccggtgtggtgaaggagcgtgctaaagaaatcgagtctcgagtggttttccaggcagggctcaccaaaccatcccaaatgaggcgctcagcttctctcgccaaattaggttacttggacctctgtaaagactgcttaccagagagggagcctgcctcctgtgaatcccctcatctcaaactgcttcagcctttcctcagaacagactcaggcatgcacgcgatggaggaccaagagtccctagaaaacccaggtgccccccacaacccagagcccaccaagtcttttgtagaacaactcacaacaacagagtgtattgtgcagagcaagccagtggagaggccccttgtgcagtatgccaaagaatttggttctagtcagcagtatttgctccccagggcaggacttgaattgactagttctgaaggaggccttcccgtgctacagacccagggactgcagtgtgcatgcccagctccagggctggccgtggcaccccgtcagcaacacggcagaactcacccccttaggagactgaaaaaggcaaatgacaaaaaacggacaaccaaccccttctataataccatgtgattctgagcctacacatgtgactttctagaagaaatgtttgtaaaaggggcaggtgtaatatgtaaggaacatgcactttattggttaatttt

SEQ ID NO: 182015 - DNA, 560 bp, Homo sapiens
  Payload ID: 15841
  Gene Symbol: SSH2
  Gene Name: slingshot protein phosphatase 2
  ENST ID: ENST00000582084
  CDS Start-End: 159-305
ggggagaggcggtagctgacaggtggcgcctgcgcactgggagcgctcattgtgccccgcagctgcggaaccgcccgcccgccgcccgttcggagcgtcagtcggcgacagtctggtggacaagaatgccctgcccggaacaacccagcagcgcctagatggctttggtcacggtccagcggtcacctacccccagcaccacctccagcccctgcgcctcgagatggggacttgcttggggtcttgctgcccaggctggtcttgaactcgtggcgtcaagggatcctcctgtctcagcctcctaaagaattgggattatagtcatgagccactgtgaccggctacaattttcaagtctacaatatattattattgactgtagaaaccatattgtacaatagctcttcataacttactcctcctgtctaatggaaactttgtaccctttgaccatcatctcctccccattctcccaccaatccccaatctggtgtgaattttctgaattgatacctatattgatccagggttaaataaacaaagtataatactataataat

SEQ ID NO: 182016 - DNA, 965 bp, Homo sapiens
  Payload ID: 15841
  Gene Symbol: SSH2
  Gene Name: slingshot protein phosphatase 2
  ENST ID: ENST00000579040
  CDS Start-End: 174-511
ggcgacagtctggtggtgggtgcggagtctgcggccgttcccgcggcctcctcctcctccccgttcccttcacccccaccccgcacccctttccccatcccggctccgtcaccctcccgtcccccacactcaggacaagaatgccctgcccggaacaacccagcagcgcctagatggctttggtcacggtccagcggtcacctacccccagcaccacctccagcccctgcgcctcggaggcagacagtggggaggaagaatgccggtcacagcccaggagcatcagcgagagctttctaactgtcaaaggtgctgccctttttctaccacggggaaatggctcatccacaccaagaatcagccacagacggaacaagcatgcaggcgatctccaacagcatctccaagcaatgttcattttactccgcccagaagacaacatcaggctggctgtaagactggaaagtacttaccagaatcgaacacgctatatggtagtggtttcaactaatggtagacaagacactgaagaaagcatcgtcctaggaatggatttctcctctaatgacagtagcacttgtaccatgggcttagttttgcctctctggagcgacacgctaattcatttggatggtgatggtgggttcagtgtatcgacggataacagagttcacatattcaaacctgtatctgtgcaggcaatgtgggttgacagggattcaaggaacaaacactgtgatgtactattggtggaagaatgaactggagcagcctttctggagagtgatttgccaatatgccttatcattttgcatgatctttgtcctagtaactctatttctatggatttactctaagtttgtaaacatggatgtgtgcaaagattttagctctaagaatgtttgtcagtgttctaataatagcaaaaaataaaaaacaaatgattgaaaaatagaattagtaaa

SEQ ID NO: 182017 - DNA, 493 bp, Homo sapiens
  Payload ID: 15841
  Gene Symbol: SSH2
  Gene Name: slingshot protein phosphatase 2
  ENST ID: ENST00000577991
  CDS Start-End: 1-350
gtcgactcccacatagctctagtagtgaaaacataaagagtctcagccacagccccggtgtggtgaaggagcgtgctaaagaaatcgagtctcgagtggttttccaggcagggctcaccaaaccatcccaaatgaggcgctcagcttctctcgccaaattaggttacttggacctctgtaaagactgcttaccagagagggagcctgcctcctgtgaatcccctcatctcaaactgcttcagcctttcctcagaacagactcaggcatgcacgcgatggaggaccaagagtccctagaaaacccaggtgtaatatgtaaggaacatgcactttattggttaattttataatattttggtcattttactgtttctggtgcatgcagggtttgggtgtttttcagtgtgtatgtgtgtgtatatgtaaggggaaagagagattgatctggatggcaagaccgtttatcattttttatttaaaaaaatcaaacctc

SEQ ID NO: 182018 - DNA, 570 bp, Homo sapiens
  Payload ID: 15841
  Gene Symbol: SSH2
  Gene Name: slingshot protein phosphatase 2
  ENST ID: ENST00000590153
  CDS Start-End: 229-375
attgtgccccgcagctgcggaaccgcccgcccgccgcccgttcggagcgtcagtcggcgacagtctggtggtgggtgcggagtctgcggccgttcccgcggcctcctcctcctccccgttcccttcacccccaccccgcacccctttccccatcccggctccgtcaccctcccgtcccccacactcaggacaagaatgccctgcccggaacaacccagcagcgcctagatggctttggtcacggtccagcggtcacctacccccagcaccacctccagcccctgcgcctcgagatggggacttgcttggggtcttgctgcccaggctggtcttgaactcgtggcgtcaagggatcctcctgtctcagcctcctaaagaattgggattatagtcatgagccactgtgaccggctacaattttcaagtctacaatatattattattgactgtagaaaccatattgtacaatagctcttcataacttactcctcctgtctaatggaaactttgtaccctttgaccatcatctcctccccattctcccaccaatccccaatctggtgtgaattt

SEQ ID NO: 182019 - DNA, 574 bp, Homo sapiens
  Payload ID: 15841
  Gene Symbol: SSH2
  Gene Name: slingshot protein phosphatase 2
  ENST ID: ENST00000592397
  CDS Start-End: 214-574
atggtgatggaagcctggcataccataagcagccagcttccacggctgacactggggaacgtgatggctcctggaagcttagagatgccaggaaccacagatccctaaagagggtgtcacaaccctggctcattgagctcctaggtctgggttccccaaagggccacagctcttctctccttattgtcttctttccctattgtcgcctgcaacatggaggcagacagtggggaggaagaatgccggtcacagcccaggagcatcagcgagagctttctaactgtcaaaggtgctgccctttttctaccacggggaaatggctcatccacaccaagaatcagccacagacggaacaagcatgcaggcgatctccaacagcatctccaagcaatgttcattttactccgcccagaagacaacatcaggctggctgtaagactggaaagtacttaccagaatcgaacacgctatatggtagtggtttcaactaatggtagacaagacactgaagaaagcatcgtcctaggaatggatttctcctctaatgacagtagcacttgtaccatgggcttag

SEQ ID NO: 182020 - DNA, 428 bp, Homo sapiens
  Payload ID: 15841
  Gene Symbol: SSH2
  Gene Name: slingshot protein phosphatase 2
  ENST ID: ENST00000579954
  CDS Start-End: 63-191
ccctcccgtcccccacactcaggacaagaatgccctgcccggaacaacccagcagcgcctagatggctttggtcacggtccagcggtcacctacccccagcaccacctccagcccctgcgcctcgagagcagaactgggattcttggttcagggaggcagatttccagtgattgtaaggaagaatttgtaacagtggagtgcactgccttgcaaaatagtgagtgcacattgctggaaatattcaagcaaaggctggagaacattttgcctgggaggtggtataaagaattcctgcagtgggggacttctaagactatttctaatctaagattttgtgatttgagaatacttgtacttcaaagctggtaaaacattttagggtcatctgaagacaagtatcataggaataaatctttaatataattta

SEQ ID NO: 182021 - DNA, 2046 bp, Homo sapiens
  Payload ID: 15842
  Gene Symbol: SSH3
  Gene Name: slingshot protein phosphatase 3
  ENST ID: ENST00000308298
  CDS Start-End: 147-1331
ctggccctttaagggccgcccccgaggaggtgccaggcccgggtggcgccgtccgtccttcctggtcctgcgggtccaggactgtccgcggggttgagggaaggggccgtgcccggtgccagcccaggtgctcgcggcctggctccatggccctggtcacagtgagccgttcgcccccgggcagcggcgcctccacgcccgtggggccctgggaccaggcggtccagcgaaggagtcgactccagcgaaggcagagctttgcggtgctccgtggggctgtcctgggactgcaggatggaggggacaatgatgatgcagcagaggccagttctgagccaacagagaaggccccgagtgaggaggagctccacggggaccagacagacttcgggcaaggatcccagagtccccagaagcaggaggagcagaggcagcacctgcacctcatggtacagctgctgaggccgcaggatgacatccgcctggcagcccagctggaggcaccccggcctccccggctccgctacctgctggtagtttctacacgagaaggagaaggtctgagccaggatgagacggtcctcctgggcgtggatttccctgacagcagctcccccagctgcaccctgggcctggtcttgcccctctggagtgacacccaggtgtacttagatggagacgggggcttcagcgtgacgtctggtgggcaaagccggatcttcaagcccatctccatccagaccatgtgggccacactccaggtattgcaccaagcatgtgaggcagctctaggcagcggccttgtaccgggtggcagtgccctcacctgggccagccactaccaggagagactgaactccgaacagagctgcctcaatgagtggacggctatggccgacctggagtctctgcggcctcccagcgccgagcctggcgggtcctcagaacaggagcagatggagcaggcgatccgtgctgagctgtggaaagtgttggatctggagagcacctcagagaccagtgacatgccagaggtcttctcttcccacgagtcttcacatgaagagcctctgcagcccttcccacagcttgcaaggaccaagggaggccagcaggtggacagggggcctcagcctgccctgaagtcccgccagtcagtggttaccctccagggcagtgccgtggtggccaaccggacccaggccttccaggagcaggagcaggggcaggggcaggggcagggagagccctgcatttcctctacgcccaggttccggaaggtggtgagacaggccagcgtgcatgacagtggagaggagggcgaggcctgagccctcacacatgcccacgctcccctgacactgaagaggatccacaactccttggagaaacaccctcacgtctgttgccgcacacattcctctcagctccgccccatacccgtcactacagcctcacctcccacccctgtcactacggcctcacctcccacccctgtcactacagcctcacctcctacagccttaagtcccaggcccatgtctgcctgtccaagggctcaagactttctaactgggatgtggtagagggactgaaggtacctttgggggcaacagcaccctagtttcattctcaactctagccctgcacactcacctgtggcacggaatgaaaacagagcttcccgtgcaaaaagggtcacgcctcccacccccgccccctccctgcacctcctgtcctctcccagttcattcctggaaccagccaggccaggcaaccagtggcccccaaaggcaggcaggatcctcaggccccagccgcgggaggctggaagggctggcagatcgcttccctcatccacctccaccggtccaggtctttgctgctgtccccagacctcctgtgacaccacgccagatcacagggcaccaggccagagatagtcttctttttgtcctttctggcctctggctagtcagtttttcatagccttacagtatctggctttgtactgagaaataaaacacattttcatatttggttatt

SEQ ID NO: 182022 - DNA, 2871 bp, Homo sapiens
  Payload ID: 15842
  Gene Symbol: SSH3
  Gene Name: slingshot protein phosphatase 3
  Uniprot ID: Q8TE77
  ENST ID: ENST00000308127
  CDS Start-End: 179-2158
gagaagctccgcgggcccggctgggcgagtgtctggccctttaagggccgcccccgaggaggtgccaggcccgggtggcgccgtccgtccttcctggtcctgcgggtccaggactgtccgcggggttgagggaaggggccgtgcccggtgccagcccaggtgctcgcggcctggctccatggccctggtcacagtgagccgttcgcccccgggcagcggcgcctccacgcccgtggggccctgggaccaggcggtccagcgaaggagtcgactccagcgaaggcagagctttgcggtgctccgtggggctgtcctgggactgcaggatggaggggacaatgatgatgcagcagaggccagttctgagccaacagagaaggccccgagtgaggaggagctccacggggaccagacagacttcgggcaaggatcccagagtccccagaagcaggaggagcagaggcagcacctgcacctcatggtacagctgctgaggccgcaggatgacatccgcctggcagcccagctggaggcaccccggcctccccggctccgctacctgctggtagtttctacacgagaaggagaaggtctgagccaggatgagacggtcctcctgggcgtggatttccctgacagcagctcccccagctgcaccctgggcctggtcttgcccctctggagtgacacccaggtgtacttagatggagacgggggcttcagcgtgacgtctggtgggcaaagccggatcttcaagcccatctccatccagaccatgtgggccacactccaggtattgcaccaagcatgtgaggcagctctaggcagcggccttgtaccgggtggcagtgccctcacctgggccagccactaccaggagagactgaactccgaacagagctgcctcaatgagtggacggctatggccgacctggagtctctgcggcctcccagcgccgagcctggcgggtcctcagaacaggagcagatggagcaggcgatccgtgctgagctgtggaaagtgttggatgtcagtgacctggagagtgtcacttccaaagagatccgccaggctctggagctgcgcctggggctccccctccagcagtaccgtgacttcatcgacaaccagatgctgctgctggtggcacagcgggaccgagcctcccgcatcttcccccacctctacctgggctcagagtggaacgcagcaaacctggaggagctgcagaggaacagggtcacccacatcttgaacatggcccgggagattgacaacttctaccctgagcgcttcacctaccacaatgtgcgcctctgggatgaggagtcggcccagctgctgccgcactggaaggagacgcaccgcttcattgaggctgcaagagcacagggcacccacgtgctggtccactgcaagatgggcgtcagccgctcagcggccacagtgctggcctatgccatgaagcagtacgaatgcagcctggagcaggccctgcgccacgtgcaggagctccggcccatcgcccgccccaaccctggcttcctgcgccagctgcagatctaccagggcatcctgacggccagccgccagagccatgtctgggagcagaaagtgggtggggtctccccagaggagcacccagcccctgaagtctctacaccattcccacctcttccgccagaacctgagggtggtggggaggagaaggttgtaggcatggaagagagccaggcagccccgaaagaagagcctgggccacggccacgtataaacctccgaggggtcatgaggtccatcagtcttctggagccctccttggagctggagagcacctcagagaccagtgacatgccagaggtcttctcttcccacgagtcttcacatgaagagcctctgcagcccttcccacagcttgcaaggaccaagggaggccagcaggtggacagggggcctcagcctgccctgaagtcccgccagtcagtggttaccctccagggcagtgccgtggtggccaaccggacccaggccttccaggagcaggagcaggggcaggggcaggggcagggagagccctgcatttcctctacgcccaggttccggaaggtggtgagacaggccagcgtgcatgacagtggagaggagggcgaggcctgagccctcacacatgcccacgctcccctgacactgaagaggatccacaactccttggagaaacaccctcacgtctgttgccgcacacattcctctcagctccgccccatacccgtcactacagcctcacctcccacccctgtcactacggcctcacctcccacccctgtcactacagcctcacctcctacagccttaagtcccaggcccatgtctgcctgtccaagggctcaagactttctaactgggatgtggtagagggactgaaggtacctttgggggcaacagcaccctagtttcattctcaactctagccctgcacactcacctgtggcacggaatgaaaacagagcttcccgtgcaaaaagggtcacgcctcccacccccgccccctccctgcacctcctgtcctctcccagttcattcctggaaccagccaggccaggcaaccagtggcccccaaaggcaggcaggatcctcaggccccagccgcgggaggctggaagggctggcagatcgcttccctcatccacctccaccggtccaggtctttgctgctgtccccagacctcctgtgacaccacgccagatcacagggcaccaggccagagatagtcttctttttgtcctttctggcctctggctagtcagtttttcatagccttacagtatctggctttgtactgagaaataaaacacattttcatatttggtta

SEQ ID NO: 182023 - DNA, 2990 bp, Homo sapiens
  Payload ID: 15842
  Gene Symbol: SSH3
  Gene Name: slingshot protein phosphatase 3
  Uniprot ID: Q8TE77
  ENST ID: ENST00000376757
  CDS Start-End: 731-2272
gtctggccctttaagggccgcccccgaggaggtgccaggcccgggtggcgccgtccgtccttcctggtcctgcgggtccaggactgtccgcggggttgagggaaggggccgtgcccggtgccagcccaggtgctcgcggcctggctccatggccctggtcacagtgagccgttcgcccccgggcagcggcgcctccacgcccgtggggccctggaattcctgagagaggggaggggacagccctccccgccctcaccctgccctggggctgctctctccgcaggaccaggcggtccagcgaaggagtcgactccagcgaagagctttgcggtgctccgtggggctgtcctgggactgcaggatggaggggacaatgatgatgcagcagaggccagttctgagccaacagagaaggccccgagtgaggaggagctccacggggaccagacagacttcgggcaaggatcccagagtccccagaagcaggaggagcagaggcagcacctgcacctcatggtacagctgctgaggccgcaggatgacatccgcctggcagcccagctggaggcaccccggcctccccggctccgctacctgctggtagtttctacacgagaaggagaaggtctgagccaggatgagacggtcctcctgggcgtggatttccctgacagcaggttcgagcagggagaggaaaggaggggcaaagaggtgagggacaggggggacaatggctttccctctgtcccctgccagctcccccagctgcaccctgggcctggtcttgcccctctggagtgacacccaggtgtacttagatggagacgggggcttcagcgtgacgtctggtgggcaaagccggatcttcaagcccatctccatccagaccatgtgggccacactccaggtattgcaccaagcatgtgaggcagctctaggcagcggccttgtaccgggtggcagtgccctcacctgggccagccactaccaggagagactgaactccgaacagagctgcctcaatgagtggacggctatggccgacctggagtctctgcggcctcccagcgccgagcctggcgggtcctcagaacaggagcagatggagcaggcgatccgtgctgagctgtggaaagtgttggatgtcagtgacctggagagtgtcacttccaaagagatccgccaggctctggagctgcgcctggggctccccctccagcagtaccgtgacttcatcgacaaccagatgctgctgctggtggcacagcgggaccgagcctcccgcatcttcccccacctctacctgggctcagagtggaacgcagcaaacctggaggagctgcagaggaacagggtcacccacatcttgaacatggcccgggagattgacaacttctaccctgagcgcttcacctaccacaatgtgcgcctctgggatgaggagtcggcccagctgctgccgcactggaaggagacgcaccgcttcattgaggctgcaagagcacagggcacccacgtgctggtccactgcaagatgggcgtcagccgctcagcggccacagtgctggcctatgccatgaagcagtacgaatgcagcctggagcaggccctgcgccacgtgcaggagctccggcccatcgcccgccccaaccctggcttcctgcgccagctgcagatctaccagggcatcctgacggccagccgccagagccatgtctgggagcagaaagtgggtggggtctccccagaggagcacccagcccctgaagtctctacaccattcccacctcttccgccagaacctgagggtggtggggaggagaaggttgtaggcatggaagagagccaggcagccccgaaagaagagcctgggccacggccacgtataaacctccgaggggtcatgaggtccatcagtcttctggagccctccttggagctggagagcacctcagagaccagtgacatgccagaggtcttctcttcccacgagtcttcacatgaagagcctctgcagcccttcccacagcttgcaaggaccaagggaggccagcaggtggacagggggcctcagcctgccctgaagtcccgccagtcagtggttaccctccagggcagtgccgtggtggccaaccggacccaggccttccaggagcaggagcaggggcaggggcaggggcagggagagccctgcatttcctctacgcccaggttccggaaggtggtgagacaggccagcgtgcatgacagtggagaggagggcgaggcctgagccctcacacatgcccacgctcccctgacactgaagaggatccacaactccttggagaaacaccctcacgtctgttgccgcacacattcctctcagctccgccccatacccgtcactacagcctcacctcccacccctgtcactacggcctcacctcccacccctgtcactacagcctcacctcctacagccttaagtcccaggcccatgtctgcctgtccaagggctcaagactttctaactgggatgtggtagagggactgaaggtacctttgggggcaacagcaccctagtttcattctcaactctagccctgcacactcacctgtggcacggaatgaaaacagagcttcccgtgcaaaaagggtcacgcctcccacccccgccccctccctgcacctcctgtcctctcccagttcattcctggaaccagccaggccaggcaaccagtggcccccaaaggcaggcaggatcctcaggccccagccgcgggaggctggaagggctggcagatcgcttccctcatccacctccaccggtccaggtctttgctgctgtccccagacctcctgtgacaccacgccagatcacagggcaccaggccagagatagtcttctttttgtcctttctggcctctggctagtcagtttttcatagccttacagtatctggctttgtactgagaaataaaacacattttcatatttggttattttc

SEQ ID NO: 182024 - DNA, 2587 bp, Homo sapiens
  Payload ID: 15842
  Gene Symbol: SSH3
  Gene Name: slingshot protein phosphatase 3
  Uniprot ID: Q8TE77
  ENST ID: ENST00000532881
  CDS Start-End: 1-1416
atggccctggtcacagtgagccgttcgcccccgggcagcggcgcctccacgcccgtggggccctgggaccaggcggtccagcgaaggagtcgactccagcgaaggcagagctttgcggtgctccgtggggctgtcctgggactgcaggatggaggggacaatgatgatgcagcagaggccagttctgagccaacagagaaggccccgagtgaggaggagctccacggggaccagacagacttcgggcaaggatcccagagtccccagaagcaggaggagcagaggcagcacctgcacctcatggtacagctgctgaggccgcaggatgacatccgcctggcagcccagctggaggcaccccggcctccccggctccgctacctgctggtagtttctacacgagaaggagaaggtctgagccaggatgagacggtcctcctgggcgtggatttccctgacagcagctcccccagctgcaccctgggcctggtcttgcccctctggagtgacacccaggtgtacttagatggagacgggggcttcagcgtgacgtctggtgggcaaagccggatcttcaagcccatctccatccagaccatgtgggccacactccaggtattgcaccaagcatgtgaggcagctctaggcagcggccttgtaccgggtggcagtgccctcacctgggccagccactaccaggagagactgaactccgaacagagctgcctcaatgagtggacggctatggccgacctggagtctctgcggcctcccagcgccgagcctggcgggtcctcagaacaggagcagatggagcaggcgatccgtgctgagctgtggaaagtgttggatgtcagtgacctggagagtgtcacttccaaagagatccgccaggctctggagctgcgcctggggctccccctccagcagtaccgtgacttcatcgacaaccagatgctgctgctggtggcacagcgggaccgagcctcccgcatcttcccccacctctacctgggctcagagtggaacgcagcaaacctggaggagctgcagaggaacagggtcacccacatcttgaacatggcccgggagattgacaacttctaccctgagcgcttcacctaccacaatgtgcgcctctgggatgaggagtcggcccagctgctgccgcactggaaggagacgcaccgcttcattgaggctgcaagagcacagggcacccacgtgctggtccactgcaagatgggcgtcagccgctcagcggccacagtgctggcctatgccatgaagcagtacgaatgcagcctggagcaggccctgcgccacgtgcaggagctccggcccatcgcccgccccaaccctggcttcctgcgccagctgcagatctaccagggcatcctgacggccagaacctgagggtggtggggaggagaaggttgtaggcatggaagagagccaggcagccccgaaagaagagcctgggccacggccacgtataaacctccgaggggtcatgaggtccatcagtcttctggagccctccttggagctggagagcacctcagagaccagtgacatgccagaggtcttctcttcccacgagtcttcacatgaagagcctctgcagcccttcccacagcttgcaaggaccaagggaggccagcaggtggacagggggcctcagcctgccctgaagtcccgccagtcagtggttaccctccagggcagtgccgtggtggccaaccggacccaggccttccaggagcaggagcaggggcaggggcaggggcagggagagccctgcatttcctctacgcccaggttccggaaggtggtgagacaggccagcgtgcatgacagtggagaggagggcgaggcctgagccctcacacatgcccacgctcccctgacactgaagaggatccacaactccttggagaaacaccctcacgtctgttgccgcacacattcctctcagctccgccccatacccgtcactacagcctcacctcccacccctgtcactacggcctcacctcccacccctgtcactacagcctcacctcctacagccttaagtcccaggcccatgtctgcctgtccaagggctcaagactttctaactgggatgtggtagagggactgaaggtacctttgggggcaacagcaccctagtttcattctcaactctagccctgcacactcacctgtggcacggaatgaaaacagagcttcccgtgcaaaaagggtcacgcctcccacccccgccccctccctgcacctcctgtcctctcccagttcattcctggaaccagccaggccaggcaaccagtggcccccaaaggcaggcaggatcctcaggccccagccgcgggaggctggaagggctggcagatcgcttccctcatccacctccaccggtccaggtctttgctgctgtccccagacctcctgtgacaccacgccagatcacagggcaccaggccagagatagtcttctttttgtcctttctggcctctggctagtcagtttttcatagccttacagtatctggctttgtactgagaaataaaacacattttcata

SEQ ID NO: 182025 - DNA, 555 bp, Homo sapiens
  Payload ID: 15842
  Gene Symbol: SSH3
  Gene Name: slingshot protein phosphatase 3
  ENST ID: ENST00000532600
  CDS Start-End: 97-222
gtccgtccttcctggtcctgcgggtccaggactgtccgcggggttgagggaaggggccgtgcccggtgccagcccaggtgctcgcggcctggctccatggccctggtcacagtgagccgttcgcccccgggcagcggcgcctccacgcccgtggggccctgggcagagctttgcggtgctccgtggggctgtcctgggactgcaggatggaggggacaatgatgatgcagcagaggccagttctgagccaacagagaaggccccgagtgaggaggagctccacggggaccagacagacttcgggcaaggatcccagagtccccagaagcaggaggagcagaggcagcacctgcacctcatggtacagctgctgaggccgcaggatgacatccgcctggcagcccagctggaggcaccccggcctccccggctccgctacctgctggtagtttctacacgagaaggagaaggtctgagccaggatgagacggtcctcctgggcgtggatttccctgacagcagctcccccagctgcaccctgggcctggtcttgcc

SEQ ID NO: 182026 - DNA, 656 bp, Homo sapiens
  Payload ID: 15842
  Gene Symbol: SSH3
  Gene Name: slingshot protein phosphatase 3
  ENST ID: ENST00000527821
  CDS Start-End: 1-656
ctccgaacagagctgcctcaatgagtggacggctatggccgacctggagtctctgcggcctcccagcgccgagcctggcgggtcctcagaacaggagcagatggagcaggcgatccgtgctgagctgtggaaagtgttggatgtcagtgacctggagagtgtcacttccaaagagatccgccaggctctggagctgcgcctggggctccccctccagcagtaccgtgacttcatcgacaaccagatgctgctgctggtggcacagcgggaccgagcctcccgcatcttcccccacctctacctgggctcagagtggaacgcagcaaacctggaggagctgcagaggaacagagcacagggcacccacgtgctggtccactgcaagatgggcgtcagccgctcagcggccacagtgctggcctatgccatgaagcagtacgaatgcagcctggagcaggccctgcgccacgtgcaggagctccggcccatcgcccgccccaaccctggcttcctgcgccagctgcagatctaccagggcatcctgacggccagccgccagagccatgtctgggagcagaaagtgggtggggtctccccagaggagcacccagcccctgaagtctctacaccattcccacctcttccgccagaacctg

SEQ ID NO: 182027 - DNA, 948 bp, Homo sapiens
  Payload ID: 15842
  Gene Symbol: SSH3
  Gene Name: slingshot protein phosphatase 3
  ENST ID: ENST00000532181
  CDS Start-End: 1-948
ggcggtccagcgaaggagtcgactccagcgaaggcagagctttgcggtgctccgtggggctgtcctgggactgcaggatggaggggacaatgatgatgcagcagaggccagttctgagccaacagagaaggccccgagtgaggaggagctccacggggaccagacagacttcgggcaaggatcccagagtccccagaagcaggaggagcagaggcagcacctgcacctcatggtacagctgctgaggccgcaggatgacatccgcctggcagcccagctggaggcaccccggcctccccggctccgctacctgctggtagtttctacacgagaaggagaaggtctgagccaggatgagacggtcctcctgggcgtggatttccctgacagcagctcccccagctgcaccctgggcctggtcttgcccctctggagtgacacccaggtgtacttagatggagacgggggcttcagcgtgacgtctggtgggcaaagccggatcttcaagcccatctccatccagaccatgtggtcctcagaacaggagcagatggagcaggcgatccgtgctgagctgtggaaagtgttggatgtcagtgacctggagagtgtcacttccaaagagatccgccaggctctggagctgcgcctggggctccccctccagcagtaccgtgacttcatcgacaaccagatgctgctgctggtggcacagcgggaccgagcctcccgcatcttcccccacctctacctgggctcagagtggaacgcagcaaacctggaggagctgcagaggaacagggtcacccacatcttgaacatggcccgggagattgacaacttctaccctgagcgcttcacctaccacaatgtgcgcctctgggatgaggagtcggcccagctgctgccgcactggaaggagacgcaccgcttcattgaggctgcaag

SEQ ID NO: 182028 - DNA, 5189 bp, Homo sapiens
  Payload ID: 15843
  Gene Symbol: SLITRK1
  Gene Name: SLIT and NTRK-like family, member 1
  Uniprot ID: Q96PX8
  ENST ID: ENST00000377084
  CDS Start-End: 887-2977
cgcgctctcttcctccctcagacaactcgccccccgccctccgcccccctccacgtaattccgaaagagcagaagaaagagaaggagaacaggaaaagaagagctagtaagcgagagcgagagcacagaaaagaaaaaaaaaagccttaagaggaccgaaggggaggaaaggaaaaggatggacaaccacaaaacgcagcgattgcggaaattttccagcgccattggctgggcagcgtgagtccttcggtcgggcgtgatttcagcaccgggggaactggacagcacctcggggggacttctgggcaacccgcaaccacagcaagaactccaccagcagcctcaacaacagaagccgcggaaaaccctgctttgtatcagagaggcaaggtcagtccgacgcacagccatgcacaggcagtgcgcctgtactacgctgcaaaccctctgcttgtttctctaacatgcacttgcttctaattactagcattgtttcatttctgatcagtgaagatcagtagatgagattctgtaagggtgtacttttaatttatatgtatatatttaacttctttttctgttatttttaaagtgttgtgggggagtggggtttttttcctacttttttttttttttttttttctttgcttgccttgcactacgtgcctggatagtttgtggatataattattgactggcgtctgggctattgcagtgcgggggggttagggaggaaggaatccacccccacccccccaaacccttttcttctcctttcctggcttcggacattggagcactaaatgaacttgaattgtgtctgtggcgagcaggatggtcgctgttactttgtgatgagatcggggatgaattgctcgctttaaaaatgctgctttggattctgttgctggagacgtctctttgttttgccgctggaaacgttacaggggacgtttgcaaagagaagatctgttcctgcaatgagatagaaggggacctacacgtagactgtgaaaaaaagggcttcacaagtctgcagcgtttcactgccccgacttcccagttttaccatttatttctgcatggcaattccctcactcgacttttccctaatgagttcgctaacttttataatgcggttagtttgcacatggaaaacaatggcttgcatgaaatcgttccgggggcttttctggggctgcagctggtgaaaaggctgcacatcaacaacaacaagatcaagtcttttcgaaagcagacttttctggggctggacgatctggaatatctccaggctgattttaatttattacgagatatagacccgggggccttccaggacttgaacaagctggaggtgctcattttaaatgacaatctcatcagcaccctacctgccaacgtgttccagtatgtgcccatcacccacctcgacctccggggtaacaggctgaaaacgctgccctatgaggaggtcttggagcaaatccctggtattgcggagatcctgctagaggataacccttgggactgcacctgtgatctgctctccctgaaagaatggctggaaaacattcccaagaatgccctgatcggccgagtggtctgcgaagcccccaccagactgcagggtaaagacctcaatgaaaccaccgaacaggacttgtgtcctttgaaaaaccgagtggattctagtctcccggcgccccctgcccaagaagagacctttgctcctggacccctgccaactcctttcaagacaaatgggcaagaggatcatgccacaccagggtctgctccaaacggaggtacaaagatcccaggcaactggcagatcaaaatcagacccacagcagcgatagcgacgggtagctccaggaacaaacccttagctaacagtttaccctgccctgggggctgcagctgcgaccacatcccagggtcgggtttaaagatgaactgcaacaacaggaacgtgagcagcttggctgatttgaagcccaagctctctaacgtgcaggagcttttcctacgagataacaagatccacagcatccgaaaatcgcactttgtggattacaagaacctcattctgttggatctgggcaacaataacatcgctactgtagagaacaacactttcaagaaccttttggacctcaggtggctatacatggatagcaattacctggacacgctgtcccgggagaaattcgcggggctgcaaaacctagagtacctgaacgtggagtacaacgctatccagctcatcctcccgggcactttcaatgccatgcccaaactgaggatcctcattctcaacaacaacctgctgaggtccctgcctgtggacgtgttcgctggggtctcgctctctaaactcagcctgcacaacaattacttcatgtacctcccggtggcaggggtgctggaccagttaacctccatcatccagatagacctccacggaaacccctgggagtgctcctgcacaattgtgcctttcaagcagtgggcagaacgcttgggttccgaagtgctgatgagcgacctcaagtgtgagacgccggtgaacttctttagaaaggatttcatgctcctctccaatgacgagatctgccctcagctgtacgctaggatctcgcccacgttaacttcgcacagtaaaaacagcactgggttggcggagaccgggacgcactccaactcctacctagacaccagcagggtgtccatctcggtgttggtcccgggactgctgctggtgtttgtcacctccgccttcaccgtggtgggcatgctcgtgtttatcctgaggaaccgaaagcggtccaagagacgagatgccaactcctccgcgtccgagattaattccctacagacagtctgtgactcttcctactggcacaatgggccttacaacgcagatggggcccacagagtgtatgactgtggctctcactcgctctcagactaagaccccaaccccaataggggagggcagagggaaggcgatacatccttccccaccgcaggcaccccgggggctggaggggcgtgtacccaaatccccgcgccatcagcctggatgggcataagtagataaataactgtgagctcgcacaaccgaaagggcctgaccccttacttagctccctccttgaaacaaagagcagactgtggagagctgggagagcgcagccagctcgctctttgctgagagccccttttgacagaaagcccagcacgaccctgctggaagaactgacagtgccctcgccctcggccccggggcctgtggggttggatgccgcggttctatacatatatacatatatccacatctatatagagagatagatatctatttttcccctgtggattagccccgtgatggctccctgttggctacgcagggatgggcagttgcacgaaggcatgaatgtattgtaaataagtaactttgacttctgacaaaaaacaaaaagtgctgcatggctcgcatggaatccacgcgctccagggactctgcccgcccccgcgactggagacggcatctcgttcacagcacccaccctcttacctgataagttccatcgtatcaaactttctataaacaaaatacagtataatcagaaagtgccatttcgccattatttgtgatcggtaggcagttcagagcataagttaactgtgaaaaaaatgtaaaggttttatttaggacatttgcatggctagtcatcagtccattttatgagttaacaatgtattttgttgagggaagtttttaggggttgttttgggttcttttattttgatggtgatgttttattttattttatttttttcagggggtcttttttttaatacatatccaataatgccttccatctgaatgtaaaataagtacccatgatttctattatagtatcagtgtaattatttaaaaaatgattttgaggcagttaagcatgaccaattaatgtcactctagtgcttaggctgcgatcctatggtagcaattctgtgctggtataaatcttacttataaagtaggaaaagagaaccgaggaagcacgtgaaacttactaattctattcgaggattttataatggcatattttttcagtattaaagcgaaaatgttttcaactctgggtccttacctttttccagcttcatatttgcaagtggtaaattggatttgcggtggaagagacaggggagggaaacggttggggttagatcccttcctgagctacattaaggctctttctctaatcgccttacttagctttttaccctttaagtagctcctcttccctcgcccccaccctctaccccacccccaccttcgctcagactttaccggctttccccagtccataaaggtcttgccccaacactcaccccttctttttttcccctctccaaatgcagcagtgaatccctttattaatactggaaatccctctctgctgcttttgttggtgctgcccacactgcagatatattaaggatgttaggagagatttgatttaattgactctgcctagataggtctcattaaacagagtggagatttcattggtcagcactcctcaatgaaagacagacctaatgactggcatttgagatgctgctggcattttgaattcaacatctgctgaaaacggtaaaactaattagtgcccacccaccctccccgccccagcaactgcatattgaaatttgttaaagcactcatctttatggaaattaatcattatcctaaagaagtgtttctctcccatcatccggatttctggttgtggcccagcaattaacaaaaacagcttcaactgttcgaattttatgaaccaatgtaactctggcctcaatcatattcctctgggatttctaaacagcagttaagctacaaaaagcaaacaaaaccacacatattgatggagtctgcattccaccacatatccacccttgagaagtatgtcaaaagactgcagactatagatttttttttaatataggattataaatcagctagtgaaagacctcagagcagttgtaagtagatctgccatctagaactcatattctaaagggaagtgatttctcagaacagtgatgttctggaatatgtattatttattttaacacttttttaataaaatctttattataaaccatga

SEQ ID NO: 182029 - DNA, 3159 bp, Homo sapiens
  Payload ID: 15844
  Gene Symbol: SLITRK2
  Gene Name: SLIT and NTRK-like family, member 2
  ENST ID: ENST00000335565
  CDS Start-End: 988-3159
cttcctgcaagaagcgttgcccgttggctagctgctcggtggggatctgcctgccctgggggcgccgcccgcgctccccgcggtgctctcgctcctgggctgcgccagtccgaggcggtgccggctcctttgcctccccgagtcgcagatgctgcgggcgcctccgggaaaagatctgggcggcgcgctcgctcgatggacacaggaagatccagaagctagtggcacatctagcaacagagccagatcagaacccaggttggaggtggagtagttcagaatcaactgacgcagccgggaattgagctttgcaaagccacttgcaaggaagggaagcatctgcccaaccctcccccaccgcgcgccctggatcctctgcctgccccctcccccgtgacgtcaccctagtcctgtcccggggagcctgcaaagcctctcagattcaaactgctagacgcactgctgccaccgccaccgaattggaaacgcgcgcccaggctccgtcgtcgccttcgcccgccgaccgggccagccggctctccgacctccctacagaatcgcaccccagtccctccctggcagctcggcttccctcagctccaactcttctcttccgctcctgcctcctgtcggatttttaatttctgcgcacccccagtcaaattaaatcaaccaacaaaaagcagggcatcccccctggaagcagcgtcttattttaccttgttctcccacttcctgaagatgctaaactcctggtggactgcagaggagagggattcagtcttctcctgatgtcgattgcgatttctgctgggagctcaagacgggcgagctgcccgagatctcttcgagataccccaggggaggaggagatgggcaggatttagtaggacaactcggttactaatgacttggcggctggctgcgaccccccgggaaatcaggtttgcctgtaggtacctgagttgacaccgaaggtgcctaaagatgctgagcggcgtttggttcctcagtgtgttaaccgtggccgggatcttacagacagagagtcgcaaaactgccaaagacatttgcaagatccgctgtctgtgcgaagaaaaggaaaacgtactgaatatcaactgtgagaacaaaggatttacaacagttagcctgctccagcccccccagtatcgaatctatcagctttttctcaatggaaacctcttgacaagactgtatccaaacgaatttgtcaattactccaacgcggtgactcttcacctaggtaacaacgggttacaggagatccgaacgggggcattcagtggcctgaaaactctcaaaagactgcatctcaacaacaacaagcttgagatattgagggaggacaccttcctaggcctggagagcctggagtatctccaggccgactacaattacatcagtgccatcgaggctggggcattcagcaaacttaacaagctcaaagtgctcatcctgaatgacaaccttctgctttcactgcccagcaatgtgttccgctttgtcctgctgacccacttagacctcagggggaataggctaaaagtaatgccttttgctggcgtccttgaacatattggagggatcatggagattcagctggaggaaaatccatggaattgcacttgtgacttacttcctctcaaggcctggctagacaccataactgtttttgtgggagagattgtctgtgagactccctttaggttgcatgggaaagacgtgacccagctgaccaggcaagacctctgtcccagaaaaagtgccagtgattccagtcagaggggcagccatgctgacacccacgtccaaaggctgtcacctacaatgaatcctgctctcaacccaaccagggctccgaaagccagccggccgcccaaaatgagaaatcgtccaactcctcgagtgactgtgtcaaaggacaggcaaagttttggacccatcatggtgtaccagaccaagtctcctgtgcctctcacctgtcccagcagctgtgtctgcacctctcagagctcagacaatggtctgaatgtaaactgccaagaaaggaagttcactaatatctctgacctgcagcccaaaccgaccagtccaaagaaactctacctaacagggaactatcttcaaactgtctataagaatgacctcttagaatacagttctttggacttactgcacttaggaaacaacaggattgcagtcattcaggaaggtgcctttacaaacctgaccagtttacgcagactttatctgaatggcaattaccttgaagtgctgtacccttctatgtttgatggactgcagagcttgcaatatctctatttagagtataatgtcattaaggaaattaagcctctgacctttgatgctttgattaacctacagctactgtttctgaacaacaaccttcttcggtccttacctgataatatatttggggggacggccctaaccaggctgaatctgagaaacaaccatttttctcacctgcccgtgaaaggggttctggatcagctcccggctttcatccagatagatctgcaggagaacccctgggactgtacctgtgacatcatggggctgaaagactggacagaacatgccaattcccctgtcatcattaatgaggtgacttgcgaatctcctgctaagcatgcaggggagatactaaaatttctggggagggaggctatctgtccagacagcccaaacttgtcagatggaaccgtcttgtcaatgaatcacaatacagacacacctcggtcgcttagtgtgtctcctagttcctatcctgaactacacactgaagttccactgtctgtcttaattctgggattgcttgttgttttcatcttatctgtctgttttggggctggtttattcgtctttgtcttgaaacgccgaaagggagtgccgagcgttcccaggaataccaacaacttagacgtaagctcctttcaattacagtatgggtcttacaacactgagactcacgataaaacagacggccatgtctacaactatatccccccacctgtgggtcagatgtgccaaaaccccatctacatgcagaaggaaggagacccagtagcctattaccgaaacctgcaagagttcagctatagcaacctggag

SEQ ID NO: 182030 - DNA, 7672 bp, Homo sapiens
  Payload ID: 15844
  Gene Symbol: SLITRK2
  Gene Name: SLIT and NTRK-like family, member 2
  Uniprot ID: Q9H156
  ENST ID: ENST00000370490
  CDS Start-End: 4256-6793
gcggccgccctctaccctcaatccccactggagattcctcaccccgggaccgtccgcgcgggcgtggtcgggctccgcgcctcgcgcagcggggtggcacaggcggccagggagggcccacgcacccggcgcgagctagaagcctccggtcggcctgcagtgcccaagtcccatggcgagggcagcccgagtggccgtcgcggctgtaggtccgcatgccgggcaccgcaccaggcgtctagcaggtaggggcagggaaggtagggctgcgctggcggccggtgcccagttaccggcgatcggggacgctcggagacacctggtctcccggaagcgcccttcggaaatgggattcgacccggcttgcgggcggcgggtgtttagaagaagaggctgcgggcaagcagtgccccctctctggttccccggactcctcttagccccctcgtggcctgatgggcggccgggacggaggtgggctgtaagcccgccggcacccaccgtgtcctgtggaaggcttggagacctgagccaggctctactcggttagatgcgagtgagacaggcgacggagttcgtctttaagcctcccttgcctcagcaaggagagggagcgttttccttattttaatgaccgcctttccctcccttggggtcccagttcaccctgaacctttccacagccttaaaagcccgctctccctagcggagtgctgcggcagttcttcagaagacacggggccaaatgaaacttacttaaagtggttatcgcgtttcaggctgatttgttcctagtaactacgttttggaaagcagctgtggactctcaaggacaggcaggaacgaagacctccttagggtccgagtgtcgcttcccacagttagattacccatgaatttccttgattctgtaggtctcaagaatctcatgagcccccaaccacctccacctttctctctgaatctctctcctgtctctgaaattcttcgcaaaaataatctgtcctcaaggaatattgaaagcgtcatcaatgtcttgaaggaaattactgtatctgagaaccgaaactagtatttgatgtttcactttcaaatacatttttttttaataaaaaggatacctttaagtaaaacactaccactgctatttacgtttaagtagatttttaattcatattaagcagtagtgtgctttttggaaagatgatggactgggactcataatccctgggttttgtttctatttgtagtttcttgagtaagtcagcactttccctggttaagaaatgacctcatctgtaaaatgaacctgacttctaaggtcttgttcggctctcacgtctttacttcagttaaatattgacataatacatgtttgttgaatgaatgactgaatgaataaatcttattgctctaggaactatgtgcttttaacctttggaaatacatagaaacaaatgcctcctttgctaggaaagggagcttaattgtgctcccactgcatcagactgcttccatctaatgatgcaattgcaatacagggtgggaggccatccacagggctgtccctctgcctcagagctcatctcaagtttgcccttctctatggagaaggaaaatttgagtctccagaaggaaagtattttgctaaacgccaagcaagaattagagggtaagggggcttctgatgcctggtccaaggctcttagaagaagaagaaggagaaagggagaaagctcaagaaaataatgcacagatcaccagctacaggtggccctagtgcctaagtttataaactacccccgcccttcccggagagaaaggagcttgtataaagggaacaatcctagaacctaggcttaacaaggaaggagaaggggagaagcaagggtcattctgttctcaagtggtttgttgtatctgtgtgtttatctattccacatttggccaggcagtgggactccgggaaagcaagctgaagtgttttgtgggacaggcacatcatttggtcaactccttttccctggttgattccctccttttcctgacccatctcccccttcctaccagaggcaaccaaggcctttccaggcaacagcagacattatttaccccttgcgaattgattccacaatggaagactcttgggtccaaggagctgtaagataattaaggagaaaacagataatgaaggcaaaaatccaacacctggccattagcaatgctctggaaaggctatttaaacccgcattggatatcagagctgggagggcccatacagtctacctacctgccttttgcagatggacacaggaagatccagaagctagtggcacatctagcaacagagccagatcagaacccaggtaagctcggtctcaggccaggattccttttccatctcctctctttctcaggagccagtcttcctgcaccagcttcctcttttctcctagctcccctgcccctgcagcctggagggctcaaccacccttcctttggctcccactcccagctgaggctcagcctggcagtgcttttctgacacccacttcttttctccttcctccaggcaagaagtgcacgtttaaacctcattatctggctaagtataaacctcagggagaaaaggggtttgtttttgtttttctcagtctataagctaacattgagctgactttcagagtccaggcaaatatgtttggtgggtcaccacccagaaaggaattctcttagcactgaatcagggctctgtatgtaaagtataaatcccctaagagaactcctcaccctcctacacagacacattggtgcatgcacacacaccccactctctgcacagagagcatctgagctaggagctggcaagtggggcaccagtcctgtagcaaagaggcacaccacacacacacacacacacacacacacacactctctctctctctctctctcactcacacacacacacacacacacacacacacgcttctcccttgcttgggaatctgggagaagaaccccccacccccacccctgccctccataggcattgtgtaggtgagagaaagagggaggagtgagagagaacacacagaggggcccaaggaggtgccaggccattagcagggcccctccttgagaaacccctctgcaggagcttctcctgccgccagccaggttggaggtggagtagttcagaatcaactgacgcagccgggaattgagctttgcaaagccacttgcaaggaagggaagcatctgcccaaccctcccccaccgcgcgccctggatcctctgcctgccccctcccccgtgacgtcaccctagtcctgtcccggggagcctgcaaagcctctcagattcaaactgctagacgcactgctgccaccgccaccgaattggaaacgcgcgcccaggctccgtcgtcgccttcgcccgccgaccgggccagccggctctccgacctccctacagaatcgcaccccagtccctccctggcagctcggcttccctcagctccaactcttctcttccgctcctgcctcctgtcggatttttaatttctgcgcacccccagtcaaattaaatcaaccaacaaaaagcagggcatcccccctggaagcagcgtcttattttaccttgttctcccacttcctgaagatgctaaactcctggtggactgcagaggagagggattcagtcttctcctgatgtgtgagtaacccccacctcgcactgtctttcccatctctatctctcctctacacctgccgccagccccctgattcctgattttcccaccccctttttgcgctttttttttttttcctaaagcgattgcgatttctgctgggagctcaagacgggcgagctgcccgagatctcttcgagataccccaggggaggaggagatgggcaggatttagtaggacaactcggttactaatgacttggcggctggctgcgaccccccgggaaatcaggtgcaagcatgtgtgttcccggggcgcgtgtgtgggtggcctcgggatgggggaatagggagcggagaaaagaaaccgctttggaaaatgcaatgatttcattctgccgtgttgctaaccccctcattctccctcgctcccactccgcctccttgctttaccatttttaatcgggcttccttgtttctttcttccctgcacccgcttcttccccctgcccccacctaaggtttgcctgtaggtacctgagttgacaccgaaggtgcctaaagatgctgagcggcgtttggttcctcagtgtgttaaccgtggccgggatcttacagacagagagtcgcaaaactgccaaagacatttgcaagatccgctgtctgtgcgaagaaaaggaaaacgtactgaatatcaactgtgagaacaaaggatttacaacagttagcctgctccagcccccccagtatcgaatctatcagctttttctcaatggaaacctcttgacaagactgtatccaaacgaatttgtcaattactccaacgcggtgactcttcacctaggtaacaacgggttacaggagatccgaacgggggcattcagtggcctgaaaactctcaaaagactgcatctcaacaacaacaagcttgagatattgagggaggacaccttcctaggcctggagagcctggagtatctccaggccgactacaattacatcagtgccatcgaggctggggcattcagcaaacttaacaagctcaaagtgctcatcctgaatgacaaccttctgctttcactgcccagcaatgtgttccgctttgtcctgctgacccacttagacctcagggggaataggctaaaagtaatgccttttgctggcgtccttgaacatattggagggatcatggagattcagctggaggaaaatccatggaattgcacttgtgacttacttcctctcaaggcctggctagacaccataactgtttttgtgggagagattgtctgtgagactccctttaggttgcatgggaaagacgtgacccagctgaccaggcaagacctctgtcccagaaaaagtgccagtgattccagtcagaggggcagccatgctgacacccacgtccaaaggctgtcacctacaatgaatcctgctctcaacccaaccagggctccgaaagccagccggccgcccaaaatgagaaatcgtccaactcctcgagtgactgtgtcaaaggacaggcaaagttttggacccatcatggtgtaccagaccaagtctcctgtgcctctcacctgtcccagcagctgtgtctgcacctctcagagctcagacaatggtctgaatgtaaactgccaagaaaggaagttcactaatatctctgacctgcagcccaaaccgaccagtccaaagaaactctacctaacagggaactatcttcaaactgtctataagaatgacctcttagaatacagttctttggacttactgcacttaggaaacaacaggattgcagtcattcaggaaggtgcctttacaaacctgaccagtttacgcagactttatctgaatggcaattaccttgaagtgctgtacccttctatgtttgatggactgcagagcttgcaatatctctatttagagtataatgtcattaaggaaattaagcctctgacctttgatgctttgattaacctacagctactgtttctgaacaacaaccttcttcggtccttacctgataatatatttggggggacggccctaaccaggctgaatctgagaaacaaccatttttctcacctgcccgtgaaaggggttctggatcagctcccggctttcatccagatagatctgcaggagaacccctgggactgtacctgtgacatcatggggctgaaagactggacagaacatgccaattcccctgtcatcattaatgaggtgacttgcgaatctcctgctaagcatgcaggggagatactaaaatttctggggagggaggctatctgtccagacagcccaaacttgtcagatggaaccgtcttgtcaatgaatcacaatacagacacacctcggtcgcttagtgtgtctcctagttcctatcctgaactacacactgaagttccactgtctgtcttaattctgggattgcttgttgttttcatcttatctgtctgttttggggctggtttattcgtctttgtcttgaaacgccgaaagggagtgccgagcgttcccaggaataccaacaacttagacgtaagctcctttcaattacagtatgggtcttacaacactgagactcacgataaaacagacggccatgtctacaactatatccccccacctgtgggtcagatgtgccaaaaccccatctacatgcagaaggaaggagacccagtagcctattaccgaaacctgcaagagttcagctatagcaacctggaggagaaaaaagaagagccagccacacctgcttacacaataagtgccactgagctgctagaaaagcaggccacaccaagagagcctgagctgctgtatcaaaatattgctgagcgagtcaaggaacttcccagcgcaggcctagtccactataacttttgtaccttacctaaaaggcagtttgccccttcctatgaatctcgacgccaaaaccaagacagaatcaataaaaccgttttatatggaactcccaggaaatgctttgtggggcagtcaaaacccaaccaccctttactgcaagctaagccgcaatcagaaccggactacctcgaagttctggaaaaacaaactgcaatcagtcagctgtgaagggaaatcatttacaaccctaaggcatcagaggatgctgctccgaactgttggaaacaaggacattagcttttgtgtttgtttttgttctccctttcccagtgttaatgggggactttgaaaatgtttgggagataggatgaagtcatgattttgcttttgcaagttttcctttaaattatttctctctcgctctcctcccctccttttttttttttttttttttttctttttcccttctcttcttaggaaccatcagtggacatgaatgtttctacaatgcatttcttcatagattttgtttatggttttgtttcttttttcttctttgtttttcagtgtgggagtgggaagaggagattatagtgactgaagaaagaataggcaaacttttcaaatgaaaatggatatttagtgtattttgtagaagatctccaaagatcttttgtgactacaacttcttttgtaaataatgatatatggtatttccatcgtcagttaccgagtatagccactgggtatcactactttgtgttaaagtgccttcgcactttaagtacattacttaaatgttgcttttagctttgataaattgaaaatattttaatgtgttgtatttttgaaattgaaaacactgtaaaatagattgatgtgtcagctatattaagtcaacgtacagtttgcttgagttatagaaaccagcctgtcatcaaatgattctagttctaggactttgtaggcttaactataaaatatttcctttcctctgggtttaagtgattttatttaagtcaactaaggggatttaacagtggactagaggtaataagccacctcagtcaggattaataattcattaataaaatatatttaacccaa

SEQ ID NO: 182031 - DNA, 4391 bp, Homo sapiens
  Payload ID: 15845
  Gene Symbol: SLITRK3
  Gene Name: SLIT and NTRK-like family, member 3
  Uniprot ID: O94933
  ENST ID: ENST00000241274
  CDS Start-End: 283-3216
aagccgggattttgcctgcgatgcgcggcgagaggactgcggcggctgatttacacagttggcgcggaggaggggccgggggtgcgggggggacgcgctggcggagctccggcgatgggctgatctgggggctcccgagcgccgctcccttggtgcgcgatttgggggcggctgatggatttgcattcaggttccagccctgcgtttcctatattgactccttatacacgacctggcgctccagtttaggaggagacgttgttttgtaatcaaccacgaacgatgaaaccttccatagctgagatgcttcacagaggaaggatgttgtggataattcttctaagcacaattgctctaggatggactaccccgattcccctaatagaggactcagaggaaatagatgagccctgttttgatccatgctactgtgaagttaaagaaagcctctttcatatacattgtgacagtaaaggatttacaaatattagtcagattaccgagttctggtcaagaccttttaaactgtatctgcagaggaattctatgaggaaattatataccaacagttttcttcatttgaataatgctgtgtctattaatcttgggaacaatgcattgcaggacattcagactggagctttcaatggtcttaagattttaaagagactatatctacatgaaaacaaactagatgtcttcagaaatgacaccttccttggcttggaaagtctagaatatctgcaggcagattacaatgtcattaaacgtattgagagtggggcatttcggaacctaagtaaattgagggttctgattttaaatgataatctcatccccatgcttccaaccaatttatttaaggctgtctctttaacccatttggacctacgtggaaataggttaaaggttcttttttaccgaggaatgctagatcacattggcagaagcctgatggagctccagctggaagaaaacccttggaactgtacatgtgaaattgtacaactgaagagttggctggaacgcattccttatactgccctggtgggagacattacctgtgagacccctttccacttccatggaaaggacctacgagaaatcaggaagacagaactctgtcccttgttgtctgactctgaggtagaggctagtttgggaattccacattcgtcatcaagtaaggagaatgcatggccaactaagccttcctcaatgctatcctctgttcattttactgcttcttctgtcgaatacaagtcctcaaataaacagcctaagcccaccaaacagcctcgaacaccaaggccaccctccacctcccaagctttatatcctggtccaaaccagcctcccattgctccttatcagaccagaccaccaatccccattatatgccccactgggtgtacctgtaatttgcacatcaatgaccttggcttgactgtcaactgcaaagagcgaggatttaataacatttctgaacttcttccaaggcccttgaatgccaagaaactgtatctgagtagcaatctgattcagaaaatataccgttctgatttttggaatttttcttccttggatctcttgcatctggggaacaatcgtatttcctatgtccaagatggggcctttatcaacttgcccaacttaaagagcctcttccttaatggcaacgatatagagaagctgacaccaggcatgttccgaggcctacagagtttgcactacttgtactttgagttcaatgtcatccgggaaatccagcctgcagccttcagcctcatgcccaacttgaagctgctattcctcaataataacttactgaggactctgccaacagacgcctttgctggcacatccctggcccggctcaacctgaggaagaactacttcctctatcttcccgtggctggtgtcctggaacacttgaatgccattgtccagatagacctcaatgagaatccttgggactgcacctgtgacctggtcccctttaaacagtggatcgaaaccatcagctcagtcagtgtggttggtgatgtgctttgcaggagccctgagaacctcacgcaccgtgatgtgcgcactattgagctggaagttctttgcccagagatgctgcacgttgcaccagctggagaatccccagcccagcctggagattctcaccttattggggcaccaaccagtgcatcaccttatgagttttctcctcctgggggccctgtgccactttctgtgttaattctcagcctgctggttctgtttttctcagcagtctttgttgctgcaggcctctttgcctacgtgctccgaaggcgtcgaaagaagctgcccttcagaagcaagcggcaggaaggtgtggaccttactggcatccaaatgcaatgccacaggctgtttgaggatggtggaggtggtggtggcggaagtgggggtggtggtcgaccaactctttcctctccagagaaggcccctcccgtgggtcatgtgtatgagtacatcccccacccggttacccaaatgtgcaacaaccccatctacaagcctcgtgaggaggaggaggtggctgtttcatcagcccaagaagcagggagtgcagaacgtgggggtccagggacacaaccaccgggaatgggtgaggctctcctaggaagtgagcagtttgctgagacacccaaggagaaccatagtaactaccggaccttgctggaaaaagagaaggagtgggccctagcagtgtccagctcccagcttaacaccatagtgacggtgaatcaccatcaccctcaccacccagcagttggtggggtttcaggagtagttgggggaactgggggagacttggcagggttccgccaccatgagaaaaatggtggggtggtgctgtttcctcctgggggaggctgtggtagtggcagtatgctactagatcgagagaggccacagcctgccccctgcacagtgggatttgtggactgtctctatggaacagtgcccaaattaaaggaactgcacgtgcaccctcctggcatgcaatacccagacttacagcaggatgccaggctcaaagaaacccttctcttctcggctggaaagggcttcacagaccaccaaacccaaaaaagtgattacctcgagttaagggccaaacttcaaaccaagccggattacctcgaagtcctggagaagacaacatacaggttctaacagagagaagaaaatatattagtgctttttttttttcaaaagaaaaggaaaataaaagaaatatatcccttgctccctttacacttgtcccagtaactccatcctcacgatctttcctaccctgaacaaaactaaaaccgcatgataactagagaatacagatgtatgctctcccctctcagatgcgatttggaggaagggccatactcagatcattaatcaatgaaagtgccttcgcagacttttgccagcaaatgttatcattatttttttatactgaaacttgagactttgactgtgccatgtataagatatactggggatcattgtatggatcctaattaagtaaaattcaatgtgtctttttattttcagtaactattttttttatagttgtagttttgatttaaagggggggaaacaagttgacatttgtcatttgtggctttctttcttatcatcatggcacagattctgtacatgtattaacaatgcagtttgctgcatgcctggaaactgcaagatggggagggagggggcgggtcttgctcgaatgttctcactcactatcttgtctctcatacacatatccatctgcagaccatggtccctaaacctgcagtttcttcctgctggtgcaggtacacacacacacacacacacacacacacacacacacacacactccataccatttccattcaactcaatctgcttagttcgggtttgatccatttttctcctctccatagttctaccacccttcactgctagtgtacagctcacagcatctctcctaccaccctgggaaaagtcacattctaggctggattctactgaagtagaggcctggtggtttaacagccgaagacacacgcctagggatgagcaccctctttgtgacacttcatcctgatgccaagattttttggagaacatctgcactttcttatatatatatataatattaaaaaaagcaactgggtatatatcactaacagctttgtaggaagcacttttaatgttttctctctcacacacaaagattcaaaagaaatgtgcatatatttattctgtaatttcagtgattataaattgtaaaggtaatgtttaatcattgtatagtgattatgcctctggtatagctttcctaataaaaagtttttgaaaaacat

SEQ ID NO: 182032 - DNA, 585 bp, Homo sapiens
  Payload ID: 15845
  Gene Symbol: SLITRK3
  Gene Name: SLIT and NTRK-like family, member 3
  ENST ID: ENST00000497724
  CDS Start-End: 98-585
acaaatcaatccacgggtacagaatgctgacttcccgacactcaatttcacagggtgtctcttgaagagctgccagttttgtaatcaaccacgaacgatgaaaccttccatagctgagatgcttcacagaggaaggatgttgtggataattcttctaagcacaattgctctaggatggactaccccgattcccctaatagaggactcagaggaaatagatgagccctgttttgatccatgctactgtgaagttaaagaaagcctctttcatatacattgtgacagtaaaggatttacaaatattagtcagattaccgagttctggtcaagaccttttaaactgtatctgcagaggaattctatgaggaaattatataccaacagttttcttcatttgaataatgctgtgtctattaatcttgggaacaatgcattgcaggacattcagactggagctttcaatggtcttaagattttaaagagactatatctacatgaaaacaaactagatgtcttcagaaatgacaccttccttggcttggaaagtctagaatatctgcaggcagattacaatgtcattaaacg

SEQ ID NO: 182033 - DNA, 4555 bp, Homo sapiens
  Payload ID: 15845
  Gene Symbol: SLITRK3
  Gene Name: SLIT and NTRK-like family, member 3
  Uniprot ID: O94933
  ENST ID: ENST00000475390
  CDS Start-End: 445-3378
aaatccagagactgagctcaggctctcgggaacaacgaagctctccactgatccagagcaccgagattttaaatcaaaggaacctagtcctgggacactcactctgcctgcctgcctaccaaccatcgagggcatagggagctgtggtcgtgagctccctgtcgctggcatcgccgcgctaggtgcgcgccccgctctcccattggtatgcagcgaccatttccctgcaagtctcaaaggtggaaacatttaaacggattacaagcgtgattcggtagcctttcggaaagttggtggccagaagaggagaagctacaaggctacagtatgatggatacaattcagcttcgcagagagtttgcccctcctgctgggtagcccctcgcagcaaacctcggagatcctgagcgctctgcaccatagttttgtaatcaaccacgaacgatgaaaccttccatagctgagatgcttcacagaggaaggatgttgtggataattcttctaagcacaattgctctaggatggactaccccgattcccctaatagaggactcagaggaaatagatgagccctgttttgatccatgctactgtgaagttaaagaaagcctctttcatatacattgtgacagtaaaggatttacaaatattagtcagattaccgagttctggtcaagaccttttaaactgtatctgcagaggaattctatgaggaaattatataccaacagttttcttcatttgaataatgctgtgtctattaatcttgggaacaatgcattgcaggacattcagactggagctttcaatggtcttaagattttaaagagactatatctacatgaaaacaaactagatgtcttcagaaatgacaccttccttggcttggaaagtctagaatatctgcaggcagattacaatgtcattaaacgtattgagagtggggcatttcggaacctaagtaaattgagggttctgattttaaatgataatctcatccccatgcttccaaccaatttatttaaggctgtctctttaacccatttggacctacgtggaaataggttaaaggttcttttttaccgaggaatgctagatcacattggcagaagcctgatggagctccagctggaagaaaacccttggaactgtacatgtgaaattgtacaactgaagagttggctggaacgcattccttatactgccctggtgggagacattacctgtgagacccctttccacttccatggaaaggacctacgagaaatcaggaagacagaactctgtcccttgttgtctgactctgaggtagaggctagtttgggaattccacattcgtcatcaagtaaggagaatgcatggccaactaagccttcctcaatgctatcctctgttcattttactgcttcttctgtcgaatacaagtcctcaaataaacagcctaagcccaccaaacagcctcgaacaccaaggccaccctccacctcccaagctttatatcctggtccaaaccagcctcccattgctccttatcagaccagaccaccaatccccattatatgccccactgggtgtacctgtaatttgcacatcaatgaccttggcttgactgtcaactgcaaagagcgaggatttaataacatttctgaacttcttccaaggcccttgaatgccaagaaactgtatctgagtagcaatctgattcagaaaatataccgttctgatttttggaatttttcttccttggatctcttgcatctggggaacaatcgtatttcctatgtccaagatggggcctttatcaacttgcccaacttaaagagcctcttccttaatggcaacgatatagagaagctgacaccaggcatgttccgaggcctacagagtttgcactacttgtactttgagttcaatgtcatccgggaaatccagcctgcagccttcagcctcatgcccaacttgaagctgctattcctcaataataacttactgaggactctgccaacagacgcctttgctggcacatccctggcccggctcaacctgaggaagaactacttcctctatcttcccgtggctggtgtcctggaacacttgaatgccattgtccagatagacctcaatgagaatccttgggactgcacctgtgacctggtcccctttaaacagtggatcgaaaccatcagctcagtcagtgtggttggtgatgtgctttgcaggagccctgagaacctcacgcaccgtgatgtgcgcactattgagctggaagttctttgcccagagatgctgcacgttgcaccagctggagaatccccagcccagcctggagattctcaccttattggggcaccaaccagtgcatcaccttatgagttttctcctcctgggggccctgtgccactttctgtgttaattctcagcctgctggttctgtttttctcagcagtctttgttgctgcaggcctctttgcctacgtgctccgaaggcgtcgaaagaagctgcccttcagaagcaagcggcaggaaggtgtggaccttactggcatccaaatgcaatgccacaggctgtttgaggatggtggaggtggtggtggcggaagtgggggtggtggtcgaccaactctttcctctccagagaaggcccctcccgtgggtcatgtgtatgagtacatcccccacccggttacccaaatgtgcaacaaccccatctacaagcctcgtgaggaggaggaggtggctgtttcatcagcccaagaagcagggagtgcagaacgtgggggtccagggacacaaccaccgggaatgggtgaggctctcctaggaagtgagcagtttgctgagacacccaaggagaaccatagtaactaccggaccttgctggaaaaagagaaggagtgggccctagcagtgtccagctcccagcttaacaccatagtgacggtgaatcaccatcaccctcaccacccagcagttggtggggtttcaggagtagttgggggaactgggggagacttggcagggttccgccaccatgagaaaaatggtggggtggtgctgtttcctcctgggggaggctgtggtagtggcagtatgctactagatcgagagaggccacagcctgccccctgcacagtgggatttgtggactgtctctatggaacagtgcccaaattaaaggaactgcacgtgcaccctcctggcatgcaatacccagacttacagcaggatgccaggctcaaagaaacccttctcttctcggctggaaagggcttcacagaccaccaaacccaaaaaagtgattacctcgagttaagggccaaacttcaaaccaagccggattacctcgaagtcctggagaagacaacatacaggttctaacagagagaagaaaatatattagtgctttttttttttcaaaagaaaaggaaaataaaagaaatatatcccttgctccctttacacttgtcccagtaactccatcctcacgatctttcctaccctgaacaaaactaaaaccgcatgataactagagaatacagatgtatgctctcccctctcagatgcgatttggaggaagggccatactcagatcattaatcaatgaaagtgccttcgcagacttttgccagcaaatgttatcattatttttttatactgaaacttgagactttgactgtgccatgtataagatatactggggatcattgtatggatcctaattaagtaaaattcaatgtgtctttttattttcagtaactattttttttatagttgtagttttgatttaaagggggggaaacaagttgacatttgtcatttgtggctttctttcttatcatcatggcacagattctgtacatgtattaacaatgcagtttgctgcatgcctggaaactgcaagatggggagggagggggcgggtcttgctcgaatgttctcactcactatcttgtctctcatacacatatccatctgcagaccatggtccctaaacctgcagtttcttcctgctggtgcaggtacacacacacacacacacacacacacacacacacacacacactccataccatttccattcaactcaatctgcttagttcgggtttgatccatttttctcctctccatagttctaccacccttcactgctagtgtacagctcacagcatctctcctaccaccctgggaaaagtcacattctaggctggattctactgaagtagaggcctggtggtttaacagccgaagacacacgcctagggatgagcaccctctttgtgacacttcatcctgatgccaagattttttggagaacatctgcactttcttatatatatatataatattaaaaaaagcaactgggtatatatcactaacagctttgtaggaagcacttttaatgttttctctctcacacacaaagattcaaaagaaatgtgcatatatttattctgtaatttcagtgattataaattgtaaaggtaatgtttaatcattgtatagtgattatgcctctggtatagctttcctaataaaaagtttttgaaaaacataa

SEQ ID NO: 182034 - DNA, 3357 bp, Homo sapiens
  Payload ID: 15846
  Gene Symbol: SLITRK4
  Gene Name: SLIT and NTRK-like family, member 4
  Uniprot ID: Q8IW52
  ENST ID: ENST00000338017
  CDS Start-End: 377-2890
agtggtcgagtgtcgggaggaaggactgcttgtgtgcggggtgggggggggtggtggagagcgggggcggggattcagcgcgtgtatgtaaaggtgcagcccgtgtgctaggcgctgggtgcgcgcgcggtgtctgctcgggtgcgcgcgcgcgccgctgcccgcctgcccgccggcccgcctgctcgcctgctggggctgctccgtgggtttgacgggcgagcgggcgcggaggagctctgtccggaatcacatagataccatcgtggaaacagcagcgcaggtcacggcgccgcgggccctgcaccagacgctgggctctagagattatttctctttattcagaagcatacagttgtttgctgattgcaagaagatgtttctgtggctgtttctgattttgtcagccctgatttcttcgacaaatgcagattctgacatatcggtggaaatttgcaatgtgtgttcctgcgtgtcagttgagaatgtgctctatgtcaactgtgagaaggtttcagtctacagaccaaatcagctgaaaccaccttggtctaatttttatcacctcaatttccaaaataattttttaaatattctgtatccaaatacattcttgaatttttcacatgcagtctccctgcatctggggaataataaactgcagaacattgagggaggagcctttcttgggctcagtgcattaaagcagttgcacttgaacaacaatgaattaaagattctccgagctgacactttccttggcatagagaacttggagtatctccaggctgactacaatttaatcaagtatattgaacgaggagccttcaataagctccacaaactgaaagttctcattcttaatgacaatctgatttcattccttcctgataatattttccgattcgcatctttgacccatctggatatacgagggaacagaatccagaagctcccttatatcggggttctggaacacattggccgtgtcgttgaattgcaactggaagataacccttggaactgtagctgtgatttattgcccttaaaagcttggctggagaacatgccatataacatttacataggagaagctatctgtgaaactcccagtgacttatatggaaggcttttaaaagaaaccaacaaacaagagctatgtcccatgggcaccggcagtgattttgacgtgcgcatcctgcctccatctcagctggaaaatggctacaccactcccaatggtcacactacccaaacatctttacacagattagtaactaaaccaccaaaaacaacaaatccttccaagatctctggaatcgttgcaggcaaagccctctccaaccgcaatctcagtcagattgtgtcttaccaaacaagggtgcctcctctaacaccttgcccggcaccttgcttctgcaaaacacacccttcagatttgggactaagtgtgaactgccaagagaaaaatatacagtctatgtctgaactgataccgaaacctttaaatgcgaagaagctgcacgtcaatggcaatagcatcaaggatgtggacgtatcagacttcactgactttgaaggactggatttgcttcatttaggcagcaatcaaattacagtgattaagggagacgtatttcacaatctcactaatttacgcaggctatatctcaatggcaatcaaattgagagactctatcctgaaatattttcaggtcttcataacctgcagtatctgtatttggaatacaatttgattaaggaaatctcagcaggcacctttgactccatgccaaatttgcagttactgtacttaaacaataatctcctaaagagcctgcctgtttacatcttttccggagcacccttagctagactgaacctgaggaacaacaaattcatgtacctgcctgtcagcggggtccttgatcagttgcaatctcttacacagattgacttggagggcaacccatgggactgtacttgtgacttggtggcattaaagctgtgggtggagaagttgagcgacgggattgttgtgaaagaactgaaatgtgagacgcctgttcagtttgccaacattgaactgaagtccctcaaaaatgaaatcttatgtcccaaacttttaaataagccgtctgcaccattcacaagccctgcacctgccattacattcaccactcctttgggtcccattcgaagtcctcctggtgggccagtgcctctgtctattttaatcttaagtatcttagtggtcctcattttaacggtgtttgttgctttttgccttcttgtttttgtcctgcgacgcaacaagaaacccacagtgaagcacgaaggcctggggaatcctgactgtggctccatgcagctgcagctaaggaagcatgaccacaaaaccaataaaaaagatggactgagcacagaagctttcattccacaaactatagaacagatgagcaagagccacacttgtggcttgaaagagtcagaaactgggttcatgttttcagatcctccaggacagaaagttgttatgagaaatgtggccgacaaggagaaagatttattacatgtagataccaggaagagactgagcacaattgatgagctggatgaattattccctagcagggattccaatgtgtttattcagaattttcttgaaagcaaaaaggagtataatagcataggtgtcagtggctttgagatccgctatccagaaaaacaaccagacaaaaaaagtaagaagtcactgataggtggcaaccacagtaaaattgttgtggaacaaaggaagagtgagtattttgaactgaaggcgaaactgcagagttcccctgactacctacaggtccttgaggagcaaacagctttgaacaagatctaggtcatgtaatcttacttcatacagaggacatttatttaatgatgaaagtgccttttgttgacttctaacttccaaatactatattatcaataggcatggaggcaggtgtttccaagggtgtctcattaactgtagctgcaaagatgtgtcaagtagaagagaatttgtttaatagattttactacataaaacctatactgtggagtcctgtggggatactgcaaactctattgccaaagggatgctttatacacataatactgaatttaacctcaagaggcaaatctgttttgtaccccaatgcaaaaccttcgtctctttgtgctttgtaaagcaaactcaagaaaactggtacacctgtaccagctgggtcctttatcttgcacgtagattaagttggtggaactggaataatccttttgatttgtggcattgtaacaactccgtgtaaagattatctgaaaagt

SEQ ID NO: 182035 - DNA, 3074 bp, Homo sapiens
  Payload ID: 15846
  Gene Symbol: SLITRK4
  Gene Name: SLIT and NTRK-like family, member 4
  Uniprot ID: Q8IW52
  ENST ID: ENST00000356928
  CDS Start-End: 94-2607
attccaggagccctccgttctgcggggtgacaattagccaaagattatttctctttattcagaagcatacagttgtttgctgattgcaagaagatgtttctgtggctgtttctgattttgtcagccctgatttcttcgacaaatgcagattctgacatatcggtggaaatttgcaatgtgtgttcctgcgtgtcagttgagaatgtgctctatgtcaactgtgagaaggtttcagtctacagaccaaatcagctgaaaccaccttggtctaatttttatcacctcaatttccaaaataattttttaaatattctgtatccaaatacattcttgaatttttcacatgcagtctccctgcatctggggaataataaactgcagaacattgagggaggagcctttcttgggctcagtgcattaaagcagttgcacttgaacaacaatgaattaaagattctccgagctgacactttccttggcatagagaacttggagtatctccaggctgactacaatttaatcaagtatattgaacgaggagccttcaataagctccacaaactgaaagttctcattcttaatgacaatctgatttcattccttcctgataatattttccgattcgcatctttgacccatctggatatacgagggaacagaatccagaagctcccttatatcggggttctggaacacattggccgtgtcgttgaattgcaactggaagataacccttggaactgtagctgtgatttattgcccttaaaagcttggctggagaacatgccatataacatttacataggagaagctatctgtgaaactcccagtgacttatatggaaggcttttaaaagaaaccaacaaacaagagctatgtcccatgggcaccggcagtgattttgacgtgcgcatcctgcctccatctcagctggaaaatggctacaccactcccaatggtcacactacccaaacatctttacacagattagtaactaaaccaccaaaaacaacaaatccttccaagatctctggaatcgttgcaggcaaagccctctccaaccgcaatctcagtcagattgtgtcttaccaaacaagggtgcctcctctaacaccttgcccggcaccttgcttctgcaaaacacacccttcagatttgggactaagtgtgaactgccaagagaaaaatatacagtctatgtctgaactgataccgaaacctttaaatgcgaagaagctgcacgtcaatggcaatagcatcaaggatgtggacgtatcagacttcactgactttgaaggactggatttgcttcatttaggcagcaatcaaattacagtgattaagggagacgtatttcacaatctcactaatttacgcaggctatatctcaatggcaatcaaattgagagactctatcctgaaatattttcaggtcttcataacctgcagtatctgtatttggaatacaatttgattaaggaaatctcagcaggcacctttgactccatgccaaatttgcagttactgtacttaaacaataatctcctaaagagcctgcctgtttacatcttttccggagcacccttagctagactgaacctgaggaacaacaaattcatgtacctgcctgtcagcggggtccttgatcagttgcaatctcttacacagattgacttggagggcaacccatgggactgtacttgtgacttggtggcattaaagctgtgggtggagaagttgagcgacgggattgttgtgaaagaactgaaatgtgagacgcctgttcagtttgccaacattgaactgaagtccctcaaaaatgaaatcttatgtcccaaacttttaaataagccgtctgcaccattcacaagccctgcacctgccattacattcaccactcctttgggtcccattcgaagtcctcctggtgggccagtgcctctgtctattttaatcttaagtatcttagtggtcctcattttaacggtgtttgttgctttttgccttcttgtttttgtcctgcgacgcaacaagaaacccacagtgaagcacgaaggcctggggaatcctgactgtggctccatgcagctgcagctaaggaagcatgaccacaaaaccaataaaaaagatggactgagcacagaagctttcattccacaaactatagaacagatgagcaagagccacacttgtggcttgaaagagtcagaaactgggttcatgttttcagatcctccaggacagaaagttgttatgagaaatgtggccgacaaggagaaagatttattacatgtagataccaggaagagactgagcacaattgatgagctggatgaattattccctagcagggattccaatgtgtttattcagaattttcttgaaagcaaaaaggagtataatagcataggtgtcagtggctttgagatccgctatccagaaaaacaaccagacaaaaaaagtaagaagtcactgataggtggcaaccacagtaaaattgttgtggaacaaaggaagagtgagtattttgaactgaaggcgaaactgcagagttcccctgactacctacaggtccttgaggagcaaacagctttgaacaagatctaggtcatgtaatcttacttcatacagaggacatttatttaatgatgaaagtgccttttgttgacttctaacttccaaatactatattatcaataggcatggaggcaggtgtttccaagggtgtctcattaactgtagctgcaaagatgtgtcaagtagaagagaatttgtttaatagattttactacataaaacctatactgtggagtcctgtggggatactgcaaactctattgccaaagggatgctttatacacataatactgaatttaacctcaagaggcaaatctgttttgtaccccaatgcaaaaccttcgtctctttgtgctttgtaaagcaaactcaagaaaactggtacacctgtaccagctgggtcctttatcttgcacgtagattaagttggtggaactggaataatccttttgatttgtggcattgtaacaactccgtgtaaagattatctgaaaagt

SEQ ID NO: 182036 - DNA, 8545 bp, Homo sapiens
  Payload ID: 15846
  Gene Symbol: SLITRK4
  Gene Name: SLIT and NTRK-like family, member 4
  Uniprot ID: Q8IW52
  ENST ID: ENST00000596188
  CDS Start-End: 227-2740
gtacaggtctcgggtggctccggctgtcgggccgctgggctgggttgggctttatttttgcaccccactcgcagccactttccgcagacgtggatctgaggctcggggcagtggcccgcgggttggtcggagattgctagcgctcggcaagactaggaataccagaggaagagccgattatttctctttattcagaagcatacagttgtttgctgattgcaagaagatgtttctgtggctgtttctgattttgtcagccctgatttcttcgacaaatgcagattctgacatatcggtggaaatttgcaatgtgtgttcctgcgtgtcagttgagaatgtgctctatgtcaactgtgagaaggtttcagtctacagaccaaatcagctgaaaccaccttggtctaatttttatcacctcaatttccaaaataattttttaaatattctgtatccaaatacattcttgaatttttcacatgcagtctccctgcatctggggaataataaactgcagaacattgagggaggagcctttcttgggctcagtgcattaaagcagttgcacttgaacaacaatgaattaaagattctccgagctgacactttccttggcatagagaacttggagtatctccaggctgactacaatttaatcaagtatattgaacgaggagccttcaataagctccacaaactgaaagttctcattcttaatgacaatctgatttcattccttcctgataatattttccgattcgcatctttgacccatctggatatacgagggaacagaatccagaagctcccttatatcggggttctggaacacattggccgtgtcgttgaattgcaactggaagataacccttggaactgtagctgtgatttattgcccttaaaagcttggctggagaacatgccatataacatttacataggagaagctatctgtgaaactcccagtgacttatatggaaggcttttaaaagaaaccaacaaacaagagctatgtcccatgggcaccggcagtgattttgacgtgcgcatcctgcctccatctcagctggaaaatggctacaccactcccaatggtcacactacccaaacatctttacacagattagtaactaaaccaccaaaaacaacaaatccttccaagatctctggaatcgttgcaggcaaagccctctccaaccgcaatctcagtcagattgtgtcttaccaaacaagggtgcctcctctaacaccttgcccggcaccttgcttctgcaaaacacacccttcagatttgggactaagtgtgaactgccaagagaaaaatatacagtctatgtctgaactgataccgaaacctttaaatgcgaagaagctgcacgtcaatggcaatagcatcaaggatgtggacgtatcagacttcactgactttgaaggactggatttgcttcatttaggcagcaatcaaattacagtgattaagggagacgtatttcacaatctcactaatttacgcaggctatatctcaatggcaatcaaattgagagactctatcctgaaatattttcaggtcttcataacctgcagtatctgtatttggaatacaatttgattaaggaaatctcagcaggcacctttgactccatgccaaatttgcagttactgtacttaaacaataatctcctaaagagcctgcctgtttacatcttttccggagcacccttagctagactgaacctgaggaacaacaaattcatgtacctgcctgtcagcggggtccttgatcagttgcaatctcttacacagattgacttggagggcaacccatgggactgtacttgtgacttggtggcattaaagctgtgggtggagaagttgagcgacgggattgttgtgaaagaactgaaatgtgagacgcctgttcagtttgccaacattgaactgaagtccctcaaaaatgaaatcttatgtcccaaacttttaaataagccgtctgcaccattcacaagccctgcacctgccattacattcaccactcctttgggtcccattcgaagtcctcctggtgggccagtgcctctgtctattttaatcttaagtatcttagtggtcctcattttaacggtgtttgttgctttttgccttcttgtttttgtcctgcgacgcaacaagaaacccacagtgaagcacgaaggcctggggaatcctgactgtggctccatgcagctgcagctaaggaagcatgaccacaaaaccaataaaaaagatggactgagcacagaagctttcattccacaaactatagaacagatgagcaagagccacacttgtggcttgaaagagtcagaaactgggttcatgttttcagatcctccaggacagaaagttgttatgagaaatgtggccgacaaggagaaagatttattacatgtagataccaggaagagactgagcacaattgatgagctggatgaattattccctagcagggattccaatgtgtttattcagaattttcttgaaagcaaaaaggagtataatagcataggtgtcagtggctttgagatccgctatccagaaaaacaaccagacaaaaaaagtaagaagtcactgataggtggcaaccacagtaaaattgttgtggaacaaaggaagagtgagtattttgaactgaaggcgaaactgcagagttcccctgactacctacaggtccttgaggagcaaacagctttgaacaagatctaggtcatgtaatcttacttcatacagaggacatttatttaatgatgaaagtgccttttgttgacttctaacttccaaatactatattatcaataggcatggaggcaggtgtttccaagggtgtctcattaactgtagctgcaaagatgtgtcaagtagaagagaatttgtttaatagattttactacataaaacctatactgtggagtcctgtggggatactgcaaactctattgccaaagggatgctttatacacataatactgaatttaacctcaagaggcaaatctgttttgtaccccaatgcaaaaccttcgtctctttgtgctttgtaaagcaaactcaagaaaactggtacacctgtaccagctgggtcctttatcttgcacgtagattaagttggtggaactggaataatccttttgatttgtggcattgtaacaactccgtgtaaagattatctgaaaagtaaaaaaaaaaaaaaaaaaaaaaaaaaaaaaaaaaaagcatgcaaagagagaacactcgatagtatttgtaaattggtaacctttatggcctgcatcttgaaaccgctggatttataatgttaatttgtgcaaatacttgtttaaaatataacatacattacataactataaaataaatttgaacactttaagcattacctgtctatacataaaaatctaaaagaaaaaatcaacgtgagttagatagcatttgtgatgatctgaagaaatatgtgacgtttatcagaattaaacatggctcaaattaaactaacactagagtttgttctcagttacgtgaaacacccacaatccttcaaggttgtccaaaataagcagagtgcttactgtgtgagcgcacccaaagctatttttgtaacataattcatatttatgaagtactttgtatactaaataggaaaatatgtactccttaatatgtatttaatatgcctgacttgttttcctgatcacagtgaatttatcagtaagtataaatgtagacagaaagaaatatactaaactgaaacaagctggtgtgaacagaaatattctggactttgtgatcaggtgtaacttaaaaacaaaaaaaatttaaaacaaacagaaaagaaaaaaatacaaaagaacagtcaattctgtgctattcttgtgaatttagcgtattatcttcagatttgttaccaattgtgcattcaaaaataagttccttagttttctagtattgtgtctggggcagttgttatttgccatcggttgtcttgcttttcaggattctatgagcttaattcaaatagttttcgctacaagtatttaaaaaataatgaataaggttaatagttatatcttgtatgcatcagtatcctgttctttcatcattcagactactatcagataatctagtagaactgtaaacatcatggtaatcttggctatgaaagccacactgtaaaaatgcttgcattggtttcagatgagttcacagtctgcaactacaaatgatatgcccctgtgtttgcttttgctaagatctaagtcaaaatttgttaaaggaataaagtaactgataatgggtgatgtcggaacttttgtaggagctcccgattaacaaagtgatattcagaaacacattgtcttcttggcctgcctgcatatatatatatagatatatagatatatatagatatacatatatatatatgtgtgtgtgtatatatatatgcgtgtgtatatatatgtgtgtgtatatatatacatatatgtatgtgtgtgtgtatacatatatatatagtgtgtgtgtgtgcatgtgtgagagtgtgtgtcctatctcttataattaccttatgaatcagtaagataaccaagaaggtaaacatagccattcctcatgattgcaagtggcatattttttctgttgcagcttccaaaatgatactatgtttatagttgcagtagctgttcctttattaatcactaatttcagggctttatgtgtttgttgcaagacaaaaaaaagaagcttggctttcttgggtgtgtgtgtatgtgtgtgtgtgtctgagtgtgtgtatatatatatatgtgggtatatattcatacatatagataatttggaaatcttttttaaatagcaaaaaccgtctccatgtgtatgtgctggtgctcttaaaactttagtgtgtaattttaatttttatgacatctgtgaaaactttatatgaatataaaataattcaaacaaataattgctttctgatcttgaaagaaaagacaagatgtgtgcccaacagcttttttcatctacaatttcataaggacttttgatatgccattaccatgcatgcacacatccatggattaaagggctcctaatgtatactgacaggataaagatgcaaaggcttcaaagaaagtgttttagtttagtctgtcaataaagtatggcttgaaggatcttaaatagacacttataggaggaatcagaaagttccattcatggtctggggataataggtcatttgaatgatacttttattcagtgtggtgatgttctgaagatgtttcaaggtttctgcagaattctcaatggcaagagtacctgccaccatctcaaaagcttgctgtagcatattggctatctcatactcttctgctaaaaggtataaatgttcaactttttttaaaaagtaatttaacatatgtggttatttggaggttcaaattgtaaatgaaagtaacaaattcttggttaaggctaatatattttccttaactaaagtcattgtgcctacattatatagtgtatacaattttgcacctgtctctcattagttctagttgtacattttatgataatgtagttaggtataagttttgagttgagtacaagaacagttaaaatactgtatctacattttgttggcttcaactataaccttgatgttagtttaacccctggaggtatgatatgtacatcagtacagcatttttagtggaacttggatgcaaacctataaaatccaagaagtgctcatttctaatgtgggctgacacatcatgggcttcttggcactatagtcatgggtatggactacgttagaatgattgcaaacaaatttagatcttatgaaatcagtgaaggggttgagataatatattgtgtccatgtaatataaatcaagttttaaattatttttttatgaaatcaataaagatgattcaattctttaaaagtaagactttgtgtaattttatgagaaagcagctattaaagtagagtgattcaagtctataaggcaatttatattctatatttagtttttcattctgaatagactgaaaaaatatatgaattagaaatttatttaagaccatctttcttttgttgctttttttaaacatttacttttctttaagccataaggatgcataaattatacagggcatgaccttatgagtaacatcaacaggtatttcagaaataacagaacacgtctagaaatgtatggtggtaatattaatctataacattttttgcatgatttgtacattgacattgtatgaaatgagcacactgaggtttttttgttgttactgtcgcatccaaagagttggggagaaactatattaagaatgtatttataatcactattttaaaataaagtaaaaaaaatattgtattgtttttaccctgatttgattatcagtattttaggttaatttgtaagagaaaaatcaagtaatgctgtaaaagctcatgtaaatcacagaaaagaactgttttaatgacttttgtttgcttttaataacatcaaggtattagaatttattaattgccatttttatgaaagtattaataaaattgtttgctacaatgatatttctgaagccacagtttgttaaatatatttgtctttccattatttttcagaaaaatataaagcagtaaccaaactgatcatttcacccagatttgagggtaagatatagctttagcctactgtttatattcaacttaactgctaaatctctgttaaaaaaaacgctttctttagaaacatattttcaatctgtgttccttcccactggcagcccctttggagaagagtctgacagtgccaagatcaacatgctttgattcttgcccattcttttgaatcagttggattctgacataacttcagataagcaaatactaatattcagtcttaactatctgctcaaatacttttagaaacccttcagtacctctgtattccattgccagtttgcctggttacaggttagttacccacttatggagtgaattgtgatttgtatttggttcttttaaagatgaccaaaattatcaatccatgactttacccaaattattactgttgtggaaaatgaactaattgcattacggttaacttgagggcagaaatgaatgtaactgactatattgaccaatacagtgggtttaaggttcatatatttatggtaagaaaagtaaacacagaaacagagagagagagagaatataaattaagattgttgttgctttacacgtatacataggtatgctgaaggtgtgaacagtatagatagcatatgcaagtacttttagactaaatgccttatgcatctgaggagatacaccgtaggattgtgttattttatttatttatgagtactgagcacagagctttgggttccagccacttctgttatgtagacaagtggcatcaaatcaaggtttggcatcatttctagtgctcatcccattagtcactgtggtcagatgggctgaactaaaataaaatatcctgtttgtggcttcacttacctagaataactggtgacatatatcaagttcacctgataattgttaactctcaatttcagatttcctaaggatctattctttgttaatttaaaagctaatgggaactcaaatgaattttaataacttactttgtacaaaactgcccttaatctaatttggaattttattttgttttatttatttatttatttatttatttaatgtctttttagtttctactggttgataggattgtgttttaaaagggaaaatcgaggaagggaaattgtgttgtttatcttataggaaatgatggttttttttaatttttaaaaattattttaacctgttgttcttatgtctacaaggggaaaataaagtagggctctgaggcatttgaatattttagaccaaataattgctattgagaataaagattcaagcttctcattaatccataattgacatttccactgactgtaggacccagaaccaggagagaattactcaaccctccacttcagtttacttttgtagacactgcctaaatagaaatagaaattctggtgatttcaataacatcaaaaatgacaaattacctgtttaacttaaaaaggtcatgaatgaggccttcagagaaataatattaataatataatgaataaccatagagcagtgcctttaaattagctataggaaggaaatagtcttttcaagtttctgaacaatatatttctcttagttggcacctcacaaatactagatcatgtcagacgctgctggttaatagctgcaggaaggcatgttgtgcagtggatattgctcatggaagtgtgtgaaaatcatagtaagctttgttctccctgctaagacttgctatgtatatttccatcattgtttcatgtaaactgaaccattgtggtaaacttttggagttgatatggaatcactttaatgctgttttcacaaataaaagttttttcttataggtca

SEQ ID NO: 182037 - DNA, 21103 bp, Homo sapiens
  Payload ID: 15847
  Gene Symbol: SLITRK5
  Gene Name: SLIT and NTRK-like family, member 5
  Uniprot ID: O94991
  ENST ID: ENST00000325089
  CDS Start-End: 220-3096
cccggaacccgcggtcgccaccgcggcggcggccccaggctggaggcgtccgggcgcctctttcctccagcctctgggactgcgctgctcgcagtctcctcgccctgcctgggcttgagaaacctagtgcataccccaaagagggtttttgtgtatgtgtgtgtttttaaagggtggctatgatgactgggccttggagatgtgagactgggaggtaaaatgcacacttgctgccccccagtaactttggaacaggaccttcacagaaaaatgcatagctggatgctgcagactctagcgtttgctgtaacatctctcgtcctttcgtgtgcagaaaccatcgattattatggggaaatctgtgacaatgcatgtccttgtgaggaaaaggacggcattttaactgtgagctgtgaaaaccgggggatcatcagtctctctgaaattagccctccccgtttcccaatctaccacctcttgttgtccggaaaccttttgaaccgtctctatcccaatgagtttgtcaattacactggggcttcaattttgcatctaggtagcaatgttatccaggacattgagaccggggctttccatgggctacggggtttgaggagattgcatctaaacaataataaactggaacttctgcgagatgataccttccttggcttggagaacctggagtacctacaggtcgattacaactacatcagcgtcattgaacccaatgcttttgggaaactgcatttgttgcaggtgcttatcctcaatgacaatcttttgtccagtttacccaacaatcttttccgttttgtgcccttaacgcacttggacctccgggggaaccggctgaaacttctgccctacgtggggctcttgcagcacatggataaagttgtggagctacagctggaggaaaacccttggaattgttcttgtgagctgatctctctaaaggattggttggacagcatctcctattcagccctggtgggggatgtagtttgtgagacccccttccgcttacacggaagggacttggacgaggtatccaagcaggaactttgcccaaggagacttatttctgactacgagatgaggccgcagacgcctttgagcaccacggggtatttacacaccaccccggcgtcagtgaattctgtggccacttcttcctctgctgtttacaaaccccctttgaagccccctaaggggactcgccaacccaacaagcccagggtgcgccccacctctcggcagccctctaaggacttgggctacagcaactatggccccagcatcgcctatcagaccaaatccccggtgcctttggagtgtcccaccgcgtgctcttgcaacctgcagatctctgatctgggcctcaacgtaaactgccaggagcgaaagatcgagagcatcgctgaactgcagcccaagccctacaatcccaagaaaatgtatctgacagagaactacatcgctgtcgtgcgcaggacagacttcctggaggccacggggctggacctcctgcacctggggaataaccgcatctcgatgatccaggaccgcgctttcggggatctcaccaacctgaggcgcctctacctgaatggcaacaggatcgagaggctgagcccggagttattctatggcctgcagagcctgcagtatctcttcctccagtacaatctcatccgcgagattcagtctggaacttttgacccggtcccaaacctccagctgctattcttgaataacaacctcctgcaggccatgccctcaggcgtcttctctggcttgaccctcctcaggctaaacctgaggagtaaccacttcacctccttgccagtgagtggagttttggaccagctgaagtcactcatccaaatcgacctgcatgacaatccttgggattgtacctgtgacattgtgggcatgaagctgtgggtggagcagctcaaagtgggcgtcctagtggacgaggtgatctgtaaggcgcccaaaaaattcgctgagaccgacatgcgctccattaagtcggagctgctgtgccctgactattcagatgtagtagtttccacgcccacaccctcctctatccaggtccctgcgaggaccagcgccgtgactcctgcggtccggttgaatagcaccggggcccccgcgagcttgggcgcaggcggaggggcgtcgtcggtgcccttgtctgtgttaattctcagcctcctgctggttttcatcatgtccgtcttcgtggccgccgggctcttcgtgctggtcatgaagcgcaggaagaagaaccagagcgaccacaccagcaccaacaactccgacgtgagctcctttaacatgcagtacagcgtgtacggcggcggcggcggcacgggcggccacccacacgcgcacgtgcatcaccgcgggcccgcgctgcccaaggtgaagacgcccgcgggccacgtgtatgaatacatcccccacccactgggccacatgtgcaaaaaccccatctaccgctcccgagagggcaactccgtagaggattacaaagacctgcacgagctcaaggtcacctacagcagcaaccaccacctgcagcagcagcagcagccgccgccgccaccgcagcagccacagcagcagcccccgccgcagctgcagctgcagcccggggaggaggagaggcgggaaagccaccacttgcggagccccgcctacagcgtcagcaccatcgagccccgggaggacctgctgtcgccggtgcaggacgccgaccgcttttacaggggcattttagaaccagacaaacactgctccaccacccccgccggcaatagcctcccggaatatcccaaattcccgtgcagccccgctgcttacactttctcccccaactatgacctgagacgcccccatcagtatttgcacccgggggcaggggacagcaggctacgggaaccggtgctctacagccccccgagtgctgtctttgtagaacccaaccggaacgaatatctggagttaaaagcaaaactaaacgttgagccggactacctcgaagtgctggaaaaacagaccacgtttagccagttctaaaagcaaagaaactctcttggagcttttgcatttaaaacaaacaagcaagcagacacacacagtgaacacatttgattaattgtgttgtttcaacgtttagggtgaagtgccttggcacgggatttctcagcttcggtggaagatacgaaaagggtgtgcaatttcctttaaaatttacacgtgggaaacatttgtgtaaactgggcacatcactttctcttcttgcgtgtggggcaggtgtggagaagggctttaaggaggccaatttgctgcgcgggtgacctgtgaaaggtcacagtcatttttgtagtggttggaagtgctaagaatggtggatgatggcagagcatagattctactcttcctcttttgcttcctccccctcccccgcccctgccccacctctctttctccccttttaagccatgggtgggtctaactggcttttgtggagaaattagcacaccccaactttaataggaaatttgttctctttttccgcccctctccttctctcctcccctcccctcccttctcattccttttctttgtttttaaaggatgtgtttgtatgcattctggacatttgaattaaaaaaaaagtattgtgatcctgtaaaggatcaccatagatgtggacaaatcattaaaattacagagctatatgatccataattgattagtcaaaataacttattgatgaaatatacaaatattttattgtagcacctatttttatatgcacatttagcattcctctttccttcactatttagcctatgattttgcagaggtgtcacactgtattaggatctgcatttctaaaactgacgtggtatcaggaaggcattttcaatcattcaaaatgtggagaatttaatggctaaatctttaaaagccaatgcaacccacccaattgaatctgcattttcttttaagaaaacagagctgattgtatcccaatgtattttaaaaaatagggcaattgattgggccattccgagagaattgtttgcaagttttgggttttattagaaaatatttgaaagtatttttattaatgaaccaaaatgacatgttcatttgactactattgtagccgattttcgattgtttaaccaaacccagttgcatttgtacagatccacgtgtactggcacctcagaagaccaaatcatggactgtacaagtctctatacaatgtctttatccctgtgggcagcaagcaatgatgataatgacaaacaggatatctgtaagatggggctactgttgttacagtctcatatgtatcccagcacatgtaattttttaaatagtttctgaataaacacttgataactatgtcaaatatgagggatggaagtaatgattacttaaggtgcaaaagacttaactatgtgtgattgatagaatctccatcattaacaatttaggaaatagttcctaaactttattcctaatacaaaatgtgtttcccctaattagcaaaattgtaaagtatatagtatatatatagtatatagtatatatagtatatagtatatatatagtatatagtatatatatagtatatatatagtatatatagtatatatgtatatatatagtatatatagtatatatatagtatatagtatatatatagtatatagtatatatatactatatatagtatatatatatataacatacatgacatatataagtaatttattcctttgttggttcagggaagtatgattttctaaatgtgtcgcttaatgtgtttattaatgcagtttcaattatatacactctttccttactgaagtattcatctactacgtggagcatggtaagtaatatatcgcatattcacttttctcttaatacaatgtaattgtcatatcagtattatttattcagtctacagttttccatagttttcatatttttaatttgtgtaaaactaccttcaacagttatgatggattccttatctaaagttgatcagtattctaaatgctcaaaatggtgtatatgagctcgtcatctttgaataaggttttctagtgagtttagacacaatttaaggataagaaatgtttcaattatgtgcttcattgctataggtggatctccccatagtttcacctggaatttgtacaatatcaagggctgttcatgaactttgtgtttaaagaacaatttccatggcattctgccacaaagaggcagcattcacccatgagaaaattgacagtaactacttgaattcaggttgaacaggtggtaccagtttcccggaggattaaaaaaaaaacaaattgtaatgctacattgaccaagtacagtaagctgttcatattctttgcaacattttcctttctaatttttttttcaaaggggaaaggaataagcttaataatgtcatggtattatcatgaagaaaagtgcattgcttgctcttcatctacctcctctatattagatccaagattagaaaagaaaaaaaaaatactagcatttgacttcaaaattgagattggtattattcttcacagcagcaggaagttatttttttaatgtcagtatcacttcctcaaccttattatatatagatatgacagttttataaattataaaatataaatgtaaagtggaatcctccatgtaacttagttttatttcttaattggtgcataaaataaaaagataagaattacataaaattaatgacttagttctgggcaatataagtaactttcaaagaaagtttagtgatgtatttttcaaagatttacaaaattttattgtaaaaccagcattattttacatcattttgtcacatatactccctttaggtggttcatttctatcttactcttcctaagatgtccaatattttattttaatcttcaaaataacatttatagattgatttttagaagttccccttaatttttatattatattttcccactgtgttaagaaaataaaagtaaattcatcctgactttcataaatgtgaaaaattttttatcatctcagaatcatgaaactgcacagaattaaaaaatgaatcatttttctcctaccaacgtcttcctgctaatacattaactcataaattagaatataggttgtatagtgttgaatatttgatttttgttgatttaagttgctcactgagtagataattggaatgggcatatcagtagtatatgactggagtaagaaaattctcttcacagaattttgaggaagaaaatatgtaatgtttcaggcaccaattaaatttggatgcacactaagcttactctttgtgcttgttcgatttaatatgttgcataaatctcatatatttagaggtagatattacaaaatattatttctatgtctatgtgattataatgtaaatacttaaattatataagaaaaaataaacatattccaagaaaatgtagataatttgaatgctaatataaaaaatcatttacagctaaactattgattgaagttgtaagttaaaccaccttagcatagatagccgacttggaacatgtcttctgtttagtgaagattatcacctttacacatgaaaagtggaaatttttgacaaatttcctgggaactcaagtctgttcctcaccactgtttcctcaatactagtaagaaaatcaaactagtttgtaatgagaacatccacacgtactgtgaaaaaagttaccatttaagaatttaatccaagatcgcagtttctggccttaggtattagttatatttgtgttactaccttgttttgttggcaaaatattcaaattaatattcattattttctttttctattctattatttcttgtttccttacatctgctccttccctcctttctcttttttatcttttttcttcattatttttcaataaggcaagggaaagagtgaacatagtttagtcctagtttgaaatgccaaaatctggctatttaatttgaagagttccatcgatggttcccaaagtcacatgactccagattaatgataacatagcaaatcacaaatattctgtcaattcatttggaaatgtgctcttcttgcacttttcagatggctccaatttaagatatttgcaggcatggcaagatacctggaatgactacttttaagaataaattttacactaagaaaaaggaactaggaacatcaaagcaacagatttaaatactagaaccaggcacagttaattaattaattttcaaagagaataaaatgttgcaaaagtataaactgtaccatattaacagttttatttatgcataagtttctacaaaccctttgagattctccactattgcaaataaatatgtgagaataaaattaaagtagttggatagacattagtcatgtgcctaaaaataattgtctaacatctatatcctcataaactttatatccattgatattgcagctgtacattataattattaatttcaattcaatgtaatgcctttctatgactaaccatatatatttccatgaatatatgtagcatgtatatgacatacaaaaatagatggattatcaaggagttattacacacacatttttcccaagtttttttacattttaatattttcaaggatttcaaattatactcttattttaatgttttaggaatgttagattggggacagaaaatttgatgcagtaaaatttttgaatgtgacaataatacagtacttttcttttcttcctccggttttagcagaccatggcttactagcacaggtcaaatacttctggtgttaattgtactagcattataaaaactgtactagtattaaaagaacaacatttaactccaagtttgagagatttagactatttcctaaaataatttctgaagattaaaatagaaatattttatagaaagttgatgtaatgcaaatataaaataatttgattttttagagatctaaacaaaatgttatgatatattgcacaatgctaagtatgtcagatccatttttattagatgttagtagagtcattttatacaagaaagtaatagtcaagtaatagtcatagagatatgttgaatggaaatcttccactgaggtttttttttttttttttttttggcatctttattagtaatcatgaagaaatattgtacatttctattataaaataaacatgtatatactttaaaatttcatgtttctaaaagtagaagttatgaaccattgttttgaaggatatttttcatttttgttgtttttaattttagtttaacatatgcacagatgacattgtggctttattttgaagactcatttatacctggtccacattgacaaacttatttgcgatttgtatatttaaataattttttcaagatattaacatacaagttcaattctttcttgattgtaatacttcaatatttaatcatatttatattcatatatatttatgcgagcagcaaaattctgtggtttttggtgttctggagtgtacatattttagatttttactgacaaattaatttctactactagtgatcatttctagcattctcaactaacacacttttcaaaaatcttattgtatacttcattaaaaacaatacataataatggatattgaaaccaaaatttctgcatattttcaatttagtacctgcctattgaaacaaaatctgaagggtgtcagtaatcctaggttaactgattagcaaatttcttttaggatactataatactctgactagcatgtttcatgcatgaaaagttcatcggtgatatgcagactacagttttaaatattaaatttaaaaattgatatataaaaatgaaaacttgaccaataaatatatctcacctgtaataatatatttacataaattatccacacaaaaaatatgccttttaactttataaacatagaatattttttgctatattaacatccaaagtcaaaagggtgtatcactctgaaaattctaataatagtgaaagacttatagctatcaaatttatttaaatcctctgttttaatatctactttaaattttcacttcaaaatataaagttaatggtatatatttttttttatatagctgaaatctgcccttgctaaagtttcataagatatacaatacacataatagggttccttcacagttttatttttgtttagcatttaggtaccatatattaaaatatgaagctataaatttccactagttaagttataattatgttttttcaaacaatatacctcaattatataatcatcccaattttttaaagctagtgaccatgagcatatatatgggtgcatccaaatgagaatattgagatccagaaattactaattttagagaatattcaaaatcattcaccagactgtcatttaaacccattcaatcagtataatgatatatttgttacccaattatgatgaaagatccctaattcttagatgaaaatgtagtatttcactggaaattcgttttttgaatgttaaaccataattattgagtatccagattataaattttaaatatcctctccaagattttatatatataatttatatatatatacagaaaattaaagagggtctttctataaaagtaagcattttaggaaatcactaatttcatatggctttcactatgtttgacttgtaatttaacaacaaatttcatcttcctttaagaatttttaccccagagaaggtatttgtttgcatagcatgtacttgagtcatccgttgtcctattattggttttggcctagtctcttcatttagaagctctgtgcccaaggtcagacacatggaaaatggtctctatcattgcctttaattctcacaactgaatcattctaccactgtcccctacctctctgttattttttgaaagaaaaaaaaaagaaggtgatatatctctttattttgctaacaaaagaattttaagaatatcctaaggcaaattcatgacatcccccacattattaaaataaaaatatgactcaatttctaacatggcaatcaagaactatgtaagcaggacttagtgtgaataaggggatggggattttaaattgttactatgaatttgtgattcattagtaattttaaatacacaacatctaaaacataaaggtggcaatttcttttttagtatattttaaattacacacttttgttgacagggtaggtaatatagtttacaaaatgccactattgcctgcttacaaacattaagaaacttggttgccgactgatgactcatgtggtaactcctgaacaatctgttttatttgatcagatcagctttatttcctttaaaaaaaattttgaattcaaatgattttaggctagatgaatagcttccatatttccatattgtcttaacctagaaacttcaaataattttacattaccagctagaccataagtgtattttaactttcaatcatgattaaataaaatttgttcctctaatattaaaatgtatctatcataatcatggatttttagatattgttcttggggagctcagagtttatcaaagctttatatgtgatatacgaggtagtaaatactatgtaggtttatattaaggaaataaaacaaatataataaacacgagaatgaataattttacatgaaaagggggagctggtatgctgtatattaatattgtatttgaaatataaatatatgtgttaaagttaaccatttacagtgacttggagtctcccagagatgaaattactcctgtttaggtgattttgtaaaatgcactatctctcacagcccctggacatcataagggaagtggcagcagtaatttaagaggtatgtgaatacagaagggaaattataattgcagcatacacagaagcttttcctaaactgttcaactgctcatatacttgacaagagtgtaaatggccaattcattggaaatatgtgaaacatcaaatatgagaatcacttttaggatgacaggtataatttggaaaatctgatccgatagaattaagaccaaaacttttttaaatgggagaagacagaatggccatttttttttcaatgtctttgaacaaaataatgagtagaagtaatatattcttcaccattgcttactgtgtccatgagaggttgtttgtaaatagatatatacctacaggaagtaaaagataatgtaatgaaattctcaaactctccaaatatgtttgtttccttttaagattgtttttcttgagacaaaaaactgaaatactatctaaaataattttggattttatttcctctatcctttttataacaaaatgttacttagctttatatattgctattatgtatgtttctatataaatatataataagttggattttttttcactgttgatttggtttagtcatcatcttagctttttgcctcactgaaagtataggttgtgcttcaaatgagaaaataagaggtgcgaagtatttgctgttatttttatcaaatgatagccaatggctaaacattaaaatggtgattctgttattccgaattaagtttctttgtccaccacagattgatggtgtgtctttggcaactttctttgtgtctctgctttaatttcaattgtaaaaatgaatccaatgaacttggtttatgaacagctgaaagaaatttagattttaagttttctctactaggtgtatgacaactgtgactctaaaatcagcaacatgataattaactattactgttatttacattatgcacctatgaaagggatgattatatcttttagagaaaacatctttctcttactgcgtatgtgtctaatatttgtaaaataattagttcaaaacatttaatttctccattaacttttattttacaaaatgaaataattgtttgtagataattaatggcaactttaaaagtatgacacccttgaaaaagaaagaacttactagtttagttttcttgactttcttacatatttttaccttttgaaataacattgagctttcagtacatttaataagatgtatcatcagtatttatttctcaaaaaattgagtaacctttctaaattagataagttttatttgcttattttatttgcttttaacacattttgaagttatgtgtgaggtaatttccattgttccagttttaattcaaacaatactgaacatacttacaatatctaaagatctttggcctttctttgcagaattaattggaaaaggtacaataaatatgcaatatgtcactcaccattttaatattctaaatttagcaattgctcttatacctaatgattaataatataagttgttctagtttcctttatctgctgtggtataaatttggctgttaatccaataataaaactatttatatttttaacattttcaaatatcattactactgctatttactagtctcagtgacaatctgagatcctccttagatgcttagaggaacctttatacagggttataaatagagaattctaatgattaaaatttaaaatggtagcaatgacaagtccactataaacataataaataaatcattaccttctctattaatgaacagaaacttcagtactttaaagctaatatcttgaaagattttagaagtgcagcaagctggtactcacacctaatgaaaaggtcttagtgaaaatcattttacaatttacaacatttgcattgttctttacaaatgttgtttccattccatgcaagacaattaaaccagaattattttgaccacaaatttttcttcctaattaattggccaaacacaatgtaaataaaataggaaatgcttcagttaatatttactatataaacaaacaaacagatagtgggataatggttttatctatcaccatattctagaattgtgcctggcattcagtaagcacctaatggattaacaaatatgtacttgtagatgtctgcagaccaaggtgaatttagtgaatatcaaaaacttcttgagtgctccatcgtaacgccatttatcttgacataaactgcaaagatggctcaaatgtcgataaggatatcaggtgagtgtttagtactttggcatgaaagtttttggaaaaccattgggatgctactagtgatatttaaatatatttatgctaaacacagaaaatattttccaaatggctcccttttagtctatgtttgttttaattaagttcagatagttaagaaaaaaatggaaataggactagagaactttggcataaaactcatttcccagtctttaattgtaattatttattttgctttgatagtataattggttacatttttcaaaaataataagaaaagtaattgttgctgctctgcacttacattactgttttaaagttcagggtatgccctaatggagatgctggtgaaattttcaggcattttcaacgaatatgatcccggtttttttaagtctggtgaggtgtttatctatttagaaagcttttctgggcaccatgtattttcccctgggagtagaaaatcagttcatctttttaatgacaatattacctcgagggaaaaaagtaatccagaaggaataatacattcctcagggcagttgcctacacagggacacatttttctctggggctgactgcacgtatatttcagtggaagagtttaaatattttaagatatgattgcattttgtcataaggcaccatgactaaaggatacagtattttttgaatatatagtaacatatttttataagcttttatacatcaattataatttaggaaattttatttgctatgaaaattttagctgtattcatatttgaggtaaaataaaataattttaactttcaatttgcatgttttgttaaacataacatcagaagaaaggaggcataagtaaagagatatttgagtttcacttatgaacaccaaacagcacaattttagaagtcttttagctattttgatagcaaaatatatattcttcattctttctatccaaactttaaccttgatgagtacttagatgatgaagtatttacttactgtcatcactttgaatactttggagaatgtataatttgagattgtgaaggagtttgactttgtagccacatcttttaattccttaacattatatttaagattcatgtacttcaaagttctgttttcacttcttttgcccattaaaaatattggaatactactaaaaaacctttgtactttaaatacctatttttttattttacaaactcttgtaataattttccttccaaaataagaataaattttatattgaatatataatgttaatacattaagatacattgatattgtgtttgcattataaaatgtatgctcgcagaactacacctatagaaaatagttttgtttcatgagatattaatattatcaaagcatttcaatagcaatctgatgataaatataaaatatagattacatttaagaatactatacttatgtggaataatgaaaaataaatattaagcatcttttcaaagtaactaatataatcagaatgaaaattagatttttttgaatttaggaaagatctttttttcctgttattttctctaatttcttcataccaaatcagttttacacttatttatttaaaattaacttgaatttctgttgattatttttaaacaaaatcattatttgttgtataaaataaaaataataggttgactaattcataaataaactaaatgtagctatttcattgagcatttaaataacatttaaactaaaatcaatcaaaaacacgtcatttaaacaatgaattttctaaattagaactgcaaaaccaattataatgttgggtactaaagatgttttataatatgctgattcatagtaaatacttttaaaaagaaaaatacatagctttttttcctaaaatttgaatctctttttaatacatgaaacatgattttatgaatagtgctaacatgagaacatcagtgtgtctgtctttttaagtgggaatgtggatattcttgtgcatgagtacccacatttatagttgaaattacatttttgtttgttaaattgaaaaatagacaacataacatctagacaactgtgtgaaaaagtaagctctacatattgataatatattacatcataatatattatatcctattataaatagttttgtaaagtgacttggaaaaatacagttccatgtgtattttcagaaatttaaattatttttgttaaaattgaataatgtgtacatctttaacgcaaattttatatggctaaatttctatttggaatgtcttaaagtaaaatcacatcaaaatttagtcattatatgtattatgaataatactataggcaatattacttccagtaccagagaaagaagaaaatattagtttaaagaagtagttttttatttataaataattagaaaaaaacacttgtgtgggtttttcacatggtaaccaagagtagtatgaattttcatactcttccatgtgtactctgggccatagctatgaaaaatttgtaaccatcataataggaacagtgatgtttggtttaattttgctctctattgcatgtactacaaataaagattcttttccatttgaaaatctttctataaaacaagaaatttcccatgcagatgaaatgaggttacagtgaagcaaaggaaactaagattgtaggtattaccaaactaagacaatttataaaattatctatatatctatatataggtgtgtgtgtgtatatatatatatatatatatatatatatatatatttttttttttttttttcaagacagagtcttgctctgttatccaggctggagtgcagtggtgcaatttctgctcaccacagcccccacctcctgagttcaagtaattctcctgcctcagcctcccaagtagctgggattacaggtgcccaccaccatgcccggctaatttttgtatttttagtagagacggggtttcaccatgttggccaggctggtcttgaactcctgacttcaggtgatccacctgccgcggcctcccaaagtgctgaaattacaggcatgtgccactgtgtctggccaaaataataaatcttatgttagctttaaggagttctgaacttagtatctgtcatgtagtaaataaataaacatgataatcttctaggaattttgggtaaataattttaaacaaattcttaatctcactacactataatctgcctcaacgttgttgttagacgtgtataatgaatattagaagtactggacaaaattccatttgatctcattttcttgaaatgagttaagttattgttgttgccacatttttcatctagaagtcattctgtaataaaactctttgtagttgttatcatctggaactgttacactggacctatggtgctataaagaaaatctctattaaaaaatgaaagtcatttcttttaccaaatatttattcagtcgtaaaaaatgtatatccttatattttgactgagtatctctattgatttatagctgaaatgctggaatgagattgtgtattaactaggattagacgcttggagtctcacatttttctcattaaatttttatttattctggatatggaatgttggtacaaacgttcctatatagtgattattcacatgatccatattaacatttttacattattgttggactacatttcatgacatattattacagcgtcaattactataattatatgtgattcaggaatgttaaaatatttatctctgtatctagattgtcctattcctttcatgcactgtatgtaacatagcatgtttatctggtaactcttgtattgcaacaagccagaaggggttggaaactaaagtaaatagagtaaatactcactcaaagttattgaaaggctcttggaaactgcgactctaagcaaaaaaaacatataaggaaagcaattttaccataggttaatgatgtaaacaagagttaagttcctagggcatatttctggtcacgaaaacatcaccaaatttctaaataaagagcaaaacacttctaatactaaacattgaaatgtatgtgaaatatatatatatacatatatatatgaatgattattaaaatcaagtaaaattattttttacccaattatttcagttcagggtctccagtggctgcagcctatcccagaagctcagggtgcaaggcaagaagtaatcgtgggaccaggcgccgtggctctcgcctgtaatcccagcactttgggaggcagaggctggtgaatcacttgaggtcaggggttccagactagcctggccaacatgatgaaacctcatctccactaaaaatacaaatattaattggatgtagtggtacatgcctgtaatcccagctactcgggaggctgaagcttgaacccggaggcagcggttgcagtgagctgagatcgtgatactgcactccagcctgggtgagggagtgagactctaaaaaaaaaaaaaaaaaaaaaaaaaaaaaaaaaaagactaaccatgggcaagacatcgtcccattgcagggtgcactcacacacacccacactcactcacactgggacagtgtagacacaccgatgaacccaacatgcacatctttgggatactagagtaaactggagtgcttagagaaaacccatgagaacataggaagaacttgcataccccacacagacagtggtccctgcagggtttttctgtttgttggttgtttttccttcatcaagtttgtaatgaaacgatgttgaatgataaaatattatttgaggaattgttgtacaaggattttggcatttgtctgtatatggaaatcaaagacattttaaagtgattataaatctttgtacatgttgacaatattcaattcagttaaaggctttatcacggtacattgtgacctctctttaaatggttacattactttgagctctgaaaatttgttatacttacattgttctaattgttcataactaggaattcactgactttgctttaatgtatgctaggaaaactgaagtagataaatcatacttcccctttcagtctccttctctcttttggatttaattttaactcgaggtttattaattacagaagttacactcatgttgctgcaaatgtattttttctagttgttaatttgttcatgacattctgcttgatgatagtaatattatgatgaaggtgcctcagatatcaaaaaagatttcaagtctatagaacgtacctctagctacagagtcacaggatatgtgacagcaatgatattaggggatgctgagctggaaacccaattcagcaccagagacagaaatactgtattttgactcattcatcttacatggaagatgaagcctgccaatcaagtagaaaatgtaggcctccaagacaataactcacctgcctttttgtggtttatatttttcatcttggttaaaaagtgtccattgataggggatttaatcaaaacattaaagaagacataatatagccaccaaatctaattatttccaactactagatatcagagctttaaaaaaattgtttttaactgcatttgcttcatttttcttatgggatattaatagaaaaatggagtgcatttctaacagttgcattttttcatatgtgtggctatgtttatgctgatattagttaaaagttctaaaaacaagcaaagaaaatatacacagttttttggcattgattggttgatataataattatgtatatttacttaatatgcataatttaaaaatgtatatttttatgtatatatatttatacgtatataattacgtatatttacttaatatacataattattactatgagcttgggcaaaaaatgtattttggcattccactgttcagttttaagtcatttattggtacataattcttttatttctacttcaataaatataattaagttttgtgaaagccgtgttctaatgaacaagtaattctttcttttaaaatattccttttaattctaatttaaagtttcttaagtaaaaatatagctcttcaataataatattataatgtgtttctcttctaaaataaacagattttatactcattattttaaaatgtgatcaaaaccacataattgtttttagtcttctgattgggatttttaaaaagaaaattcaaagtttggcattaaatatattttctgtaagataatataactacatatgataaaatgattaagtactctgatagtgtcactatttcaataccattattatctttaacatatgttaaaacactccagtacataactaataaagaggaattcacatggccagcaattttaaactggtgcagcaaacttatcttttgtgtttgcaaacataagagaactgaagaagcaagatgcaaacaatgtctccgttgttcagcatgtgttttatgatataatacattcgttcatgttgtgttatacaaattttgcagggagggttgctcgttttatcaatttgtgtattttttatttcatattttgtacgcaatcatgagcatttttcttataaattgtacacaacaagaacctgttgaagattagaaggaaggagcagcacatacttttagcaatccttttatcttaccaatcactggaagaaaatgatgccaagaagccatgtgagatatcatctctgtctgtcatgttttcagaacagagtgtggcttactaatgttgccattgcaggctatgctttgtcaagtgaatacggttttcatcttaaggggatagtaagcaagatgttagcaatactcactcatcttcagatttcattgtcaaatatactaatatttcaaaaatatggttttcatctagaaaaaaatggagattttgagtgtacaaatatagccaatgcaggttaaatttaaacagagatttttttttaatctctcccttttttatactttttttttttttttttgagacagagtcttgccctgtcacccaggcttcagtgcaatggtgcaatctcgactcactgcaacctccgcctcccaggttctagtgattctcctgcctcagcctcccaagtagctgggattacaggcacgcgctaccacacctggctaatttttgtatctttagtagagacaggtttcaccatgttggtcaggctggtatcgaactcctgacctcatgatccacccgcctcggactcccgaagtgctgggattacaggcataagccaccacacctggcccccttttttatactttttacaagtaatctgacactaggtgccacataattaagataaagacaaaagtgcaaaaccatgtaaaatattgacttctaattgtgaattagtttcccttttctacttgttttgccttgttggatatgaaacatttcaagtatgtcattgtaggattatttttgacattttattcttagaatggtgatttagttgcataattctcatttgctataccacttttctaaaaaataaatgtttgaattattgaaatatcccaagatactccttgttatataattgtagatcattactttattttcagacaaattatgctattgtggataaatattcaatgtataaaatacaggacttcttttttcctgttttacaaaactccagtgccctttcttatctactattttaatattcctttgctatagtatattgcataatgtggagtcaactattttttacaatatgtacgtgttgatctgaaagttcctattgagttaaataatgaaaaataatttggtggaccatgaattttaaatttgttaaaaattgttttatttgtgtatgtgtataaaattaaattttgcaaattggtaaatttattcttcatttaaccttgttgctttgagtactcctaaagcttgtaataattctttggggagtaatataaaatatatcattcataagtgaa

SEQ ID NO: 182038 - DNA, 4318 bp, Homo sapiens
  Payload ID: 15848
  Gene Symbol: SLITRK6
  Gene Name: SLIT and NTRK-like family, member 6
  Uniprot ID: Q9H5Y7
  ENST ID: ENST00000400286
  CDS Start-End: 600-3125
atatgacactggcagattaaaacgctctgatggggaagggcttaaaggctgagtcaaaagccaagaagtctctttatttacgcctacctcccagcccttggcaatctgactaataacaaactgagctaacaagaaatactagaaaaggaggaaggagaacattgctgtagcttggatctacaacctaagaaagcaagagtgatcaatctcagctctgttaaacatcttgtttacttactgcattcagcagcttgcaaatggttaactatatgcaaaaaagtcagcatagctgtgaagtatgccgtgaattttaattgagggaaaaagggacaattgcttcaggatgctctagtatgcactctgcttgaaatattttcaatgaaatgctcagtattctatctttgaccagaggttttaactttatgaagctatgggacttgacaaaaagtgatatttgagaagaaagtacgcagtggttggtgttttcttttttttaataaaggaattgaattactttgaacacctcttccagctgtgcattacagataacgtcaggaagagtctctgctttacagaatcggatttcatcacatgacaacatgaagctgtggattcatctcttttattcatctctccttgcctgtatatctttacactcccaaactccagtgctctcatccagaggctcttgtgattctctttgcaattgtgaggaaaaagatggcacaatgctaataaattgtgaagcaaaaggtatcaagatggtatctgaaataagtgtgccaccatcacgacctttccaactaagcttattaaataacggcttgacgatgcttcacacaaatgacttttctgggcttaccaatgctatttcaatacaccttggatttaacaatattgcagatattgagataggtgcatttaatggccttggcctcctgaaacaacttcatatcaatcacaattctttagaaattcttaaagaggatactttccatggactggaaaacctggaattcctgcaagcagataacaattttatcacagtgattgaaccaagtgcctttagcaagctcaacagactcaaagtgttaattttaaatgacaatgctattgagagtcttcctccaaacatcttccgatttgttcctttaacccatctagatcttcgtggaaatcaattacaaacattgccttatgttggttttctcgaacacattggccgaatattggatcttcagttggaggacaacaaatgggcctgcaattgtgacttattgcagttaaaaacttggttggagaacatgcctccacagtctataattggtgatgttgtctgcaacagccctccattttttaaaggaagtatactcagtagactaaagaaggaatctatttgccctactccaccagtgtatgaagaacatgaggatccttcaggatcattacatctggcagcaacatcttcaataaatgatagtcgcatgtcaactaagaccacgtccattctaaaactacccaccaaagcaccaggtttgataccttatattacaaagccatccactcaacttccaggaccttactgccctattccttgtaactgcaaagtcctatccccatcaggacttctaatacattgtcaggagcgcaacattgaaagcttatcagatctgagacctcctccgcaaaatcctagaaagctcattctagcgggaaatattattcacagtttaatgaagtctgatctagtggaatatttcactttggaaatgcttcacttgggaaacaatcgtattgaagttcttgaagaaggatcgtttatgaacctaacgagattacaaaaactctatctaaatggtaaccacctgaccaaattaagtaaaggcatgttccttggtctccataatcttgaatacttatatcttgaatacaatgccattaaggaaatactgccaggaacctttaatccaatgcctaaacttaaagtcctgtatttaaataacaacctcctccaagttttaccaccacatattttttcaggggttcctctaactaaggtaaatcttaaaacaaaccagtttacccatctacctgtaagtaatattttggatgatcttgatttgctaacccagattgaccttgaggataacccctgggactgctcctgtgacctggttggactgcagcaatggatacaaaagttaagcaagaacacagtgacagatgacatcctctgcacttcccccgggcatctcgacaaaaaggaattgaaagccctaaatagtgaaattctctgtccaggtttagtaaataacccatccatgccaacacagactagttaccttatggtcaccactcctgcaacaacaacaaatacggctgatactattttacgatctcttacggacgctgtgccactgtctgttctaatattgggacttctgattatgttcatcactattgttttctgtgctgcagggatagtggttcttgttcttcaccgcaggagaagatacaaaaagaaacaagtagatgagcaaatgagagacaacagtcctgtgcatcttcagtacagcatgtatggccataaaaccactcatcacactactgaaagaccctctgcctcactctatgaacagcacatggtgagccccatggttcatgtctatagaagtccatcctttggtccaaagcatctggaagaggaagaagagaggaatgagaaagaaggaagtgatgcaaaacatctccaaagaagtcttttggaacaggaaaatcattcaccactcacagggtcaaatatgaaatacaaaaccacgaaccaatcaacagaatttttatccttccaagatgccagctcattgtacagaaacattttagaaaaagaaagggaacttcagcaactgggaatcacagaatacctaaggaaaaacattgctcagctccagcctgatatggaggcacattatcctggagcccacgaagagctgaagttaatggaaacattaatgtactcacgtccaaggaaggtattagtggaacagacaaaaaatgagtattttgaacttaaagctaatttacatgctgaacctgactatttagaagtcctggagcagcaaacatagatggagagtttgagggctttcgcagaaatgctgtgattctgttttaagtccataccttgtaaataagtgccttacgtgagtgtgtcatcaatcagaacctaagcacagcagtaaactatggggaaaaaaaaagaagaagaaaaagaaactcagggatcactgggagaagccatggcattatcttcaggcaatttagtctgtcccaaataaaataaatccttgcatgtaaatcattcaaggattatagtaatatttcatatactgaaaagtgtctcataggagtcctcttgcacatctaaaaaggctgaacatttaagtatcccgaattttcttgaattgctttccctatagattaattacaattggatttcatcatttaaaaaccatacttgtatatgtagttataatatgtaaggaatacattgtttataaccagtatgtacttcaaaaatgtgtattgtcaaacatacctaactttcttgcaataaatgcaaaagaaactggaacttgacaattataaatagtaatagtgaagaaaaaatagaaaggttgcaattatataggccatgggtggctcaaaactttgaacatttgagcttaaacaaatgccactctcatgcattctaaattaaaaagttaaaatgattaatagttcaggtggaagaaataagcatactttttgggttttctacacattttgtgtagacaattttaatgtcagtgctgctgtgaactaaagtatgtcatttatgctcaaagtttaattcttcttcttgggatattttaaaaatgctactgagattctgctgtaaatatgactagagaatatattgggtttgctttatttcataggcttaattctttgtaaatctgaatgaccataatagaaatacatttcttgtggcaagtaattcacagttgtaaagtaaataggaaaaattattttatttttattgatgtacattgatagatgccataaatcagtagcaaaaggcacttctaaaggtaagtggtttaagttgcctcaagagagggacaatgtagctttattttacaagaaggcatagttagatttctatgaaatatttattctgtacagttttatatagttttggttcacaaaagtaattattcttgggtgcctttcaagaaaattaaaaatactactcactacaataaaactaaaatgaaaa

SEQ ID NO: 182039 - DNA, 7925 bp, Homo sapiens
  Payload ID: 15849
  Gene Symbol: SLIT1
  Gene Name: slit guidance ligand 1
  Uniprot ID: O75093
  ENST ID: ENST00000266058
  CDS Start-End: 247-4851
gggagacgcaggcggcgaaacggcagaggagccgagccccctccgcccaaggcgccctccctccgtccgcgcacaggcgccgtcgcttggaggagcaaggtgcctcccagcccgcaggggcgccgcgcgcaagcccgcgggctcttcggtggctctgccccgggactgcacctggaggcggccccggacggggatggtcagcggctgctgccgtctggctcgcgagcgggacgctgtgagggcaccatggcgctgactcccgggtgggggtcctcggcggggccggtccggccggagctctggctgctgctgtgggcagccgcgtggcgcctgggtgcctcggcgtgccccgccctctgcacctgcaccggaaccacggtggactgccacggcacggggctgcaggccattcccaagaatatacctcggaacaccgagcgcctggaactcaatggcaacaacatcactcggatccataagaatgactttgcggggctcaagcagctgcgggtgctgcagctgatggagaaccagattggagcagtggaacgtggtgcttttgatgacatgaaggagctggagcggctgcgactgaaccgaaaccagctgcacatgttaccggaactgctgttccagaacaaccaggctttgtcaagactggacttgagtgagaacgccatccaggccatccccaggaaagcttttcggggagctacggaccttaaaaatttacagctggacaagaaccagatcagctgcattgaggaaggggccttccgtgctctgcgggggctggaggtgctgaccctgaacaacaacaatatcaccaccatccccgtgtccagcttcaaccatatgcccaagctacggaccttccgcctgcactccaaccacctgttttgcgactgccacctggcctggctctcgcagtggctgaggcagcggccaaccatcgggctcttcacccagtgctcgggcccagccagcctgcgtggcctcaatgtggcagaggtccagaagagtgagttcagctgctcaggccagggagaagcggggcgcgtgcccacctgcaccctgtcctccggctcctgcccggccatgtgcacctgcagcaatggcatcgtggactgtcgtggaaaaggcctcactgccatcccggccaacctgcccgagaccatgacggagatacgcctggagctgaacggcatcaagtccatccctcctggagccttctcaccctacagaaagctacggaggatagacctgagcaacaatcagatcgctgagattgcacccgacgccttccagggcctccgctccctgaactcgctggtcctctatggaaacaagatcacagacctcccccgtggtgtgtttggaggcctatacaccctacagctcctgctcctgaatgccaacaagatcaactgcatccggcccgatgccttccaggacctgcagaacctctcactgctctccctgtatgacaacaagatccagagcctcgccaagggcactttcacctccctgcgggccatccagactctgcacctggcgcagaaccctttcatttgcgactgtaacctcaagtggctggcagacttcctgcgcaccaatcccatcgagacgagtggtgcccgctgtgccagtccccggcgcctcgccaacaagcgcatcgggcagatcaagagcaagaagttccggtgctcagccaaagagcagtacttcattccaggcacggaggattaccagctgaacagcgagtgcaacagcgacgtggtctgtccccacaagtgccgctgtgaggccaacgtggtggagtgctccagcctgaagctcaccaagatccctgagcgcatcccccagtccacggcagaactgcgattgaataacaatgagatttccatcctggaggccactgggatgtttaaaaaacttacacatctgaagaaaatcaatctgagcaacaacaaggtgtcagaaattgaagatggggccttcgagggcgcagcctctgtgagcgagctgcacctaactgccaaccagctggagtccatccggagcggcatgttccggggtctggatggcttgaggaccctaatgctgcggaacaaccgcatcagctgcatccacaacgacagcttcacgggcctgcgcaacgtccggctcctctcgctctacgacaaccagatcaccaccgtatccccaggagccttcgacaccctccagtccctctccacactgaatctcctggccaaccctttcaactgcaactgccagctggcctggctaggaggctggctacggaagcgcaagatcgtgacggggaacccgcgatgccagaaccctgactttttgcggcagattcccctgcaggacgtggccttccctgacttcaggtgtgaggaaggccaggaggaggggggctgcctgccccgcccacagtgcccacaggagtgcgcctgcctggacaccgtggtccgatgcagcaacaagcacctgcgggccctgcccaagggcattcccaagaatgtcacagaactctatttggacgggaaccagttcacgctggttccgggacagctgtctaccttcaagtacctgcagctcgtggacctgagcaacaacaagatcagttccttaagcaattcctccttcaccaacatgagccagctgaccactctgatcctcagctacaatgccctgcagtgcatcccgcctttggccttccagggactccgctccctgcgcctgctgtctctccacggcaatgacatctccaccctccaagagggcatctttgcagacgtgacctccctgtctcacctggccattggtgccaaccccctatactgtgactgccacctccgctggctgtccagctgggtgaagactggctacaaggaaccgggcattgctcgttgtgctgggccccaggacatggagggcaagctgctcctcaccacgcctgccaagaagtttgaatgccaaggtcctccaacgctggctgtccaggccaagtgtgatctctgcttgtccagtccgtgccagaaccagggcacctgccacaacgacccccttgaggtgtacaggtgcgcctgccccagcggctataagggtcgagactgtgaggtgtccctggacagctgttccagtggcccctgtgaaaatgggggcacctgccatgcacaggagggcgaggatgccccgttcacgtgctcctgtcccaccggctttgaaggaccaacctgtggggtgaacacagatgactgtgtggatcatgcctgtgccaatgggggcgtctgtgtggatggtgtgggcaactacacctgccagtgccccctgcagtatgagggaaaggcctgtgagcagctggtggacttgtgctctccggatctgaacccatgtcaacacgaggcccagtgtgtgggcaccccggatgggcccaggtgtgagtgcatgccaggttatgcaggtgacaactgcagtgagaaccaggatgactgcagggaccaccgctgccagaatggggcccagtgtatggatgaagtcaacagctactcctgcctctgtgctgagggctacagtggacagctctgtgagatccctccccatctgcctgcccccaagagcccctgtgaggggactgagtgccagaatggggccaactgtgtggaccagggcaacaggcctgtgtgccagtgcctcccaggcttcggtggccctgagtgtgagaagttgctcagtgtcaactttgtggatcgggacacttacctgcagttcactgacctgcaaaactggccacgggccaacatcacgttgcaggtctccacggcagaggacaatgggatccttctgtacaacggggacaacgaccacattgcagttgagctgtaccagggccatgtgcgtgtcagctacgacccaggcagctaccccagctctgccatctacagtgctgagacgatcaacgatgggcaattccacaccgttgagctggttgcctttgaccagatggtgaatctctccattgatggcgggagccccatgaccatggacaactttggcaaacattacacgctcaacagcgaggcgccactctatgtgggagggatgcccgtggatgtcaactcagctgccttccgcctgtggcagatcctcaacggcaccggcttccacggttgcatccgaaacctgtacatcaacaacgagctgcaggacttcaccaagacgcagatgaagccaggcgtggtgccaggctgcgaaccctgccgcaagctctactgcctgcatggcatctgccagcccaatgccaccccagggcccatgtgccactgcgaggctggctgggtgggcctgcactgtgaccagcccgctgacggcccctgccatggccacaagtgtgtccatgggcaatgcgtgcccctcgacgctctttcctacagctgccagtgccaggatgggtactcgggggcactgtgcaaccaggccggggccctggcagagccctgcagaggcctgcagtgcctgcatggccactgccaggcctcaggcaccaagggggcacactgtgtgtgtgaccccggcttttcgggcgagctgtgtgagcaagagtccgagtgccggggggaccctgtccgggactttcaccaggtccagaggggctatgccatctgccagaccacgcgccccctgtcatgggtggagtgccggggctcgtgcccaggccagggctgctgccagggccttcggctgaagcggaggaagttcacctttgagtgcagcgatgggacctcttttgccgaggaggtggaaaagcccaccaagtgtggctgtgccctctgcgcatagcgctgggcgtggacaggccggtgagggcgggcaaggggccccagccgctgcagcagcggagacagtcgccagcagctgggctggggtgcaggtcatcacaggacggctcctgggcagctgggccctcctgggtggggtggtgccagagcagccttttaaaagcaaattgcgccatagctgggggcagcgggggtgggcgaggcctgagctgcgggctgccctctccggaagtgccttgcacaaataggcgcttaataaatatttgttgagtgaatgtgtgcgtgaggtcaggccaagaagtgcagaacgatgacacccctccttacctgctatctgaatctggagaagaaaaatgacagccttccaaaccaacccttccctttggcctgtggcccaggctggcttggaactgggtctgtggccccagaagcctcttacccctctgcgggcaaccatgaagtactgtcagcctccccgggaagccagcctggttcattctgctgctacagaatctgctggtggtaggccaggctctggagcgggggtgccgcctcctgctggccagggagggtcggacccttgccccctgggctgactggcagctctgcagccacggcttgggaacgaggctgtgggtggaggtggttcttaggaccaggcctctgaatcctaaagttctagcatgactactgtagctgcgagggcttatgtggaggaaacagtcacaggggctgctcagggtggcagaccccactaaagagggcagagggttctttgctctagataaacaaacatcatctgcctccagacactggccacagtaggagtattggtcctgggcttccccagccaccagtcagccacaagctgtcggtgacctattggtagagggactgggtgtgagggtctgggccagggtgcttgacctgggagcagctggttcagagtccttcacaccgcaggccagtagggagcagtggaagggacagtgctccaggcattgggaagtccctgctggctctatcactcggggcaaacttctccccacctgggccttgggttcttcagctataaaatggccagaggtggggggcgggatgactaaaggaacagtgcagactcccccactgtggtcttgggaggccagaggagttagaagacctatctatctatctatctatctacattgatcacatcaaaagtatttatgtgcctaacccggggctggggattgtggacgttctggcctaatggacagatgtgaactcatcccagagcatcgcaggaatgaccaggatgcccgggaagagttgagctgagtgggggctccagccacagacagcggcccaggccagggagttgctggcaacgaaggagccagtggtggaagaagaagaggccctgaatatacgattgcctgcccacgttgtcttctcttccatacacagtgaaaatgtagaaagatggtttgtgaggccaaactgtgaatgggctaaagggaggcaaagttgcactctccttccccagagggctcaccaagagggcacacccccgggggttctggtgggcaacgggggtgagcatgtccctgccctggctccctccatctgtgaccaggaggcatggctgggtgtatgttcaggtgaggctcagagtggcattgtgtccctgtcccctgcccagggcagtgaggggagcccttgatgctgattagaaggctagaactggggtagaggtgcctggcatgtctcatgccatggggactcaatctagcaactgtgagtcctggggtccctgtgatgggaagagggcagtgccctgcccaatgtggcaggtgtcctcatggcaggatctgcccctcaccagggggctgggatctacttgcttggagctctgagcaaggccacaatgcccgcccccacccccaagtagactgcagcctgggcctcatggggcttctcccaggcccacatggcatccctctctgagtttccaggccaccgtgggaccctgcagagcatctgcaccgggctggatagggcagaaaagctcaagggcagctagcttgcctcttccctggaagaaaggtgctctgggactcaccaaccctgagaaagatagctttcctggccaccaccattccccaccaccctggagaagccaattcccaggcttgaagggcactggctggcaggaggcctcttcattctgcaggaggtggaaaggacacctgtagacaggtgatgctcacccctcacctggcgccatggggctgggaggtgagcggctggcatgtttgttcctagggagcaccatgtgagcttaaggctcccctgaccggccccaccacatggcccagcctcctagcacagcagcgctgacctcagtgcagtctgaggattggaatccaccatgagatgatgtgagagctgtgtgccccaggatcaactttttctccaacttggccatcagccagcgagttgctaaggacctgagtcagcactcacgttgcctattcacactccgcttgaaagtccggaaggtggctactgcaaaatcacccctctgagaagtcctctctccacatcttgtccccctttgtgaagacccctagttcgctctgcattttaggcatgaagagatacagcagggtgcgtccggagggagctgtggccttgcaacaccactggcaacagggccggggctcccggtgaaggtgtcaggaagtggaaaaggctggactttgtctcctctttgcctgctggtagcctaaccgcaaaagtatctctttatacagaatacttacagattctaatatatatttgtatttcattttgttacagtatttttatatgttaaagtcaacatccagcgtcttgttttgcctttcagatgctatgtggtcgtggcacgttttgttgggggtttctgtagtcgtcttgtttggatcaactcctagaggctggtttagaacaggcccatgagggagctgcacctgccctggaagtattgttttagactatgtcgatattgtctgttgtcttccatgtgaacatgacattgagtcactctgc

SEQ ID NO: 182040 - DNA, 2345 bp, Homo sapiens
  Payload ID: 15849
  Gene Symbol: SLIT1
  Gene Name: slit guidance ligand 1
  ENST ID: ENST00000314867
  CDS Start-End: 1-2345
ctctggctgctgctgtgggcagccgcgtggcgcctgggtgcctcggcgtgccccgccctctgcacctgcaccggaaccacggtggactgccacggcacggggctgcaggccattcccaagaatatacctcggaacaccgagcgcctggaactcaatggcaacaacatcactcggatccataagaatgactttgcggggctcaagcagctgcgggtgctgcagctgatggagaaccagattggagcagtggaacgtggtgcttttgatgacatgaaggagctggagcggctgcgactgaaccgaaaccagctgcacatgttaccggaactgctgttccagaacaaccaggctttgtcaagactggacttgagtgagaacgccatccaggccatccccaggaaagcttttcggggagctacggaccttaaaaatttacagctggacaagaaccagatcagctgcattgaggaaggggccttccgtgctctgcgggggctggaggtgctgaccctgaacaacaacaatatcaccaccatccccgtgtccagcttcaaccatatgcccaagctacggaccttccgcctgcactccaaccacctgttttgcgactgccacctggcctggctctcgcagtggctgaggcagcggccaaccatcgggctcttcacccagtgctcgggcccagccagcctgcgtggcctcaatgtggcagaggtccagaagagtgagttcagctgctcaggccagggagaagcggggcgcgtgcccacctgcaccctgtcctccggctcctgcccggccatgtgcacctgcagcaatggcatcgtggactgtcgtggaaaaggcctcactgccatcccggccaacctgcccgagaccatgacggagatacgcctggagctgaacggcatcaagtccatccctcctggagccttctcaccctacagaaagctacggaggatatgccccctctccttctgctcaccttgcagagacctgagcaacaatcagatcgctgagattgcacccgacgccttccagggcctccgctccctgaactcgctggtcctctatggaaacaagatcacagacctcccccgtggtgtgtttggaggcctatacaccctacagctcctgctcctgaatgccaacaagatcaactgcatccggcccgatgccttccaggacctgcagaacctctcactgctctccctgtatgacaacaagatccagagcctcgccaagggcactttcacctccctgcgggccatccagactctgcacctggcgcagaaccctttcatttgcgactgtaacctcaagtggctggcagacttcctgcgcaccaatcccatcgagacgagtggtgcccgctgtgccagtccccggcgcctcgccaacaagcgcatcgggcagatcaagagcaagaagttccggtgctcagccaaagagcagtacttcattccaggcacggaggattaccagctgaacagcgagtgcaacagcgacgtggtctgtccccacaagtgccgctgtgaggccaacgtggtggagtgctccagcctgaagctcaccaagatccctgagcgcatcccccagtccacggcagaactgcgattgaataacaatgagatttccatcctggaggccactgggatgtttaaaaaacttacacatctgaagaaaatcaatctgagcaacaacaaggtgtcagaaattgaagatggggccttcgagggcgcagcctctgtgagcgagctgcacctaactgccaaccagctggagtccatccggagcggcatgttccggggtctggatggcttgaggaccctaatgctgcggaacaaccgcatcagctgcatccacaacgacagcttcacgggcctgcgcaacgtccggctcctctcgctctacgacaaccagatcaccaccgtatccccaggagccttcgacaccctccagtccctctccacactgaatctcctggccaaccctttcaactgcaactgccagctggcctggctaggaggctggctacggaagcgcaagatcgtgacggggaacccgcgatgccagaaccctgactttttgcggcagattcccctgcaggacgtggccttccctgacttcaggtgtgaggaaggccaggaggaggggggctgcctgccccgcccacagtgcccacaggagtgcgcctgcctggacaccgtggtccgatgcagcaacaagcacctgcgggccctgcccaagggcattcccaagaatgtcacagaactctatttggacgggaaccagttcacgctggttccgggacagctgtctaccttcaagtacctgcagctcgt

SEQ ID NO: 182041 - DNA, 1695 bp, Homo sapiens
  Payload ID: 15849
  Gene Symbol: SLIT1
  Gene Name: slit guidance ligand 1
  ENST ID: ENST00000371041
  CDS Start-End: 247-1476
gggagacgcaggcggcgaaacggcagaggagccgagccccctccgcccaaggcgccctccctccgtccgcgcacaggcgccgtcgcttggaggagcaaggtgcctcccagcccgcaggggcgccgcgcgcaagcccgcgggctcttcggtggctctgccccgggactgcacctggaggcggccccggacggggatggtcagcggctgctgccgtctggctcgcgagcgggacgctgtgagggcaccatggcgctgactcccgggtgggggtcctcggcggggccggtccggccggagctctggctgctgctgtgggcagccgcgtggcgcctgggtgcctcggcgtgccccgccctctgcacctgcaccggaaccacggtggactgccacggcacggggctgcaggccattcccaagaatatacctcggaacaccgagcgcctggaactcaatggcaacaacatcactcggatccataagaatgactttgcggggctcaagcagctgcgggtgctgcagctgatggagaaccagattggagcagtggaacgtggtgcttttgatgacatgaaggagctggagcggctgcgactgaaccgaaaccagctgcacatgttaccggaactgctgttccagaacaaccaggctttgtcaagactggacttgagtgagaacgccatccaggccatccccaggaaagcttttcggggagctacggaccttaaaaatttacagctggacaagaaccagatcagctgcattgaggaaggggccttccgtgctctgcgggggctggaggtgctgaccctgaacaacaacaatatcaccaccatccccgtgtccagcttcaaccatatgcccaagctacggaccttccgcctgcactccaaccacctgttttgcgactgccacctggcctggctctcgcagtggctgaggcagcggccaaccatcgggctcttcacccagtgctcgggcccagccagcctgcgtggcctcaatgtggcagaggtccagaagagtgagttcagctgctcaggccagggagaagcggggcgcgtgcccacctgcaccctgtcctccggctcctgcccggccatgtgcacctgcagcaatggcatcgtggactgtcgtggaaaaggcctcactgccatcccggccaacctgcccgagaccatgacggagatacgcctggagctgaacggcatcaagtccatccctcctggagccttctcaccctacagaaagctacggaggatagacctgagcaacaatcagatcgctgagattgcacccgacgccttccagggcctccgctccctgaactcgctccacactggccccgtcacctgtccacacacgacaggcacacacagctcccactgcagggcctttgctgttgctgtgcctcactccaggaatgaccttgaagccatgtttgaagaggaagtacccaggattttttactcagcttgaacgtttacgagggtagcttgtggggtccgattatgatattgggaatggcatacaacccccctccccaaacctcctggatgttttcactgtcctcctgaacccacccatgtctacatgtgtttttttgaacttttgtttttttaaaaaacctatacatggaattcatgctcaatgcagaaaactttgaaaatgctaaagtataaaaaaaaaatgcttgaa

SEQ ID NO: 182042 - DNA, 4564 bp, Homo sapiens
  Payload ID: 15849
  Gene Symbol: SLIT1
  Gene Name: slit guidance ligand 1
  ENST ID: ENST00000371070
  CDS Start-End: 85-4470
ggactgcacctggaggcggccccggacggggatggtcagcggctgctgccgtctggctcgcgagcgggacgctgtgagggcaccatggcgctgactcccgggtgggggtcctcggcggggccggtccggccggagctctggctgctgctgtgggcagccgcgtggcgcctgggtgcctcggcgtgccccgccctctgcacctgcaccggaaccacggtggactgccacggcacggggctgcaggccattcccaagaatatacctcggaacaccgagcgcctggaactcaatggcaacaacatcactcggatccataagaatgactttgcggggctcaagcagctgcgggtgctgcagctgatggagaaccagattggagcagtggaacgtggtgcttttgatgacatgaaggagctggagcggctgcgactgaaccgaaaccagctgcacatgttaccggaactgctgttccagaacaaccaggctttgtcaagactggacttgagtgagaacgccatccaggccatccccaggaaagcttttcggggagctacggaccttaaaaatttacagctggacaagaaccagatcagctgcattgaggaaggggccttccgtgctctgcgggggctggaggtgctgaccctgaacaacaacaatatcaccaccatccccgtgtccagcttcaaccatatgcccaagctacggaccttccgcctgcactccaaccacctgttttgcgactgccacctggcctggctctcgcagtggctgaggcagcggccaaccatcgggctcttcacccagtgctcgggcccagccagcctgcgtggcctcaatgtggcagaggtccagaagagtgagttcagctgctcaggccagggagaagcggggcgcgtgcccacctgcaccctgtcctccggctcctgcccggccatgtgcacctgcagcaatggcatcgtggactgtcgtggaaaaggcctcactgccatcccggccaacctgcccgagaccatgacggagatacgcctggagctgaacggcatcaagtccatccctcctggagccttctcaccctacagaaagctacggaggatagacctgagcaacaatcagatcgctgagattgcacccgacgccttccagggcctccgctccctgaactcgctggtcctctatggaaacaagatcacagacctcccccgtggtgtgtttggaggcctatacaccctacagctcctgctcctgaatgccaacaagatcaactgcatccggcccgatgccttccaggacctgcagaacctctcactgctctccctgtatgacaacaagatccagagcctcgccaagggcactttcacctccctgcgggccatccagactctgcacctggcgcagaaccctttcatttgcgactgtaacctcaagtggctggcagacttcctgcgcaccaatcccatcgagacgagtggtgcccgctgtgccagtccccggcgcctcgccaacaagcgcatcgggcagatcaagagcaagaagttccggtgctcagccaaagagcagtacttcattccaggcacggaggattaccagctgaacagcgagtgcaacagcgacgtggtctgtccccacaagtgccgctgtgaggccaacgtggtggagtgctccagcctgaagctcaccaagatccctgagcgcatcccccagtccacggcagaactgcgattgaataacaatgagatttccatcctggaggccactgggatgtttaaaaaacttacacatctgaagaaaatcaatctgagcaacaacaaggtgtcagaaattgaagatggggccttcgagggcgcagcctctgtgagcgagctgcacctaactgccaaccagctggagtccatccggagcggcatgttccggggtctggatggcttgaggaccctaatgctgcggaacaaccgcatcagctgcatccacaacgacagcttcacgggcctgcgcaacgtccggctcctctcgctctacgacaaccagatcaccaccgtatccccaggagccttcgacaccctccagtccctctccacactgaatctcctggccaaccctttcaactgcaactgccagctggcctggctaggaggctggctacggaagcgcaagatcgtgacggggaacccgcgatgccagaaccctgactttttgcggcagattcccctgcaggacgtggccttccctgacttcaggtgtgaggaaggccaggaggaggggggctgcctgccccgcccacagtgcccacaggagtgcgcctgcctggacaccgtggtccgatgcagcaacaagcacctgcgggccctgcccaagggcattcccaagaatgtcacagaactctatttggacgggaaccagttcacgctggttccgggacagctgtctaccttcaagtacctgcagctcgtggacctgagcaacaacaagatcagttccttaagcaattcctccttcaccaacatgagccagctgaccactctgatcctcagctacaatgccctgcagtgcatcccgcctttggccttccagggactccgctccctgcgcctgctgtctctccacggcaatgacatctccaccctccaagagggcatctttgcagacgtgacctccctgtctcacctggccattggtgccaaccccctatactgtgactgccacctccgctggctgtccagctgggtgaagactggctacaaggaaccgggcattgctcgttgtgctgggccccaggacatggagggcaagctgctcctcaccacgcctgccaagaagtttgaatgccaaggtcctccaacgctggctgtccaggccaagtgtgatctctgcttgtccagtccgtgccagaaccagggcacctgccacaacgacccccttgaggtgtacaggtgcgcctgccccagcggctataagggtcgagactgtgaggtgtccctggacagctgttccagtggcccctgtgaaaatgggggcacctgccatgcacaggagggcgaggatgccccgttcacgtgctcctgtcccaccggctttgaaggaccaacctgtggggtgaacacagatgactgtgtggatcatgcctgtgccaatgggggcgtctgtgtggatggtgtgggcaactacacctgccagtgccccctgcagtatgagggaaaggcctgtgagcagctggtggacttgtgctctccggatctgaacccatgtcaacacgaggcccagtgtgtgggcaccccggatgggcccaggtgtgagtgcatgccaggttatgcaggtgacaactgcagtgagaaccaggatgactgcagggaccaccgctgccagaatggggcccagtgtatggatgaagtcaacagctactcctgcctctgtgctgagggctacagtggacagctctgtgagatccctccccatctgcctgcccccaagagcccctgtgaggggactgagtgccagaatggggccaactgtgtggaccagggcaacaggcctgtgtgccagtgcctcccaggcttcggtggccctgagtgtgagaagttgctcagtgtcaactttgtggatcgggacacttacctgcagttcactgacctgcaaaactggccacgggccaacatcacgttgcaggtctccacggcagaggacaatgggatccttctgtacaacggggacaacgaccacattgcagttgagctgtaccagggccatgtgcgtgtcagctacgacccaggcagctaccccagctctgccatctacagtgctgagacgatcaacgatgggcaattccacaccgttgagctggttgcctttgaccagatggtgaatctctccattgatggcgggagccccatgaccatggacaactttggcaaacattacacgctcaacagcgaggcgccactctatgtgggagggatgcccgtggatgtcaactcagctgccttccgcctgtggcagatcctcaacggcaccggcttccacggttgcatccgaaacctgtacatcaacaacgagctgcaggacttcaccaagacgcagatgaagccaggcgtggtgccaggctgcgaaccctgccgcaagctctactgcctgcatggcatctgccagcccaatgccaccccagggcccatgtgccactgcgaggctggctgggtgggcctgcactgtgaccagcccgctgacggcccctgccatggccacaagtgtgtccatgggcaatgcgtgcccctcgacgctctttcctacagctgccagtgccaggatgggtactcgggggcactgtgcaaccagagtccgagtgccggggggaccctgtccgggactttcaccaggtccagaggggctatgccatctgccagaccacgcgccccctgtcatgggtggagtgccggggctcgtgcccaggccagggctgctgccagggccttcggctgaagcggaggaagttcacctttgagtgcagcgatgggacctcttttgccgaggaggtggaaaagcccaccaagtgtggctgtgccctctgcgcata

SEQ ID NO: 182043 - DNA, 5132 bp, Homo sapiens
  Payload ID: 15850
  Gene Symbol: SLIT2
  Gene Name: slit guidance ligand 2
  ENST ID: ENST00000273739
  CDS Start-End: 227-4855
gcccaaggagctcctgctctgccagaggagggtggagagggcggtgggaggcgtgtgcctgagtgggctctactgccttgttccatattatttggtgcacattttccctggcactctgggttgctagccccgccgggcactgggcctcagacactgcgcggttccctcggagcagcaagctaaagaaagcccccagtgccggcgaggaaggaggcggcggggaaagatgcgcggcgttggctggcagatgctgtccctgtcgctggggttagtgctggcgatcctgaacaaggtggcaccgcaggcgtgcccggcgcagtgctcttgctcgggcagcacagtggactgtcacgggctggcgctgcgcagcgtgcccaggaatatcccccgcaacaccgagagactggatttaaatggaaataacatcacaagaattacgaagacagattttgctggtcttagacatctaagagttcttcagcttatggagaataagattagcaccattgaaagaggagcattccaggatcttaaagaactagagagactgcgtttaaacagaaatcaccttcagctgtttcctgagttgctgtttcttgggactgcgaagctatacaggcttgatctcagtgaaaaccaaattcaggcaatcccaaggaaagctttccgtggggcagttgacataaaaaatttgcaactggattacaaccagatcagctgtattgaagatggggcattcagggctctccgggacctggaagtgctcactctcaacaataacaacattactagactttctgtggcaagtttcaaccatatgcctaaacttaggacttttcgactgcattcaaacaacctgtattgtgactgccacctggcctggctctccgactggcttcgccaaaggcctcgggttggtctgtacactcagtgtatgggcccctcccacctgagaggccataatgtagccgaggttcaaaaacgagaatttgtctgcagtgatgaggaagaaggtcaccagtcatttatggctccttcttgtagtgttttgcactgccctgccgcctgtacctgtagcaacaatatcgtagactgtcgtgggaaaggtctcactgagatccccacaaatcttccagagaccatcacagaaatacgtttggaacagaacacaatcaaagtcatccctcctggagctttctcaccatataaaaagcttagacgaattgacctgagcaataatcagatctctgaacttgcaccagatgctttccaaggactacgctctctgaattcacttgtcctctatggaaataaaatcacagaactccccaaaagtttatttgaaggactgttttccttacagctcctattattgaatgccaacaagataaactgccttcgggtagatgcttttcaggatctccacaacttgaaccttctctccctatatgacaacaagcttcagaccatcgccaaggggaccttttcacctcttcgggccattcaaactatgcatttggcccagaacccctttatttgtgactgccatctcaagtggctagcggattatctccataccaacccgattgagaccagtggtgcccgttgcaccagcccccgccgcctggcaaacaaaagaattggacagatcaaaagcaagaaattccgttgttcagctaaagaacagtatttcattccaggtacagaagattatcgatcaaaattaagtggagactgctttgcggatctggcttgccctgaaaagtgtcgctgtgaaggaaccacagtagattgctctaatcaaaagctcaacaaaatcccggagcacattccccagtacactgcagagttgcgtctcaataataatgaatttaccgtgttggaagccacaggaatctttaagaaacttcctcaattacgtaaaataaactttagcaacaataagatcacagatattgaggagggagcatttgaaggagcatctggtgtaaatgaaatacttcttacgagtaatcgtttggaaaatgtgcagcataagatgttcaagggattggaaagcctcaaaactttgatgttgagaagcaatcgaataacctgtgtggggaatgacagtttcataggactcagttctgtgcgtttgctttctttgtatgataatcaaattactacagttgcaccaggggcatttgatactctccattctttatctactctaaacctcttggccaatccttttaactgtaactgctacctggcttggttgggagagtggctgagaaagaagagaattgtcacgggaaatcctagatgtcaaaaaccatacttcctgaaagaaatacccatccaggatgtggccattcaggacttcacttgtgatgacggaaatgatgacaatagttgctccccactttctcgctgtcctactgaatgtacttgcttggatacagtcgtccgatgtagcaacaagggtttgaaggtcttgccgaaaggtattccaagagatgtcacagagttgtatctggatggaaaccaatttacactggttcccaaggaactctccaactacaaacatttaacacttatagacttaagtaacaacagaataagcacgctttctaatcagagcttcagcaacatgacccagctcctcaccttaattcttagttacaaccgtctgagatgtattcctcctcgcacctttgatggattaaagtctcttcgattactttctctacatggaaatgacatttctgttgtgcctgaaggtgctttcaatgatctttctgcattatcacatctagcaattggagccaaccctctttactgtgattgtaacatgcagtggttatccgactgggtgaagtcggaatataaggagcctggaattgctcgttgtgctggtcctggagaaatggcagataaacttttactcacaactccctccaaaaaatttacctgtcaaggtcctgtggatgtcaatattctagctaagtgtaacccctgcctatcaaatccgtgtaaaaatgatggcacatgtaatagtgatccagttgacttttaccgatgcacctgtccatatggtttcaaggggcaggactgtgatgtcccaattcatgcctgcatcagtaacccatgtaaacatggaggaacttgccacttaaaggaaggagaagaagatggattctggtgtatttgtgctgatggatttgaaggagaaaattgtgaagtcaacgttgatgattgtgaagataatgactgtgaaaataattctacatgtgtcgatggcattaataactacacatgcctttgcccacctgagtatacagctgctaatctgaatgaggtggaaaaaggtgagttgtgtgaggagaagctggacttctgtgcccaggacctgaacccctgccagcacgattcaaagtgcatcctaactccaaagggattcaaatgtgactgcacaccagggtacgtaggtgaacactgcgacatcgattttgacgactgccaagacaacaagtgtaaaaacggagcccactgcacagatgcagtgaacggctatacgtgcatatgccccgaaggttacagtggcttgttctgtgagttttctccacccatggtcctccctcgtaccagcccctgtgataattttgattgtcagaatggagctcagtgtatcgtcagaataaatgagccaatatgtcagtgtttgcctggctatcagggagaaaagtgtgaaaaattggttagtgtgaattttataaacaaagagtcttatcttcagattccttcagccaaggttcggcctcagacgaacataacacttcagattgccacagatgaagacagcggaatcctcctgtataagggtgacaaagaccatatcgcggtagaactctatcgggggcgtgttcgtgccagctatgacaccggctctcatccagcttctgccatttacagtgtggagacaatcaatgatggaaacttccacattgtggaactacttgccttggatcagagtctctctttgtccgtggatggtgggaaccccaaaatcatcactaacttgtcaaagcagtccactctgaattttgactctccactctatgtaggaggcatgccagggaagagtaacgtggcatctctgcgccaggcccctgggcagaacggaaccagcttccacggctgcatccggaacctttacatcaacagtgagctgcaggacttccagaaggtgccgatgcaaacaggcattttgcctggctgtgagccatgccacaagaaggtgtgtgcccatggcacatgccagcccagcagccaggcaggcttcacctgcgagtgccaggaaggatggatggggcccctctgtgaccaacggaccaatgacccttgccttggaaataaatgcgtacatggcacctgcttgcccatcaatgcgttctcctacagctgtaagtgcttggagggccatggaggtgtcctctgtgatgaagaggaggatctgtttaacccatgccaggcgatcaagtgcaagcatgggaagtgcaggctttcaggtctggggcagccctactgtgaatgcagcagtggatacacgggggacagctgtgatcgagaaatctcttgtcgaggggaaaggataagagattattaccaaaagcagcagggctatgctgcttgccaaacaaccaagaaggtgtcccgattagagtgcagaggtgggtgtgcaggagggcagtgctgtggaccgctgaggagcaagcggcggaaatactctttcgaatgcactgacggctcctcctttgtggacgaggttgagaaagtggtgaagtgcggctgtacgaggtgtgtgtcctaaacacactcccggcagctctgtctttggaaaaggttgtatacttcttgaccgtgtgggactaatgaatgcttcatagtggaaatatttgaaatatattgtaaaatacagaacagacttatttttattatgagaataaagactttttttctgcatttggaaaaaaaaaaaaagaaatgcttgaactaaagcttcccctatgctggagaagtatgaagaaagatatacctggagacattagaacagcgatgggaaccattgcaactcgggtccatctttg

SEQ ID NO: 182044 - DNA, 767 bp, Homo sapiens
  Payload ID: 15850
  Gene Symbol: SLIT2
  Gene Name: slit guidance ligand 2
  ENST ID: ENST00000511508
  CDS Start-End: 130-767
acagagttgtatctggatggaaaccaatttacactggttcccaaggaactctccaactacaaacatttaacacttatagacttaagtaacaacagaataagcacgctttctaatcagagcttcagcaacatgacccagctcctcaccttaattcttagttacaaccgtctgagatgtattcctcctcgcacctttgatggattaaagtctcttcgattactttctctacatggaaatgacatttctgttgtgcctgaaggtgctttcaatgatctttctgcattatcacatctagcaattggagccaaccctctttactgtgattgtaacatgcagtggttatccgactgggtgaagtcggaatataaggagcctggaattgctcgttgtgctggtcctggagaaatggcagataaacttttactcacaactccctccaaaaaatttacctgtcaagggctgccagggccctgtggcttcctcataccaggtcctgtggatgtcaatattctagctaagtgtaacccctgcctatcaaatccgtgtaaaaatgatggcacatgtaatagtgatccagttgacttttaccgatgcacctgtccatatggtttcaaggggcaggactgtgatgtcccaattcatgcctgcatcagtaacccatgtaaacatggaggaacttgccacttaaaggaaggagaagaagatggattctggtgtatttgtgctgatggatttgaaggagaaaattgtgaagtcaacgttgatga

SEQ ID NO: 182045 - DNA, 4752 bp, Homo sapiens
  Payload ID: 15850
  Gene Symbol: SLIT2
  Gene Name: slit guidance ligand 2
  Uniprot ID: O94813
  ENST ID: ENST00000503837
  CDS Start-End: 1-4578
atgcgcggcgttggctggcagatgctgtccctgtcgctggggttagtgctggcgatcctgaacaaggtggcaccgcaggcgtgcccggcgcagtgctcttgctcgggcagcacagtggactgtcacgggctggcgctgcgcagcgtgcccaggaatatcccccgcaacaccgagagactggatttaaatggaaataacatcacaagaattacgaagacagattttgctggtcttagacatctaagagttcttcagcttatggagaataagattagcaccattgaaagaggagcattccaggatcttaaagaactagagagactgcgtttaaacagaaatcaccttcagctgtttcctgagttgctgtttcttgggactgcgaagctatacaggcttgatctcagtgaaaaccaaattcaggcaatcccaaggaaagctttccgtggggcagttgacataaaaaatttgcaactggattacaaccagatcagctgtattgaagatggggcattcagggctctccgggacctggaagtgctcactctcaacaataacaacattactagactttctgtggcaagtttcaaccatatgcctaaacttaggacttttcgactgcattcaaacaacctgtattgtgactgccacctggcctggctctccgactggcttcgccaaaggcctcgggttggtctgtacactcagtgtatgggcccctcccacctgagaggccataatgtagccgaggttcaaaaacgagaatttgtctgcagtgatgaggaagaaggtcaccagtcatttatggctccttcttgtagtgttttgcactgccctgccgcctgtacctgtagcaacaatatcgtagactgtcgtgggaaaggtctcactgagatccccacaaatcttccagagaccatcacagaaatacgtttggaacagaacacaatcaaagtcatccctcctggagctttctcaccatataaaaagcttagacgaattgacctgagcaataatcagatctctgaacttgcaccagatgctttccaaggactacgctctctgaattcacttgtcctctatggaaataaaatcacagaactccccaaaagtttatttgaaggactgttttccttacagctcctattattgaatgccaacaagataaactgccttcgggtagatgcttttcaggatctccacaacttgaaccttctctccctatatgacaacaagcttcagaccatcgccaaggggaccttttcacctcttcgggccattcaaactatgcatttggcccagaacccctttatttgtgactgccatctcaagtggctagcggattatctccataccaacccgattgagaccagtggtgcccgttgcaccagcccccgccgcctggcaaacaaaagaattggacagatcaaaagcaagaaattccgttgttcaggtacagaagattatcgatcaaaattaagtggagactgctttgcggatctggcttgccctgaaaagtgtcgctgtgaaggaaccacagtagattgctctaatcaaaagctcaacaaaatcccggagcacattccccagtacactgcagagttgcgtctcaataataatgaatttaccgtgttggaagccacaggaatctttaagaaacttcctcaattacgtaaaataaactttagcaacaataagatcacagatattgaggagggagcatttgaaggagcatctggtgtaaatgaaatacttcttacgagtaatcgtttggaaaatgtgcagcataagatgttcaagggattggaaagcctcaaaactttgatgttgagaagcaatcgaataacctgtgtggggaatgacagtttcataggactcagttctgtgcgtttgctttctttgtatgataatcaaattactacagttgcaccaggggcatttgatactctccattctttatctactctaaacctcttggccaatccttttaactgtaactgctacctggcttggttgggagagtggctgagaaagaagagaattgtcacgggaaatcctagatgtcaaaaaccatacttcctgaaagaaatacccatccaggatgtggccattcaggacttcacttgtgatgacggaaatgatgacaatagttgctccccactttctcgctgtcctactgaatgtacttgcttggatacagtcgtccgatgtagcaacaagggtttgaaggtcttgccgaaaggtattccaagagatgtcacagagttgtatctggatggaaaccaatttacactggttcccaaggaactctccaactacaaacatttaacacttatagacttaagtaacaacagaataagcacgctttctaatcagagcttcagcaacatgacccagctcctcaccttaattcttagttacaaccgtctgagatgtattcctcctcgcacctttgatggattaaagtctcttcgattactttctctacatggaaatgacatttctgttgtgcctgaaggtgctttcaatgatctttctgcattatcacatctagcaattggagccaaccctctttactgtgattgtaacatgcagtggttatccgactgggtgaagtcggaatataaggagcctggaattgctcgttgtgctggtcctggagaaatggcagataaacttttactcacaactccctccaaaaaatttacctgtcaaggtcctgtggatgtcaatattctagctaagtgtaacccctgcctatcaaatccgtgtaaaaatgatggcacatgtaatagtgatccagttgacttttaccgatgcacctgtccatatggtttcaaggggcaggactgtgatgtcccaattcatgcctgcatcagtaacccatgtaaacatggaggaacttgccacttaaaggaaggagaagaagatggattctggtgtatttgtgctgatggatttgaaggagaaaattgtgaagtcaacgttgatgattgtgaagataatgactgtgaaaataattctacatgtgtcgatggcattaataactacacatgcctttgcccacctgagtatacaggtgagttgtgtgaggagaagctggacttctgtgcccaggacctgaacccctgccagcacgattcaaagtgcatcctaactccaaagggattcaaatgtgactgcacaccagggtacgtaggtgaacactgcgacatcgattttgacgactgccaagacaacaagtgtaaaaacggagcccactgcacagatgcagtgaacggctatacgtgcatatgccccgaaggttacagtggcttgttctgtgagttttctccacccatggtcctccctcgtaccagcccctgtgataattttgattgtcagaatggagctcagtgtatcgtcagaataaatgagccaatatgtcagtgtttgcctggctatcagggagaaaagtgtgaaaaattggttagtgtgaattttataaacaaagagtcttatcttcagattccttcagccaaggttcggcctcagacgaacataacacttcagattgccacagatgaagacagcggaatcctcctgtataagggtgacaaagaccatatcgcggtagaactctatcgggggcgtgttcgtgccagctatgacaccggctctcatccagcttctgccatttacagtgtggagacaatcaatgatggaaacttccacattgtggaactacttgccttggatcagagtctctctttgtccgtggatggtgggaaccccaaaatcatcactaacttgtcaaagcagtccactctgaattttgactctccactctatgtaggaggcatgccagggaagagtaacgtggcatctctgcgccaggcccctgggcagaacggaaccagcttccacggctgcatccggaacctttacatcaacagtgagctgcaggacttccagaaggtgccgatgcaaacaggcattttgcctggctgtgagccatgccacaagaaggtgtgtgcccatggcacatgccagcccagcagccaggcaggcttcacctgcgagtgccaggaaggatggatggggcccctctgtgaccaacggaccaatgacccttgccttggaaataaatgcgtacatggcacctgcttgcccatcaatgcgttctcctacagctgtaagtgcttggagggccatggaggtgtcctctgtgatgaagaggaggatctgtttaacccatgccaggcgatcaagtgcaagcatgggaagtgcaggctttcaggtctggggcagccctactgtgaatgcagcagtggatacacgggggacagctgtgatcgagaaatctcttgtcgaggggaaaggataagagattattaccaaaagcagcagggctatgctgcttgccaaacaaccaagaaggtgtcccgattagagtgcagaggtgggtgtgcaggagggcagtgctgtggaccgctgaggagcaagcggcggaaatactctttcgaatgcactgacggctcctcctttgtggacgaggttgagaaagtggtgaagtgcggctgtacgaggtgtgtgtcctaaacacactcccggcagctctgtctttggaaaaggttgtatacttcttgaccgtgtgggactaatgaatgcttcatagtggaaatatttgaaatatattgtaaaatacagaacagacttatttttattatgagaataaagactttttttctgcatttggaaaaaaaaaaaaagaaa

SEQ ID NO: 182046 - DNA, 6390 bp, Homo sapiens
  Payload ID: 15850
  Gene Symbol: SLIT2
  Gene Name: slit guidance ligand 2
  Uniprot ID: O94813
  ENST ID: ENST00000504154
  CDS Start-End: 253-4842
cggattcatcctcaggacctaaagttgcccaaggagctcctgctctgccagaggagggtggagagggcggtgggaggcgtgtgcctgagtgggctctactgccttgttccatattatttggtgcacattttccctggcactctgggttgctagccccgccgggcactgggcctcagacactgcgcggttccctcggagcagcaagctaaagaaagcccccagtgccggcgaggaaggaggcggcggggaaagatgcgcggcgttggctggcagatgctgtccctgtcgctggggttagtgctggcgatcctgaacaaggtggcaccgcaggcgtgcccggcgcagtgctcttgctcgggcagcacagtggactgtcacgggctggcgctgcgcagcgtgcccaggaatatcccccgcaacaccgagagactggatttaaatggaaataacatcacaagaattacgaagacagattttgctggtcttagacatctaagagttcttcagcttatggagaataagattagcaccattgaaagaggagcattccaggatcttaaagaactagagagactgcgtttaaacagaaatcaccttcagctgtttcctgagttgctgtttcttgggactgcgaagctatacaggcttgatctcagtgaaaaccaaattcaggcaatcccaaggaaagctttccgtggggcagttgacataaaaaatttgcaactggattacaaccagatcagctgtattgaagatggggcattcagggctctccgggacctggaagtgctcactctcaacaataacaacattactagactttctgtggcaagtttcaaccatatgcctaaacttaggacttttcgactgcattcaaacaacctgtattgtgactgccacctggcctggctctccgactggcttcgccaaaggcctcgggttggtctgtacactcagtgtatgggcccctcccacctgagaggccataatgtagccgaggttcaaaaacgagaatttgtctgcagtggtcaccagtcatttatggctccttcttgtagtgttttgcactgccctgccgcctgtacctgtagcaacaatatcgtagactgtcgtgggaaaggtctcactgagatccccacaaatcttccagagaccatcacagaaatacgtttggaacagaacacaatcaaagtcatccctcctggagctttctcaccatataaaaagcttagacgaattgacctgagcaataatcagatctctgaacttgcaccagatgctttccaaggactacgctctctgaattcacttgtcctctatggaaataaaatcacagaactccccaaaagtttatttgaaggactgttttccttacagctcctattattgaatgccaacaagataaactgccttcgggtagatgcttttcaggatctccacaacttgaaccttctctccctatatgacaacaagcttcagaccatcgccaaggggaccttttcacctcttcgggccattcaaactatgcatttggcccagaacccctttatttgtgactgccatctcaagtggctagcggattatctccataccaacccgattgagaccagtggtgcccgttgcaccagcccccgccgcctggcaaacaaaagaattggacagatcaaaagcaagaaattccgttgttcagctaaagaacagtatttcattccaggtacagaagattatcgatcaaaattaagtggagactgctttgcggatctggcttgccctgaaaagtgtcgctgtgaaggaaccacagtagattgctctaatcaaaagctcaacaaaatcccggagcacattccccagtacactgcagagttgcgtctcaataataatgaatttaccgtgttggaagccacaggaatctttaagaaacttcctcaattacgtaaaataaactttagcaacaataagatcacagatattgaggagggagcatttgaaggagcatctggtgtaaatgaaatacttcttacgagtaatcgtttggaaaatgtgcagcataagatgttcaagggattggaaagcctcaaaactttgatgttgagaagcaatcgaataacctgtgtggggaatgacagtttcataggactcagttctgtgcgtttgctttctttgtatgataatcaaattactacagttgcaccaggggcatttgatactctccattctttatctactctaaacctcttggccaatccttttaactgtaactgctacctggcttggttgggagagtggctgagaaagaagagaattgtcacgggaaatcctagatgtcaaaaaccatacttcctgaaagaaatacccatccaggatgtggccattcaggacttcacttgtgatgacggaaatgatgacaatagttgctccccactttctcgctgtcctactgaatgtacttgcttggatacagtcgtccgatgtagcaacaagggtttgaaggtcttgccgaaaggtattccaagagatgtcacagagttgtatctggatggaaaccaatttacactggttcccaaggaactctccaactacaaacatttaacacttatagacttaagtaacaacagaataagcacgctttctaatcagagcttcagcaacatgacccagctcctcaccttaattcttagttacaaccgtctgagatgtattcctcctcgcacctttgatggattaaagtctcttcgattactttctctacatggaaatgacatttctgttgtgcctgaaggtgctttcaatgatctttctgcattatcacatctagcaattggagccaaccctctttactgtgattgtaacatgcagtggttatccgactgggtgaagtcggaatataaggagcctggaattgctcgttgtgctggtcctggagaaatggcagataaacttttactcacaactccctccaaaaaatttacctgtcaaggtcctgtggatgtcaatattctagctaagtgtaacccctgcctatcaaatccgtgtaaaaatgatggcacatgtaatagtgatccagttgacttttaccgatgcacctgtccatatggtttcaaggggcaggactgtgatgtcccaattcatgcctgcatcagtaacccatgtaaacatggaggaacttgccacttaaaggaaggagaagaagatggattctggtgtatttgtgctgatggatttgaaggagaaaattgtgaagtcaacgttgatgattgtgaagataatgactgtgaaaataattctacatgtgtcgatggcattaataactacacatgcctttgcccacctgagtatacaggtgagttgtgtgaggagaagctggacttctgtgcccaggacctgaacccctgccagcacgattcaaagtgcatcctaactccaaagggattcaaatgtgactgcacaccagggtacgtaggtgaacactgcgacatcgattttgacgactgccaagacaacaagtgtaaaaacggagcccactgcacagatgcagtgaacggctatacgtgcatatgccccgaaggttacagtggcttgttctgtgagttttctccacccatggtcctccctcgtaccagcccctgtgataattttgattgtcagaatggagctcagtgtatcgtcagaataaatgagccaatatgtcagtgtttgcctggctatcagggagaaaagtgtgaaaaattggttagtgtgaattttataaacaaagagtcttatcttcagattccttcagccaaggttcggcctcagacgaacataacacttcagattgccacagatgaagacagcggaatcctcctgtataagggtgacaaagaccatatcgcggtagaactctatcgggggcgtgttcgtgccagctatgacaccggctctcatccagcttctgccatttacagtgtggagacaatcaatgatggaaacttccacattgtggaactacttgccttggatcagagtctctctttgtccgtggatggtgggaaccccaaaatcatcactaacttgtcaaagcagtccactctgaattttgactctccactctatgtaggaggcatgccagggaagagtaacgtggcatctctgcgccaggcccctgggcagaacggaaccagcttccacggctgcatccggaacctttacatcaacagtgagctgcaggacttccagaaggtgccgatgcaaacaggcattttgcctggctgtgagccatgccacaagaaggtgtgtgcccatggcacatgccagcccagcagccaggcaggcttcacctgcgagtgccaggaaggatggatggggcccctctgtgaccaacggaccaatgacccttgccttggaaataaatgcgtacatggcacctgcttgcccatcaatgcgttctcctacagctgtaagtgcttggagggccatggaggtgtcctctgtgatgaagaggaggatctgtttaacccatgccaggcgatcaagtgcaagcatgggaagtgcaggctttcaggtctggggcagccctactgtgaatgcagcagtggatacacgggggacagctgtgatcgagaaatctcttgtcgaggggaaaggataagagattattaccaaaagcagcagggctatgctgcttgccaaacaaccaagaaggtgtcccgattagagtgcagaggtgggtgtgcaggagggcagtgctgtggaccgctgaggagcaagcggcggaaatactctttcgaatgcactgacggctcctcctttgtggacgaggttgagaaagtggtgaagtgcggctgtacgaggtgtgtgtcctaaacacactcccggcagctctgtctttggaaaaggttgtatacttcttgaccgtgtgggactaatgaatgcttcatagtggaaatatttgaaatatattgtaaaatacagaacagacttatttttattatgagaataaagactttttttctgcatttggaaaaaaaaaaaaagaaatgcttgaactaaagcttcccctatgctggagaagtatgaagaaagatatacctggagacattagaacagcgatgggaaccattgcaactcgggtccatctttgtaacatgctgaagacaagcagaagcacatgcacgagggacagaggagctactgtgcactgctgtgaaattgcccagagcataaaacctgtgtaccctccttcacatcaaccaagttcactaggacataccaagcacatgcgtgtgaatgaggatgcaaggcaagagaatggaactccagaattcacagatagaacaaatggatgagaaatatttcatgcaaaatataaagtgtcctgaggatctgggttccatttacgagaggaaatgaaagtgctaaaataaattttatcttccttttaaatgtcagcatgtcagcagaagcagcacacaaaagtctttaccattttccagtattaatttttttgtaatataaatgataaaggagatgataaagaaccaatagattattgataaataaattagtaataatatgattttttgtttctatgagttctaaacagccctatacagtattcagtttccatgagaaatatttattgtatcaaagtacattgtacttaacattttaggccatccttttactgttccttgatgctttaatatatattaatttataattatcctgatatttttgtacatttttcaaacttaaaaatcaggatttttttttttttttttttggcaatagtactaacatagggttttatcttgggatacatatgtattggtctgtttgttgaccttgacatctgatcactgatgtcaatgacctactggcctcattcaggacacctgcagagagtatgcaaagtccgagagaggaaaacagaaatctgtatgtgagatggtcattgtacagaaagaagtggcccctctgcaacatgtcctcacagaaacgaaatggtgtgtagcaatcaacactagaaagtagaccttttgcaaattaatatgtccttgaccttttttgcccttttgtgggggtgaggtggggataaaaagactgtcatatcaagaactgtgacttttctttccctcaaacaataaaactcctttattatcttaatgctcccatgttaacatgtttgctgctaaattacaatgtagaattgataatggtttatagtgaactgtgctcttccctcattaaaatcccagggtgccctgtaaagatgcagatgtttcttcctgaaaacttctttttttacaaagaaaattagatgtacatgtataattcagtgtgctttgtctttctccagattaatatcggttacactgctgatgtttgtaaattaaacagatatttacttca

SEQ ID NO: 182047 - DNA, 394 bp, Homo sapiens
  Payload ID: 15850
  Gene Symbol: SLIT2
  Gene Name: slit guidance ligand 2
  ENST ID: ENST00000512993
  CDS Start-End: 1-248
ccagctatgacaccggctctcatccagcttctgccatttacagtgtggagacaatcaatgatggaaacttccacattgtggaactacttgccttggatcagagtctctctttgtccgtggatggtgggaaccccaaaatcatcactaacttgtcaaagcagtccactctgaattttgactctccactctatgtaggaggcatgccagggaagagtaacgtggcatctctgcgccagggtgccctgtaaagatgcagatgtttcttcctgaaaacttctttttttacaaagaaaattagatgtacatgtataattcagtgtgctttgtctttctccagattaatatcggttacactgctgatgtttgtaaattaaacagatatttacttcattaa

SEQ ID NO: 182048 - DNA, 739 bp, Homo sapiens
  Payload ID: 15850
  Gene Symbol: SLIT2
  Gene Name: slit guidance ligand 2
  ENST ID: ENST00000509941
  CDS Start-End: 1-589
atccgactgggtgaagtcggaatataaggagcctggaattgctcgttgtgctggtcctggagaaatggcagataaacttttactcacaactccctccaaaaaatttacctgtcaaggtcctgtggatgtcaatattctagctaagtgtaacccctgcctatcaaatccgtgtaaaaatgatggcacatgtaatagtgatccagttgacttttaccgatgcacctgtccatatggtttcaaggggcaggactgtgatgtcccaattcatgcctgcatcagtaacccatgtaaacatggaggaacttgccacttaaaggaaggagaagaagatggattctggtgtatttgtgctgatggatttgaaggagaaaattgtgaagtcaacgttgatgattgtgaagataatgactgtgaaaataattctacatgtgtcgatggcattaataactacacatgcctttgcccacctgagtatacaggtacaaataataggaaatattttgccttccatcagtatatctgtttgaaagcatcattggaactatgttatatatgtttagtaaatctttttttatttgataaatggtaggtgtcttgaaaatcagatgtaatgtaaataacataaggacttaaagatagtttcagctaaccaaataaaagacccaggaatctctgttcaaacatacgcatctattataaagccatgctatccagtaataaaagaagctattttgctaaa

SEQ ID NO: 182049 - DNA, 532 bp, Homo sapiens
  Payload ID: 15850
  Gene Symbol: SLIT2
  Gene Name: slit guidance ligand 2
  ENST ID: ENST00000508824
  CDS Start-End: 95-532
tttgcgagtctctaatgaagaagtaaatgcagacccggtgttgacggcccacgcgctcctgatgaggcgcttccagagttcagcgaagtggagcatggaggccgttctctttgtgaacgccgaggccgccgccccgcgccagtccggccgccctagggatttaaatggaaataacatcacaagaattacgaagacagattttgctggtcttagacatctaagagttcttcagcttatggagaataagattagcaccattgaaagaggagcattccaggatcttaaagaactagagagactgcgtttaaacagaaatcaccttcagctgtttcctgagttgctgtttcttgggactgcgaagctatacaggcttgatctcagtgaaaaccaaattcaggcaatcccaaggaaagctttccgtggggcagttgacataaaaaatttgcaactggattacaaccagatcagctgtattgaagatggggcattcagggctctccgggacctggaagtgctcactctcaacaataac

SEQ ID NO: 182050 - DNA, 5233 bp, Homo sapiens
  Payload ID: 15850
  Gene Symbol: SLIT2
  Gene Name: slit guidance ligand 2
  Uniprot ID: O94813
  ENST ID: ENST00000503823
  CDS Start-End: 557-5122
tgccccgcgcgctctgctacgggcccgctgggcttccgcgccttctagcttccggagcccactttgatcggggccataatacctattgagatcccctcttctgtcttgtaccttcgccactggcatcggatttgcagaagcgtgcgtgggatcagaggaccgccctccccacaacaaccggcccctgcatcttagcagccgttggaagccccagctcttttaccgccaagttcatccttgggagacagaagacgcgtgatctcctctccgctgctcttggggtctccttgcagccctggccaggcggattcatcctcaggacctaaagttgcccaaggagctcctgctctgccagaggagggtggagagggcggtgggaggcgtgtgcctgagtgggctctactgccttgttccatattatttggtgcacattttccctggcactctgggttgctagccccgccgggcactgggcctcagacactgcgcggttccctcggagcagcaagctaaagaaagcccccagtgccggcgaggaaggaggcggcggggaaagatgcgcggcgttggctggcagatgctgtccctgtcgctggggttagtgctggcgatcctgaacaaggtggcaccgcaggcgtgcccggcgcagtgctcttgctcgggcagcacagtggactgtcacgggctggcgctgcgcagcgtgcccaggaatatcccccgcaacaccgagagactggatttaaatggaaataacatcacaagaattacgaagacagattttgctggtcttagacatctaagagttcttcagcttatggagaataagattagcaccattgaaagaggagcattccaggatcttaaagaactagagagactgcgtttaaacagaaatcaccttcagctgtttcctgagttgctgtttcttgggactgcgaagctatacaggcttgatctcagtgaaaaccaaattcaggcaatcccaaggaaagctttccgtggggcagttgacataaaaaatttgcaactggattacaaccagatcagctgtattgaagatggggcattcagggctctccgggacctggaagtgctcactctcaacaataacaacattactagactttctgtggcaagtttcaaccatatgcctaaacttaggacttttcgactgcattcaaacaacctgtattgtgactgccacctggcctggctctccgactggcttcgccaaaggcctcgggttggtctgtacactcagtgtatgggcccctcccacctgagaggccataatgtagccgaggttcaaaaacgagaatttgtctgcagtggtcaccagtcatttatggctccttcttgtagtgttttgcactgccctgccgcctgtacctgtagcaacaatatcgtagactgtcgtgggaaaggtctcactgagatccccacaaatcttccagagaccatcacagaaatacgtttggaacagaacacaatcaaagtcatccctcctggagctttctcaccatataaaaagcttagacgaattgacctgagcaataatcagatctctgaacttgcaccagatgctttccaaggactacgctctctgaattcacttgtcctctatggaaataaaatcacagaactccccaaaagtttatttgaaggactgttttccttacagctcctattattgaatgccaacaagataaactgccttcgggtagatgcttttcaggatctccacaacttgaaccttctctccctatatgacaacaagcttcagaccatcgccaaggggaccttttcacctcttcgggccattcaaactatgcatttggcccagaacccctttatttgtgactgccatctcaagtggctagcggattatctccataccaacccgattgagaccagtggtgcccgttgcaccagcccccgccgcctggcaaacaaaagaattggacagatcaaaagcaagaaattccgttgttcaggtacagaagattatcgatcaaaattaagtggagactgctttgcggatctggcttgccctgaaaagtgtcgctgtgaaggaaccacagtagattgctctaatcaaaagctcaacaaaatcccggagcacattccccagtacactgcagagttgcgtctcaataataatgaatttaccgtgttggaagccacaggaatctttaagaaacttcctcaattacgtaaaataaactttagcaacaataagatcacagatattgaggagggagcatttgaaggagcatctggtgtaaatgaaatacttcttacgagtaatcgtttggaaaatgtgcagcataagatgttcaagggattggaaagcctcaaaactttgatgttgagaagcaatcgaataacctgtgtggggaatgacagtttcataggactcagttctgtgcgtttgctttctttgtatgataatcaaattactacagttgcaccaggggcatttgatactctccattctttatctactctaaacctcttggccaatccttttaactgtaactgctacctggcttggttgggagagtggctgagaaagaagagaattgtcacgggaaatcctagatgtcaaaaaccatacttcctgaaagaaatacccatccaggatgtggccattcaggacttcacttgtgatgacggaaatgatgacaatagttgctccccactttctcgctgtcctactgaatgtacttgcttggatacagtcgtccgatgtagcaacaagggtttgaaggtcttgccgaaaggtattccaagagatgtcacagagttgtatctggatggaaaccaatttacactggttcccaaggaactctccaactacaaacatttaacacttatagacttaagtaacaacagaataagcacgctttctaatcagagcttcagcaacatgacccagctcctcaccttaattcttagttacaaccgtctgagatgtattcctcctcgcacctttgatggattaaagtctcttcgattactttctctacatggaaatgacatttctgttgtgcctgaaggtgctttcaatgatctttctgcattatcacatctagcaattggagccaaccctctttactgtgattgtaacatgcagtggttatccgactgggtgaagtcggaatataaggagcctggaattgctcgttgtgctggtcctggagaaatggcagataaacttttactcacaactccctccaaaaaatttacctgtcaaggtcctgtggatgtcaatattctagctaagtgtaacccctgcctatcaaatccgtgtaaaaatgatggcacatgtaatagtgatccagttgacttttaccgatgcacctgtccatatggtttcaaggggcaggactgtgatgtcccaattcatgcctgcatcagtaacccatgtaaacatggaggaacttgccacttaaaggaaggagaagaagatggattctggtgtatttgtgctgatggatttgaaggagaaaattgtgaagtcaacgttgatgattgtgaagataatgactgtgaaaataattctacatgtgtcgatggcattaataactacacatgcctttgcccacctgagtatacaggtgagttgtgtgaggagaagctggacttctgtgcccaggacctgaacccctgccagcacgattcaaagtgcatcctaactccaaagggattcaaatgtgactgcacaccagggtacgtaggtgaacactgcgacatcgattttgacgactgccaagacaacaagtgtaaaaacggagcccactgcacagatgcagtgaacggctatacgtgcatatgccccgaaggttacagtggcttgttctgtgagttttctccacccatggtcctccctcgtaccagcccctgtgataattttgattgtcagaatggagctcagtgtatcgtcagaataaatgagccaatatgtcagtgtttgcctggctatcagggagaaaagtgtgaaaaattggttagtgtgaattttataaacaaagagtcttatcttcagattccttcagccaaggttcggcctcagacgaacataacacttcagattgccacagatgaagacagcggaatcctcctgtataagggtgacaaagaccatatcgcggtagaactctatcgggggcgtgttcgtgccagctatgacaccggctctcatccagcttctgccatttacagtgtggagacaatcaatgatggaaacttccacattgtggaactacttgccttggatcagagtctctctttgtccgtggatggtgggaaccccaaaatcatcactaacttgtcaaagcagtccactctgaattttgactctccactctatgtaggaggcatgccagggaagagtaacgtggcatctctgcgccaggcccctgggcagaacggaaccagcttccacggctgcatccggaacctttacatcaacagtgagctgcaggacttccagaaggtgccgatgcaaacaggcattttgcctggctgtgagccatgccacaagaaggtgtgtgcccatggcacatgccagcccagcagccaggcaggcttcacctgcgagtgccaggaaggatggatggggcccctctgtgaccaacggaccaatgacccttgccttggaaataaatgcgtacatggcacctgcttgcccatcaatgcgttctcctacagctgtaagtgcttggagggccatggaggtgtcctctgtgatgaagaggaggatctgtttaacccatgccaggcgatcaagtgcaagcatgggaagtgcaggctttcaggtctggggcagccctactgtgaatgcagcagtggatacacgggggacagctgtgatcgagaaatctcttgtcgaggggaaaggataagagattattaccaaaagcagcagggctatgctgcttgccaaacaaccaagaaggtgtcccgattagagtgcagaggtgggtgtgcaggagggcagtgctgtggaccgctgaggagcaagcggcggaaatactctttcgaatgcactgacggctcctcctttgtggacgaggttgagaaagtggtgaagtgcggctgtacgaggtgtgtgtcctaaacacactcccggcagctctgtctttggaaaaggttgtatacttcttgaccgtgtgggactaatgaatgcttcatagtggaaatatttgaaatatattgtaaaatacagaac

SEQ ID NO: 182051 - DNA, 6380 bp, Homo sapiens
  Payload ID: 15850
  Gene Symbol: SLIT2
  Gene Name: slit guidance ligand 2
  ENST ID: ENST00000622093
  CDS Start-End: 511-4830
cggattcatcctcaggacctaaagttgcccaaggagctcctgctctgccagaggagggtggagagggcggtgggaggcgtgtgcctgagtgggctctactgccttgttccatattatttggtgcacattttccctggcactctgggttgctagccccgccgggcactgggcctcagacactgcgcggttccctcggagcagcaagctaaagaaagcccccagtgccggcgaggaaggaggcggcggggaaagatgcgcggcgttggctggcagatgctgtccctgtcgctggggttagtgctggcgatcctgaacaaggtggcaccgcaggcgtgcccggcgcagtgctcttgctcgggcagcacagtggactgtcacgggctggcgctgcgcagcgtgcccaggaatatcccccgcaacaccgagagactggatttaaatggaaataacatcacaagaattacgaagacagattttgctggtcttagacatctaagagttcttcagcttatggagaataagattagcaccattgaaagaggagcattccaggatcttaaagaactagagagactgcgtttaaacagaaatcaccttcagctgtttcctgagttgctgtttcttgggactgcgaagctatacaggcttgatctcagtgaaaaccaaattcaggcaatcccaaggaaagctttccgtggggcagttgacataaaaaatttgcaactggattacaaccagatcagctgtattgaagatggggcattcagggctctccgggacctggaagtgctcactctcaacaataacaacattactagactttctgtggcaagtttcaaccatatgcctaaacttaggacttttcgactgcattcaaacaacctgtattgtgactgccacctggcctggctctccgactggcttcgccaaaggcctcgggttggtctgtacactcagtgtatgggcccctcccacctgagaggccataatgtagccgaggttcaaaaacgagaatttgtctgcagtgccaggcatggtggtcaccagtcatttatggctccttcttgtagtgttttgcactgccctgccgcctgtacctgtagcaacaatatcgtagactgtcgtgggaaaggtctcactgagatccccacaaatcttccagagaccatcacagaaatacgtttggaacagaacacaatcaaagtcatccctcctggagctttctcaccatataaaaagcttagacgaattgacctgagcaataatcagatctctgaacttgcaccagatgctttccaaggactacgctctctgaattcacttgtcctctatggaaataaaatcacagaactccccaaaagtttatttgaaggactgttttccttacagctcctattattgaatgccaacaagataaactgccttcgggtagatgcttttcaggatctccacaacttgaaccttctctccctatatgacaacaagcttcagaccatcgccaaggggaccttttcacctcttcgggccattcaaactatgcatttggcccagaacccctttatttgtgactgccatctcaagtggctagcggattatctccataccaacccgattgagaccagtggtgcccgttgcaccagcccccgccgcctggcaaacaaaagaattggacagatcaaaagcaagaaattccgttgttcaggtacagaagattatcgatcaaaattaagtggagactgctttgcggatctggcttgccctgaaaagtgtcgctgtgaaggaaccacagtagattgctctaatcaaaagctcaacaaaatcccggagcacattccccagtacactgcagagttgcgtctcaataataatgaatttaccgtgttggaagccacaggaatctttaagaaacttcctcaattacgtaaaataaactttagcaacaataagatcacagatattgaggagggagcatttgaaggagcatctggtgtaaatgaaatacttcttacgagtaatcgtttggaaaatgtgcagcataagatgttcaagggattggaaagcctcaaaactttgatgttgagaagcaatcgaataacctgtgtggggaatgacagtttcataggactcagttctgtgcgtttgctttctttgtatgataatcaaattactacagttgcaccaggggcatttgatactctccattctttatctactctaaacctcttggccaatccttttaactgtaactgctacctggcttggttgggagagtggctgagaaagaagagaattgtcacgggaaatcctagatgtcaaaaaccatacttcctgaaagaaatacccatccaggatgtggccattcaggacttcacttgtgatgacggaaatgatgacaatagttgctccccactttctcgctgtcctactgaatgtacttgcttggatacagtcgtccgatgtagcaacaagggtttgaaggtcttgccgaaaggtattccaagagatgtcacagagttgtatctggatggaaaccaatttacactggttcccaaggaactctccaactacaaacatttaacacttatagacttaagtaacaacagaataagcacgctttctaatcagagcttcagcaacatgacccagctcctcaccttaattcttagttacaaccgtctgagatgtattcctcctcgcacctttgatggattaaagtctcttcgattactttctctacatggaaatgacatttctgttgtgcctgaaggtgctttcaatgatctttctgcattatcacatctagcaattggagccaaccctctttactgtgattgtaacatgcagtggttatccgactgggtgaagtcggaatataaggagcctggaattgctcgttgtgctggtcctggagaaatggcagataaacttttactcacaactccctccaaaaaatttacctgtcaaggtcctgtggatgtcaatattctagctaagtgtaacccctgcctatcaaatccgtgtaaaaatgatggcacatgtaatagtgatccagttgacttttaccgatgcacctgtccatatggtttcaaggggcaggactgtgatgtcccaattcatgcctgcatcagtaacccatgtaaacatggaggaacttgccacttaaaggaaggagaagaagatggattctggtgtatttgtgctgatggatttgaaggagaaaattgtgaagtcaacgttgatgattgtgaagataatgactgtgaaaataattctacatgtgtcgatggcattaataactacacatgcctttgcccacctgagtatacaggtgagttgtgtgaggagaagctggacttctgtgcccaggacctgaacccctgccagcacgattcaaagtgcatcctaactccaaagggattcaaatgtgactgcacaccagggtacgtaggtgaacactgcgacatcgattttgacgactgccaagacaacaagtgtaaaaacggagcccactgcacagatgcagtgaacggctatacgtgcatatgccccgaaggttacagtggcttgttctgtgagttttctccacccatggtcctccctcgtaccagcccctgtgataattttgattgtcagaatggagctcagtgtatcgtcagaataaatgagccaatatgtcagtgtttgcctggctatcagggagaaaagtgtgaaaaattggttagtgtgaattttataaacaaagagtcttatcttcagattccttcagccaaggttcggcctcagacgaacataacacttcagattgccacagatgaagacagcggaatcctcctgtataagggtgacaaagaccatatcgcggtagaactctatcgggggcgtgttcgtgccagctatgacaccggctctcatccagcttctgccatttacagtgtggagacaatcaatgatggaaacttccacattgtggaactacttgccttggatcagagtctctctttgtccgtggatggtgggaaccccaaaatcatcactaacttgtcaaagcagtccactctgaattttgactctccactctatgtaggaggcatgccagggaagagtaacgtggcatctctgcgccaggcccctgggcagaacggaaccagcttccacggctgcatccggaacctttacatcaacagtgagctgcaggacttccagaaggtgccgatgcaaacaggcattttgcctggctgtgagccatgccacaagaaggtgtgtgcccatggcacatgccagcccagcagccaggcaggcttcacctgcgagtgccaggaaggatggatggggcccctctgtgaccaacggaccaatgacccttgccttggaaataaatgcgtacatggcacctgcttgcccatcaatgcgttctcctacagctgtaagtgcttggagggccatggaggtgtcctctgtgatgaagaggaggatctgtttaacccatgccaggcgatcaagtgcaagcatgggaagtgcaggctttcaggtctggggcagccctactgtgaatgcagcagtggatacacgggggacagctgtgatcgagaaatctcttgtcgaggggaaaggataagagattattaccaaaagcagcagggctatgctgcttgccaaacaaccaagaaggtgtcccgattagagtgcagaggtgggtgtgcaggagggcagtgctgtggaccgctgaggagcaagcggcggaaatactctttcgaatgcactgacggctcctcctttgtggacgaggttgagaaagtggtgaagtgcggctgtacgaggtgtgtgtcctaaacacactcccggcagctctgtctttggaaaaggttgtatacttcttgaccgtgtgggactaatgaatgcttcatagtggaaatatttgaaatatattgtaaaatacagaacagacttatttttattatgagaataaagactttttttctgcatttggaaaaaaaaaaaaagaaatgcttgaactaaagcttcccctatgctggagaagtatgaagaaagatatacctggagacattagaacagcgatgggaaccattgcaactcgggtccatctttgtaacatgctgaagacaagcagaagcacatgcacgagggacagaggagctactgtgcactgctgtgaaattgcccagagcataaaacctgtgtaccctccttcacatcaaccaagttcactaggacataccaagcacatgcgtgtgaatgaggatgcaaggcaagagaatggaactccagaattcacagatagaacaaatggatgagaaatatttcatgcaaaatataaagtgtcctgaggatctgggttccatttacgagaggaaatgaaagtgctaaaataaattttatcttccttttaaatgtcagcatgtcagcagaagcagcacacaaaagtctttaccattttccagtattaatttttttgtaatataaatgataaaggagatgataaagaaccaatagattattgataaataaattagtaataatatgattttttgtttctatgagttctaaacagccctatacagtattcagtttccatgagaaatatttattgtatcaaagtacattgtacttaacattttaggccatccttttactgttccttgatgctttaatatatattaatttataattatcctgatatttttgtacatttttcaaacttaaaaatcaggatttttttttttttttttttggcaatagtactaacatagggttttatcttgggatacatatgtattggtctgtttgttgaccttgacatctgatcactgatgtcaatgacctactggcctcattcaggacacctgcagagagtatgcaaagtccgagagaggaaaacagaaatctgtatgtgagatggtcattgtacagaaagaagtggcccctctgcaacatgtcctcacagaaacgaaatggtgtgtagcaatcaacactagaaagtagaccttttgcaaattaatatgtccttgaccttttttgcccttttgtgggggtgaggtggggataaaaagactgtcatatcaagaactgtgacttttctttccctcaaacaataaaactcctttattatcttaatgctcccatgttaacatgtttgctgctaaattacaatgtagaattgataatggtttatagtgaactgtgctcttccctcattaaaatcccagggtgccctgtaaagatgcagatgtttcttcctgaaaacttctttttttacaaagaaaattagatgtacatgtataattcagtgtgctttgtctttctccagattaatatcggttacactgctgatgtttgtaaattaaacagatatttacttcatt

SEQ ID NO: 182052 - DNA, 4895 bp, Homo sapiens
  Payload ID: 15851
  Gene Symbol: SLIT3
  Gene Name: slit guidance ligand 3
  Uniprot ID: O75094
  ENST ID: ENST00000332966
  CDS Start-End: 74-4666
cgcgcgcctcctcgggctccacgcgtcttgccccgcagaggcagcctcctccaggagcggggccctgcacaccatggcccccgggtgggcaggggtcggcgccgccgtgcgcgcccgcctggcgctggccttggcgctggcgagcgtcctgagtgggcctccagccgtcgcctgccccaccaagtgtacctgctccgctgccagcgtggactgccacgggctgggcctccgcgcggttcctcggggcatcccccgcaacgctgagcgccttgacctggacagaaataatatcaccaggatcaccaagatggacttcgctgggctcaagaacctccgagtcttgcatctggaagacaaccaggtcagcgtcatcgagagaggcgccttccaggacctgaagcagctagagcgactgcgcctgaacaagaataagctgcaagtccttccagaattgcttttccagagcacgccgaagctcaccagactagatttgagtgaaaaccagatccaggggatcccgaggaaggcgttccgcggcatcaccgatgtgaagaacctgcaactggacaacaaccacatcagctgcattgaagatggagccttccgagcgctgcgcgatttggagatccttaccctcaacaacaacaacatcagtcgcatcctggtcaccagcttcaaccacatgccgaagatccgaactctgcgcctccactccaaccacctgtactgcgactgccacctggcctggctctcggattggctgcgacagcgacggacagttggccagttcacactctgcatggctcctgtgcatttgaggggcttcaacgtggcggatgtgcagaagaaggagtacgtgtgcccagccccccactcggagcccccatcctgcaatgccaactccatctcctgcccttcgccctgcacgtgcagcaataacatcgtggactgtcgaggaaagggcttgatggagattcctgccaacttgccggagggcatcgtcgaaatacgcctagaacagaactccatcaaagccatccctgcaggagccttcacccagtacaagaaactgaagcgaatagacatcagcaagaatcagatatcggatattgctccagatgccttccagggcctgaaatcactcacatcgctggtcctgtatgggaacaagatcaccgagattgtcaagggactgtttgatgggctggtgtccctacagctgctcctcctcaatgccaacaagatcaactgcctgcgggtgaacacgtttcaggacctgcagaacctcaacttgctctccctgtatgacaacaagctgcagaccatcagcaaggggctcttcgcccctctgcagtccatccagacactccacttagcccaaaacccatttgtgtgcgactgccacttgaagtggctggccgactacctccaggacaaccccatcgagacaagcggggcccgctgcagcagcccgcgccgactcgccaacaagcgcatcagccagatcaagagcaagaagttccgctgctcaggctccgaggattaccgcagcaggttcagcagcgagtgcttcatggacctcgtgtgccccgagaagtgtcgctgtgagggcacgattgtggactgctccaaccagaagctggtccgcatcccaagccacctccctgaatatgtcaccgacctgcgactgaatgacaatgaggtatctgttctggaggccactggcatcttcaagaagttgcccaacctgcggaaaataaatctgagtaacaataagatcaaggaggtgcgagagggagctttcgatggagcagccagcgtgcaggagctgatgctgacagggaaccagctggagaccgtgcacgggcgcgtgttccgtggcctcagtggcctcaaaaccttgatgctgaggagtaacttgatcggctgtgtgagtaatgacacctttgccggcctgagttcggtgagactgctgtccctctatgacaatcggatcaccaccatcacccctggggccttcaccacgcttgtctccctgtccaccataaacctcctgtccaaccccttcaactgcaactgccacctggcctggctcggcaagtggttgaggaagaggcggatcgtcagtgggaaccctaggtgccagaagccatttttcctcaaggagattcccatccaggatgtggccatccaggacttcacctgtgatggcaacgaggagagtagctgccagctgagcccgcgctgcccggagcagtgcacctgtatggagacagtggtgcgatgcagcaacaaggggctccgcgccctccccagaggcatgcccaaggatgtgaccgagctgtacctggaaggaaaccacctaacagccgtgcccagagagctgtccgccctccgacacctgacgcttattgacctgagcaacaacagcatcagcatgctgaccaattacaccttcagtaacatgtctcacctctccactctgatcctgagctacaaccggctgaggtgcatccccgtccacgccttcaacgggctgcggtccctgcgagtgctaaccctccatggcaatgacatttccagcgttcctgaaggctccttcaacgacctcacatctctttcccatctggcgctgggaaccaacccactccactgtgactgcagtcttcggtggctgtcggagtgggtgaaggcggggtacaaggagcctggcatcgcccgctgcagtagccctgagcccatggctgacaggctcctgctcaccaccccaacccaccgcttccagtgcaaagtactctggttttgctgcccagggccagtggacatcaacattgtggccaaatgcaatgcctgcctctccagcccgtgcaagaataacgggacatgcacccaggaccctgtggagctgtaccgctgtgcctgcccctacagctacaagggcaaggactgcactgtgcccatcaacacctgcatccagaacccctgtcagcatggaggcacctgccacctgagtgacagccacaaggatgggttcagctgctcctgccctctgggctttgaggggcagcggtgtgagatcaacccagatgactgtgaggacaacgactgcgaaaacaatgccacctgcgtggacgggatcaacaactacgtgtgtatctgtccgcctaactacacaggtgagctatgcgacgaggtgattgaccactgtgtgcctgagctgaacctctgtcagcatgaggccaagtgcatccccctggacaaaggattcagctgcgagtgtgtccctggctacagcgggaagctctgtgagacagacaatgatgactgtgtggcccacaagtgccgccacggggcccagtgcgtggacacaatcaatggctacacatgcacctgcccccagggcttcagtggacccttctgtgaacaccccccacccatggtcctactgcagaccagcccatgcgaccagtacgagtgccagaacggggcccagtgcatcgtggtgcagcaggagcccacctgccgctgcccaccaggcttcgccggccccagatgcgagaagctcatcactgtcaacttcgtgggcaaagactcctacgtggaactggcctccgccaaggtccgaccccaggccaacatctccctgcaggtggccactgacaaggacaacggcatccttctctacaaaggagacaatgaccccctggcactggagctgtaccagggccacgtgcggctggtctatgacagcctgagttcccctccaaccacagtgtacagtgtggagacagtgaatgatgggcagtttcacagtgtggagctggtgacgctaaaccagaccctgaacctagtagtggacaaaggaactccaaagagcctggggaagctccagaagcagccagcagtgggcatcaacagccccctctaccttggaggcatccccacctccaccggcctctctgccttgcgccagggcacggaccggcctctaggcggcttccacggatgcatccatgaggtgcgcatcaacaacgagctgcaggacttcaaggccctcccaccacagtccctgggggtgtcaccaggctgcaagtcctgcaccgtgtgcaagcacggcctgtgccgctccgtggagaaggacagcgtggtgtgcgagtgccgcccaggctggaccggcccactctgcgatcaggaggcccgggacccctgcctcggccacagatgccaccatggaaaatgtgtggcaactgggacctcatacatgtgcaagtgtgccgagggctatggaggggacttgtgtgacaacaagaatgactctgccaatgcctgctcagccttcaagtgtcaccatgggcagtgccacatctcagaccaaggggagccctactgcctgtgccagcccggctttagcggcgagcactgccaacaagagaatccgtgcctgggacaagtagtccgagaggtgatccgccgccagaaaggttatgcatcatgtgccacagcctccaaggtgcccatcatggaatgtcgtgggggctgtgggccccagtgctgccagcccacccgcagcaagcggcggaaatacgtcttccagtgcacggacggctcctcgtttgtagaagaggtggagagacacttagagtgcggctgcctcgcgtgttcctaagcccctgcccgcctgcctgccacctctcggactccagcttgatggagttgggacagccatgtgggaccccctggtgattcagcatgaaggaaatgaagctggagaggaaggtaaagaagaagagaatattaagtatattgtaaaataaacaaaaaatagaacttatttttattatggaaagtgactattttcatcttttattatataaatatattacaccatctgcgta

SEQ ID NO: 182053 - DNA, 8903 bp, Homo sapiens
  Payload ID: 15851
  Gene Symbol: SLIT3
  Gene Name: slit guidance ligand 3
  ENST ID: ENST00000404867
  CDS Start-End: 1-4182
agagatttgagtgaaaaccagatccaggggatcccgaggaaggcgttccgcggcatcaccgatgtgaagaacctgcaactggacaacaaccacatcagctgcattgaagatggagccttccgagcgctgcgcgatttggagatccttaccctcaacaacaacaacatcagtcgcatcctggtcaccagcttcaaccacatgccgaagatccgaactctgcgcctccactccaaccacctgtactgcgactgccacctggcctggctctcggattggctgcgacagcgacggacagttggccagttcacactctgcatggctcctgtgcatttgaggggcttcaacgtggcggatgtgcagaagaaggagtacgtgtgcccagccccccactcggagcccccatcctgcaatgccaactccatctcctgcccttcgccctgcacgtgcagcaataacatcgtggactgtcgaggaaagggcttgatggagattcctgccaacttgccggagggcatcgtcgaaatacgcctagaacagaactccatcaaagccatccctgcaggagccttcacccagtacaagaaactgaagcgaatagacatcagcaagaatcagatatcggatattgctccagatgccttccagggcctgaaatcactcacatcgctggtcctgtatgggaacaagatcaccgagattgtcaagggactgtttgatgggctggtgtccctacagctgctcctcctcaatgccaacaagatcaactgcctgcgggtgaacacgtttcaggacctgcagaacctcaacttgctctccctgtatgacaacaagctgcagaccatcagcaaggggctcttcgcccctctgcagtccatccagacactccacttagcccaaaacccatttgtgtgcgactgccacttgaagtggctggccgactacctccaggacaaccccatcgagacaagcggggcccgctgcagcagcccgcgccgactcgccaacaagcgcatcagccagatcaagagcaagaagttccgctgctcaggctccgaggattaccgcagcaggttcagcagcgagtgcttcatggacctcgtgtgccccgagaagtgtcgctgtgagggcacgattgtggactgctccaaccagaagctggtccgcatcccaagccacctccctgaatatgtcaccgacctgcgactgaatgacaatgaggtatctgttctggaggccactggcatcttcaagaagttgcccaacctgcggaaaataaatctgagtaacaataagatcaaggaggtgcgagagggagctttcgatggagcagccagcgtgcaggagctgatgctgacagggaaccagctggagaccgtgcacgggcgcgtgttccgtggcctcagtggcctcaaaaccttgatgctgaggagtaacttgatcggctgtgtgagtaatgacacctttgccggcctgagttcggtgagactgctgtccctctatgacaatcggatcaccaccatcacccctggggccttcaccacgcttgtctccctgtccaccataaacctcctgtccaaccccttcaactgcaactgccacctggcctggctcggcaagtggttgaggaagaggcggatcgtcagtgggaaccctaggtgccagaagccatttttcctcaaggagattcccatccaggatgtggccatccaggacttcacctgtgatggcaacgaggagagtagctgccagctgagcccgcgctgcccggagcagtgcacctgtatggagacagtggtgcgatgcagcaacaaggggctccgcgccctccccagaggcatgcccaaggatgtgaccgagctgtacctggaaggaaaccacctaacagccgtgcccagagagctgtccgccctccgacacctgacgcttattgacctgagcaacaacagcatcagcatgctgaccaattacaccttcagtaacatgtctcacctctccactctgatcctgagctacaaccggctgaggtgcatccccgtccacgccttcaacgggctgcggtccctgcgagtgctaaccctccatggcaatgacatttccagcgttcctgaaggctccttcaacgacctcacatctctttcccatctggcgctgggaaccaacccactccactgtgactgcagtcttcggtggctgtcggagtgggtgaaggcggggtacaaggagcctggcatcgcccgctgcagtagccctgagcccatggctgacaggctcctgctcaccaccccaacccaccgcttccagtgcaaagtactctggttttgctgcccagggccagtggacatcaacattgtggccaaatgcaatgcctgcctctccagcccgtgcaagaataacgggacatgcacccaggaccctgtggagctgtaccgctgtgcctgcccctacagctacaagggcaaggactgcactgtgcccatcaacacctgcatccagaacccctgtcagcatggaggcacctgccacctgagtgacagccacaaggatgggttcagctgctcctgccctctgggctttgaggggcagcggtgtgagatcaacccagatgactgtgaggacaacgactgcgaaaacaatgccacctgcgtggacgggatcaacaactacgtgtgtatctgtccgcctaactacacaggtgagctatgcgacgaggtgattgaccactgtgtgcctgagctgaacctctgtcagcatgaggccaagtgcatccccctggacaaaggattcagctgcgagtgtgtccctggctacagcgggaagctctgtgagacagacaatgatgactgtgtggcccacaagtgccgccacggggcccagtgcgtggacacaatcaatggctacacatgcacctgcccccagggcttcagtggacccttctgtgaacaccccccacccatggtcctactgcagaccagcccatgcgaccagtacgagtgccagaacggggcccagtgcatcgtggtgcagcaggagcccacctgccgctgcccaccaggcttcgccggccccagatgcgagaagctcatcactgtcaacttcgtgggcaaagactcctacgtggaactggcctccgccaaggtccgaccccaggccaacatctccctgcaggtggccactgacaaggacaacggcatccttctctacaaaggagacaatgaccccctggcactggagctgtaccagggccacgtgcggctggtctatgacagcctgagttcccctccaaccacagtgtacagtgtggagacagtgaatgatgggcagtttcacagtgtggagctggtgacgctaaaccagaccctgaacctagtagtggacaaaggaactccaaagagcctggggaagctccagaagcagccagcagtgggcatcaacagccccctctaccttggaggcatccccacctccaccggcctctctgccttgcgccagggcacggaccggcctctaggcggcttccacggatgcatccatgaggtgcgcatcaacaacgagctgcaggacttcaaggccctcccaccacagtccctgggggtgtcaccaggctgcaagtcctgcaccgtgtgcaagcacggcctgtgccgctccgtggagaaggacagcgtggtgtgcgagtgccgcccaggctggaccggcccactctgcgatcaggaggcccgggacccctgcctcggccacagatgccaccatggaaaatgtgtggcaactgggacctcatacatgtgcaagtgtgccgagggctatggaggggacttgtgtgacaacaagaatgactctgccaatgcctgctcagccttcaagtgtcaccatgggcagtgccacatctcagaccaaggggagccctactgcctgtgccagcccggctttagcggcgagcactgccaacaagagaatccgtgcctgggacaagtagtccgagaggtgatccgccgccagaaaggttatgcatcatgtgccacagcctccaaggtgcccatcatggaatgtcgtgggggctgtgggccccagtgctgccagcccacccgcagcaagcggcggaaatacgtcttccagtgcacggacggctcctcgtttgtagaagaggtggagagacacttagagtgcggctgcctcgcgtgttcctaagcccctgcccgcctgcctgccacctctcggactccagcttgatggagttgggacagccatgtgggaccccctggtgattcagcatgaaggaaatgaagctggagaggaaggtaaagaagaagagaatattaagtatattgtaaaataaacaaaaaatagaacttatttttattatggaaagtgactattttcatcttttattatataaatatattacaccatctgcgtatatgtaccatatagtgagttatttttaccaagttttgtgttgtgtatttgttgtgtttttaaaaatagctgtttaaaaatttaagaaaaaaatagactaataaaaatgctttaaaacaaaaggataagaataaagaatgatagcctgtctgaggaaggaggaagatgttttcatgtttatgaaacggtattatgtcggcagtagaccaagagctgctcattgagatcagaaaaaggaataagaggaagagagagaaggaaaagacctttgtttcttgttttttaactcccttttatttttcctcccctaaaattacccagcttttcggagtcctggatgtcagtgcccaaaatgcccagttcttccaggaaaagctgctgagccctggccttctcagtctcactgccactcaaaaatattgctgtccctgtctgtcccagaccccccttcagggtatctgaacccactgggggacccctcttctccttcctgggtggccctggcttccgtatctgaacccactgggggacccctcttctccttcctggctggccctggcttccaatcgaggactgactattgaagtctgctacaggtgtcatttggaactgtcttaccaaattttaaaacagctgctatttttcctgctcctccccaggagaggggtcttcctagaggaggcgagggaagagaatatcatggtgtctcctcaggacccatgcactggccctctctcctccttccaggtaatttttcattggaatgtatcccagtagagaaggtagtcagcccttcttggaagcggaaggctgggagccaagtcaagtctgcccacagcgctagatgtccaactctggaaggttcttggaggctcttgttgtaagacaggcctctgccacctgatcctccaggtcaccagcatgacgatagagactccttgcccatctgtgacactttccaatgcatatccaaactttaccttattttatctatgcaacccctgcctccctgggaaggataagggagtagagctgggttcactaagaaggaagtttaggccctcacaggctctggaacttgccttaagccacacaccagataagtggaggagccagaccagaagtccagacccaaagcttgagattcttcctctagaatgggtgagcacaggtgattcaggcggcttaaatccatcagagcagccctgccggaaaaggaaataatatgatgttttttcctgctcttgttctgccttgctcactccttctccctccgcagtatctggaaagattctggagaccagggcttatgcatctagggaaagtgaccaagggcagcctatccagcctctgcctccattcctgaaggggacttccctgcccctgtttctttccatgtctctccctccctcactcccatttgcccccttccaccccatcaggttagccacatatcttccagggctcagctgttcacaccaactccctggctcttatcatccatccctccttcccccaggagcttccactgtaggagtttcagggagaagagtttggaattcattggacctttcagccctcaggttccctagaggagcctagttgatctgtgagtaccaatggtgggccaaagacgcagggaataatgaagggagaaagaaaagaaaggaagatggaggaaaacgaggcaactggaagaaggaaggaaggaaagaaggaagggatggaggggatgaagagaagggagagagggatatagctgaggaatttatctaaaaatgtgcatgtaaatctccattatgttccaggtactgtgccttatgatggctttgttttttgttgtcattagagacaaggtcttgctttgtcacccaggctggagtagagtggttcgatcatagctcaccgcagcctcaacctcctaggctcaagccatcttcctgcctcagtctcccaaaatgctgggattacaggtgtgagccactatgctcagcctgtttcaaacattattataatagcagatttatttagtactttattatacatcagataccactctaattgtgaaatagatatatattcatttaattattgaaacaaccatgtagttaaaacactattaactcattttacagttgagtagactgagacacagagaagttaaagaacttgcccaagagtaaatgtctaataaaccgtagagccaggatctgggcccaggctgtctgactccagaacttgctcactcaaccactaaaccatcctgcttctcatgggaaagaaacacatcctgcctttgaggatcctacagcctgtgacaaaaacagtcataaaaatggacaattgccttattacacaaggagctcttaagtggcaatacaagcaatggaagtggctgtccagaggagggaacttctagtcctaggtctttaaggatgaataggagtttgccagagtgagaaagggaattgaactttcctgggagtggccttttaaaaagcaatgagatatggccaggcctggcttgtttggggaagagtcaaaatctagggtggcaagagtatgggaagcacactgaggagcagagagaaatggggtaggtaggaaggtagggttttgaccacaaagagctgtgcatgctaaactgggccacaggtgccagcagggttgtttgaggaagggaagagcaagacaagctctggtttaggaagagagctgtggcagcataaaggcctgaaagaggagacagagctgtcacccaaaatggacttgagagctccctgtggtttactctgtggctagaaaacactgccggccagatggatcacaaatgtctatggtagcttagaagctctgctcttgaagaggatcctgggatctgcccaacacccttcccaacctccatttccccatccccacctccattgccccatcccccctctccccctaggcaggtggatctgagccttatcccaccaccaatgcccctgctagcctctccccacccagcccagagcctactcagcctgccatctcaagagccccaccgagggtcactggcttcctgggaggagtcaccaggctgccagctttccctctgcctccccaaggaacctgagacctccctctgctcatcaccctgggcccaatcctgaatccagcccccatcaaccaagacagcaaaagggccaggtctgtcccttataattttgagccttctccctcaagtttggaagccctgactttaagaaatgccaaatgcaaggaccattaagaaaattctccccgaaatgaggctcctctaacaaatgatgattaaaacgctctctccttgagcagtcacattctagaaacaggacattccatgaggcaggaagagttcagttaatttgctcctgaaaaagtgtggttcagtgtttgtgtggcaatgtacgtgggcagaagaggccgctcaagctgtgtcccccctgagcaggattcaggaaagggaaaagaagttctcttcaactcagccaaggggccgtacgatggccgatgagattatgtatttaaaagttctttgtaaagtgtaaactaaaaaccttaaatgtaagatgctgttgttattattactgttgttgttgctgttatggacatgccaaaaggcccttgttagaagacagttttgccttttcaatctcatagcaaggaactcaagtctgatgcttcaaaaagatgagaagaagggcaagaagagggataactcccaagctcagagggaaaaaaaaggtgggggaaaagagccccagggtgaccttcaggaaaggccaggaccaggatgatctaacctttcccttcaccagaaacaaagctattgccagactgaaccctaaagtcaagcagtcacccactgcctttgctgggagcagaagcccatagcaacaagtgacctgcccctcagactcaagatcccagataccagagctggaggagtcatagggcattactggtaggcaggaaaactgagggtcgaacaaatggaagaatgcggtgatcatagaccaaagacacacagataattaaccccatgtgtccacccaggccaaagttcttcctgctaccccacagtggatgtccaggcagatggtccccacatgatggggaagcagagggcatagtgtggttttgtgggacttgttcatgttttgtagtgtgggctcaacagtgccaaaggaaacactagggaaaagttggtgaaacatgccagctagcaggaccagtaaaggcataatcaggcatttggcaaagcttgcttttctaattcaatgataggttctaataggaaatttttgaagattttttaaaacaatgttatagtggcacttccccagtatggaataaataacatgcattcttttttcaatatactgtcatattcagatgtcattaaaataaatggatgagtcacagaggagctatcagatgctctcatgactaccataactcagccctgc

SEQ ID NO: 182054 - DNA, 9706 bp, Homo sapiens
  Payload ID: 15851
  Gene Symbol: SLIT3
  Gene Name: slit guidance ligand 3
  Uniprot ID: O75094
  ENST ID: ENST00000519560
  CDS Start-End: 421-4992
gagagcgagcgccggccagctcacccggccgccccgtgccccagccgcagccgccgcgctccccagcccagccccaagccggacctccccgggcgccacgccccattgcgctcgccccaggtccccaacccggcccgcgggccagcggggccagggggcgctccgcacctgggcactcccagcgatgcgcagcggggcagcgccggccccgccgatggagctgctgttgctgccgccgccgccgcccggagcgccccgctccgcccgcgccccgtgcgcctgagcaccgagctcgcccctcctccgcgctaactccgccgcccgctccccaggccgcccgcgctccccgcgcgcctcctcgggctccacgcgtcttgccccgcagaggcagcctcctccaggagcggggccctgcacaccatggcccccgggtgggcaggggtcggcgccgccgtgcgcgcccgcctggcgctggccttggcgctggcgagcgtcctgagtgggcctccagccgtcgcctgccccaccaagtgtacctgctccgctgccagcgtggactgccacgggctgggcctccgcgcggttcctcggggcatcccccgcaacgctgagcgccttgacctggacagaaataatatcaccaggatcaccaagatggacttcgctgggctcaagaacctccgagtcttgcatctggaagacaaccaggtcagcgtcatcgagagaggcgccttccaggacctgaagcagctagagcgactgcgcctgaacaagaataagctgcaagtccttccagaattgcttttccagagcacgccgaagctcaccagactagatttgagtgaaaaccagatccaggggatcccgaggaaggcgttccgcggcatcaccgatgtgaagaacctgcaactggacaacaaccacatcagctgcattgaagatggagccttccgagcgctgcgcgatttggagatccttaccctcaacaacaacaacatcagtcgcatcctggtcaccagcttcaaccacatgccgaagatccgaactctgcgcctccactccaaccacctgtactgcgactgccacctggcctggctctcggattggctgcgacagcgacggacagttggccagttcacactctgcatggctcctgtgcatttgaggggcttcaacgtggcggatgtgcagaagaaggagtacgtgtgcccagccccccactcggagcccccatcctgcaatgccaactccatctcctgcccttcgccctgcacgtgcagcaataacatcgtggactgtcgaggaaagggcttgatggagattcctgccaacttgccggagggcatcgtcgaaatacgcctagaacagaactccatcaaagccatccctgcaggagccttcacccagtacaagaaactgaagcgaatagacatcagcaagaatcagatatcggatattgctccagatgccttccagggcctgaaatcactcacatcgctggtcctgtatgggaacaagatcaccgagattgtcaagggactgtttgatgggctggtgtccctacagctgctcctcctcaatgccaacaagatcaactgcctgcgggtgaacacgtttcaggacctgcagaacctcaacttgctctccctgtatgacaacaagctgcagaccatcagcaaggggctcttcgcccctctgcagtccatccagacactccacttagcccaaaacccatttgtgtgcgactgccacttgaagtggctggccgactacctccaggacaaccccatcgagacaagcggggcccgctgcagcagcccgcgccgactcgccaacaagcgcatcagccagatcaagagcaagaagttccgctgctcaggctccgaggattaccgcagcaggttcagcagcgagtgcttcatggacctcgtgtgccccgagaagtgtcgctgtgagggcacgattgtggactgctccaaccagaagctggtccgcatcccaagccacctccctgaatatgtcaccgacctgcgactgaatgacaatgaggtatctgttctggaggccactggcatcttcaagaagttgcccaacctgcggaaaataaatctgagtaacaataagatcaaggaggtgcgagagggagctttcgatggagcagccagcgtgcaggagctgatgctgacagggaaccagctggagaccgtgcacgggcgcgtgttccgtggcctcagtggcctcaaaaccttgatgctgaggagtaacttgatcggctgtgtgagtaatgacacctttgccggcctgagttcggtgagactgctgtccctctatgacaatcggatcaccaccatcacccctggggccttcaccacgcttgtctccctgtccaccataaacctcctgtccaaccccttcaactgcaactgccacctggcctggctcggcaagtggttgaggaagaggcggatcgtcagtgggaaccctaggtgccagaagccatttttcctcaaggagattcccatccaggatgtggccatccaggacttcacctgtgatggcaacgaggagagtagctgccagctgagcccgcgctgcccggagcagtgcacctgtatggagacagtggtgcgatgcagcaacaaggggctccgcgccctccccagaggcatgcccaaggatgtgaccgagctgtacctggaaggaaaccacctaacagccgtgcccagagagctgtccgccctccgacacctgacgcttattgacctgagcaacaacagcatcagcatgctgaccaattacaccttcagtaacatgtctcacctctccactctgatcctgagctacaaccggctgaggtgcatccccgtccacgccttcaacgggctgcggtccctgcgagtgctaaccctccatggcaatgacatttccagcgttcctgaaggctccttcaacgacctcacatctctttcccatctggcgctgggaaccaacccactccactgtgactgcagtcttcggtggctgtcggagtgggtgaaggcggggtacaaggagcctggcatcgcccgctgcagtagccctgagcccatggctgacaggctcctgctcaccaccccaacccaccgcttccagtgcaaagggccagtggacatcaacattgtggccaaatgcaatgcctgcctctccagcccgtgcaagaataacgggacatgcacccaggaccctgtggagctgtaccgctgtgcctgcccctacagctacaagggcaaggactgcactgtgcccatcaacacctgcatccagaacccctgtcagcatggaggcacctgccacctgagtgacagccacaaggatgggttcagctgctcctgccctctgggctttgaggggcagcggtgtgagatcaacccagatgactgtgaggacaacgactgcgaaaacaatgccacctgcgtggacgggatcaacaactacgtgtgtatctgtccgcctaactacacaggtgagctatgcgacgaggtgattgaccactgtgtgcctgagctgaacctctgtcagcatgaggccaagtgcatccccctggacaaaggattcagctgcgagtgtgtccctggctacagcgggaagctctgtgagacagacaatgatgactgtgtggcccacaagtgccgccacggggcccagtgcgtggacacaatcaatggctacacatgcacctgcccccagggcttcagtggacccttctgtgaacaccccccacccatggtcctactgcagaccagcccatgcgaccagtacgagtgccagaacggggcccagtgcatcgtggtgcagcaggagcccacctgccgctgcccaccaggcttcgccggccccagatgcgagaagctcatcactgtcaacttcgtgggcaaagactcctacgtggaactggcctccgccaaggtccgaccccaggccaacatctccctgcaggtggccactgacaaggacaacggcatccttctctacaaaggagacaatgaccccctggcactggagctgtaccagggccacgtgcggctggtctatgacagcctgagttcccctccaaccacagtgtacagtgtggagacagtgaatgatgggcagtttcacagtgtggagctggtgacgctaaaccagaccctgaacctagtagtggacaaaggaactccaaagagcctggggaagctccagaagcagccagcagtgggcatcaacagccccctctaccttggaggcatccccacctccaccggcctctctgccttgcgccagggcacggaccggcctctaggcggcttccacggatgcatccatgaggtgcgcatcaacaacgagctgcaggacttcaaggccctcccaccacagtccctgggggtgtcaccaggctgcaagtcctgcaccgtgtgcaagcacggcctgtgccgctccgtggagaaggacagcgtggtgtgcgagtgccgcccaggctggaccggcccactctgcgatcaggaggcccgggacccctgcctcggccacagatgccaccatggaaaatgtgtggcaactgggacctcatacatgtgcaagtgtgccgagggctatggaggggacttgtgtgacaacaagaatgactctgccaatgcctgctcagccttcaagtgtcaccatgggcagtgccacatctcagaccaaggggagccctactgcctgtgccagcccggctttagcggcgagcactgccaacaagagaatccgtgcctgggacaagtagtccgagaggtgatccgccgccagaaaggttatgcatcatgtgccacagcctccaaggtgcccatcatggaatgtcgtgggggctgtgggccccagtgctgccagcccacccgcagcaagcggcggaaatacgtcttccagtgcacggacggctcctcgtttgtagaagaggtggagagacacttagagtgcggctgcctcgcgtgttcctaagcccctgcccgcctgcctgccacctctcggactccagcttgatggagttgggacagccatgtgggaccccctggtgattcagcatgaaggaaatgaagctggagaggaaggtaaagaagaagagaatattaagtatattgtaaaataaacaaaaaatagaacttatttttattatggaaagtgactattttcatcttttattatataaatatattacaccatctgcgtatatgtaccatatagtgagttatttttaccaagttttgtgttgtgtatttgttgtgtttttaaaaatagctgtttaaaaatttaagaaaaaaatagactaataaaaatgctttaaaacaaaaggataagaataaagaatgatagcctgtctgaggaaggaggaagatgttttcatgtttatgaaacggtattatgtcggcagtagaccaagagctgctcattgagatcagaaaaaggaataagaggaagagagagaaggaaaagacctttgtttcttgttttttaactcccttttatttttcctcccctaaaattacccagcttttcggagtcctggatgtcagtgcccaaaatgcccagttcttccaggaaaagctgctgagccctggccttctcagtctcactgccactcaaaaatattgctgtccctgtctgtcccagaccccccttcagggtatctgaacccactgggggacccctcttctccttcctgggtggccctggcttccgtatctgaacccactgggggacccctcttctccttcctggctggccctggcttccaatcgaggactgactattgaagtctgctacaggtgtcatttggaactgtcttaccaaattttaaaacagctgctatttttcctgctcctccccaggagaggggtcttcctagaggaggcgagggaagagaatatcatggtgtctcctcaggacccatgcactggccctctctcctccttccaggtaatttttcattggaatgtatcccagtagagaaggtagtcagcccttcttggaagcggaaggctgggagccaagtcaagtctgcccacagcgctagatgtccaactctggaaggttcttggaggctcttgttgtaagacaggcctctgccacctgatcctccaggtcaccagcatgacgatagagactccttgcccatctgtgacactttccaatgcatatccaaactttaccttattttatctatgcaacccctgcctccctgggaaggataagggagtagagctgggttcactaagaaggaagtttaggccctcacaggctctggaacttgccttaagccacacaccagataagtggaggagccagaccagaagtccagacccaaagcttgagattcttcctctagaatgggtgagcacaggtgattcaggcggcttaaatccatcagagcagccctgccggaaaaggaaataatatgatgttttttcctgctcttgttctgccttgctcactccttctccctccgcagtatctggaaagattctggagaccagggcttatgcatctagggaaagtgaccaagggcagcctatccagcctctgcctccattcctgaaggggacttccctgcccctgtttctttccatgtctctccctccctcactcccatttgcccccttccaccccatcaggttagccacatatcttccagggctcagctgttcacaccaactccctggctcttatcatccatccctccttcccccaggagcttccactgtaggagtttcagggagaagagtttggaattcattggacctttcagccctcaggttccctagaggagcctagttgatctgtgagtaccaatggtgggccaaagacgcagggaataatgaagggagaaagaaaagaaaggaagatggaggaaaacgaggcaactggaagaaggaaggaaggaaagaaggaagggatggaggggatgaagagaagggagagagggatatagctgaggaatttatctaaaaatgtgcatgtaaatctccattatgttccaggtactgtgccttatgatggctttgttttttgttgtcattagagacaaggtcttgctttgtcacccaggctggagtagagtggttcgatcatagctcaccgcagcctcaacctcctaggctcaagccatcttcctgcctcagtctcccaaaatgctgggattacaggtgtgagccactatgctcagcctgtttcaaacattattataatagcagatttatttagtactttattatacatcagataccactctaattgtgaaatagatatatattcatttaattattgaaacaaccatgtagttaaaacactattaactcattttacagttgagtagactgagacacagagaagttaaagaacttgcccaagagtaaatgtctaataaaccgtagagccaggatctgggcccaggctgtctgactccagaacttgctcactcaaccactaaaccatcctgcttctcatgggaaagaaacacatcctgcctttgaggatcctacagcctgtgacaaaaacagtcataaaaatggacaattgccttattacacaaggagctcttaagtggcaatacaagcaatggaagtggctgtccagaggagggaacttctagtcctaggtctttaaggatgaataggagtttgccagagtgagaaagggaattgaactttcctgggagtggccttttaaaaagcaatgagatatggccaggcctggcttgtttggggaagagtcaaaatctagggtggcaagagtatgggaagcacactgaggagcagagagaaatggggtaggtaggaaggtagggttttgaccacaaagagctgtgcatgctaaactgggccacaggtgccagcagggttgtttgaggaagggaagagcaagacaagctctggtttaggaagagagctgtggcagcataaaggcctgaaagaggagacagagctgtcacccaaaatggacttgagagctccctgtggtttactctgtggctagaaaacactgccggccagatggatcacaaatgtctatggtagcttagaagctctgctcttgaagaggatcctgggatctgcccaacacccttcccaacctccatttccccatccccacctccattgccccatcccccctctccccctaggcaggtggatctgagccttatcccaccaccaatgcccctgctagcctctccccacccagcccagagcctactcagcctgccatctcaagagccccaccgagggtcactggcttcctgggaggagtcaccaggctgccagctttccctctgcctccccaaggaacctgagacctccctctgctcatcaccctgggcccaatcctgaatccagcccccatcaaccaagacagcaaaagggccaggtctgtcccttataattttgagccttctccctcaagtttggaagccctgactttaagaaatgccaaatgcaaggaccattaagaaaattctccccgaaatgaggctcctctaacaaatgatgattaaaacgctctctccttgagcagtcacattctagaaacaggacattccatgaggcaggaagagttcagttaatttgctcctgaaaaagtgtggttcagtgtttgtgtggcaatgtacgtgggcagaagaggccgctcaagctgtgtcccccctgagcaggattcaggaaagggaaaagaagttctcttcaactcagccaaggggccgtacgatggccgatgagattatgtatttaaaagttctttgtaaagtgtaaactaaaaaccttaaatgtaagatgctgttgttattattactgttgttgttgctgttatggacatgccaaaaggcccttgttagaagacagttttgccttttcaatctcatagcaaggaactcaagtctgatgcttcaaaaagatgagaagaagggcaagaagagggataactcccaagctcagagggaaaaaaaaggtgggggaaaagagccccagggtgaccttcaggaaaggccaggaccaggatgatctaacctttcccttcaccagaaacaaagctattgccagactgaaccctaaagtcaagcagtcacccactgcctttgctgggagcagaagcccatagcaacaagtgacctgcccctcagactcaagatcccagataccagagctggaggagtcatagggcattactggtaggcaggaaaactgagggtcgaacaaatggaagaatgcggtgatcatagaccaaagacacacagataattaaccccatgtgtccacccaggccaaagttcttcctgctaccccacagtggatgtccaggcagatggtccccacatgatggggaagcagagggcatagtgtggttttgtgggacttgttcatgttttgtagtgtgggctcaacagtgccaaaggaaacactagggaaaagttggtgaaacatgccagctagcaggaccagtaaaggcataatcaggcatttggcaaagcttgcttttctaattcaatgataggttctaataggaaatttttgaagattttttaaaacaatgttatagtggcacttccccagtatggaataaataacatgcattcttttttcaatatactgtcatattcagatgtcattaaaataaatggatgagtcacagaggagctatcagatgctctcatgactaccataactca

SEQ ID NO: 182055 - DNA, 23331 bp, Homo sapiens
  Payload ID: 15852
  Gene Symbol: SRGAP1
  Gene Name: SLIT-ROBO Rho GTPase activating protein 1
  Uniprot ID: Q7Z6B7
  ENST ID: ENST00000355086
  CDS Start-End: 525-3782
cgggacccttgagcgccggagccgacagctggaggcaggaagggagggttgtggcgcccgagctgggcgcgttcccagcgcctgccctccgccgctggccctgtcccgggcgcccggtgcgggtctcgaacaatggtgcggagcgccggcgcgagccccgcgcccgcccagcggccgtagaggaagtggccgggctcccggcgaggtgggcagggagacgtcccccgccactcgctggctggagtttgcctgcgcgtccggcctctcccccggggatcccctgggattaccgacggagctcaatttcgagagtatggtgccagcgcccgggctaatctagtcctctctactcgctctttttcccctcctcctcctacttctcctctccctcctcccttccctcgggtcggcgctgcctctggattgcctgcgtgtgggagtacaactctgcctctccaaggagaacgggttgtgaccactgaacaaaacttgcccattgaaagcaaacccggaacagctggataatgtccaccccgagccgattcaagaaggacaaagagatcatagccgagtatgaaagtcaagtcaaagaaattcgagctcaactggtagaacaacaaaaatgcctggagcagcaaacggagatgcgagttcagcttctccaggatctgcaagatttcttccgaaaaaaagctgaaattgagacggaatattcccggaatctagagaagttagcagaaaggttcatggcaaaaacaagaagcactaaggatcatcaacaatacaagaaagaccagaacctgttgtctccagtgaactgctggtatttgctcctgaaccaagtaaggagagaaagcaaagaccatgcaaccttgagtgacatctatctgaacaatgtgattatgcggttcatgcagataagtgaggattctaccaggatgtttaaaaagagcaaagagattgcattccaacttcatgaggatttaatgaaggttcttaatgagctttatacggtgatgaaaacataccatatgtatcatgcagagagcatcagtgcagagagcaagctgaaagaggccgaaaaacaagaggaaaagcaaattgggagatctggtgatccagtcttccatattcgactagaggagagacatcaacggcgaagctctgtaaagaaaattgaaaaaatgaaagaaaaaagacaagcaaaatattcagaaaataagctaaaatcaattaaggcacggaacgaatatctcctaacacttgaagccaccaatgcctcagttttcaagtactatattcatgatctttctgatttaattgattgctgtgatcttggctaccatgcaagtctgaacagagccctaagaacatatctgtctgcggagtacaaccttgaaacctccagacatgagggcttagacattattgagaatgcagttgataatttagagcccaggagcgataagcagagattcatggagatgtaccctgctgcgttctgtccaccaatgaagtttgagtttcagtctcacatgggtgatgaggtgtgccaggtcagtgcccagcagccagtccaggcagagctcatgctcaggtaccaacagttgcagtcccgccttgccacgctcaaaatcgagaatgaagaggttaagaaaacgactgaagccaccttgcagacgatacaagatatggtcaccatcgaggactatgatgtttctgaatgcttccagcacagtcgttccacagaatcagtgaagtccactgtctctgaaacctacctgagtaaacccagcatcgccaagagaagagccaaccagcaggaaactgaacagttctacttcatgaaactcagagaatatttggaaggcagtaatctcatcacaaaacttcaagccaaacatgacttgctgcagaggaccctgggagaaggtcatagagctgaatatatgactacaaggcctccaaatgttccccctaagccccagaaacacaggaagtccaggccccgctcacagtataatactaagttgtttaatggggatttggaaacattcgtcaaggactcaggacaggttattcccctcattgtggaaagctgtattcggttcatcaatctctatggtcttcagcatcaggggattttcagagtgtctggttcccaggtggaagtcaatgatattaaaaattcatttgagagaggtgaaaatcctttggctgatgaccagagtaaccatgatattaactcagttgctggcgttctgaagctctatttccgtgggctggaaaaccccctctttcctaaggaaagatttaacgatctgatttcttgtatcagaatagataatctctatgagagggcgcttcacatccgcaaactcctcctgactttgcccaggtcggtccttatagtgatgaggtacctctttgccttcctcaatcatctatcacagtacagcgatgagaatatgatggacccttataacctggccatttgctttggcccaacattgatgcctgtcccagaaatacaggatcaagtgtcttgccaggcacatgtgaatgaaattatcaaaaccatcatcatccaccatgagactattttcccagatgctaaagagctggatggccctgtttatgagaaatgtatggctggagatgactattgcgacagcccatacagtgagcacggtacattggaggaagtggaccaagatgctggtacagagccccacacaagtgaagatgaatgtgagccaatagaagcaatagccaagtttgactatgttgggcggtctgccagagaactatccttcaagaagggtgcctccctgctgctgtatcaccgtgcatctgaggactggtgggaaggcaggcacaacgggattgacgggctggtgcctcaccagtatatagtggtgcaggatatggatgatacgttttcagacactctgagccaaaaagccgacagtgaggccagcagtgggccagtcacggaagacaagtcctcatccaaggacatgaactccccgacagaccgtcatcctgacggctatttagccaggcaacgaaaaagaggagagccaccccctccagtaaggcgtcctggcaggaccagtgatggccattgcccgctccaccctccacatgccctttctaactcctcagttgacctagggtccccaagccttgccagtcacccccggggcctgctgcagaaccgtggcctcaacaatgacagtcctgagcggaggcgcaggcctggccatggcagcctgaccaacatcagccggcacgactccctcaagaagatcgacagccctcccattagaaggtccacgtcatcagggcaatacacgggcttcaatgaccacaagccactggacccagagacaattgctcaggatattgaagaaacgatgaacacagctttgaatgaactccgagaactggagagacagagcacagcaaagcatgcccctgatgtggtgctggataccctggagcaagtgaaaaactctcccacccctgccacttccacggaatctctcagccctttgcacaacgttgccctcaggagctccgagcctcagattcgacgtagcacgagctcctccagtgacacaatgagtactttcaagcctatggtggcacccagaatgggcgtgcagctgaagcctccagcccttaggccaaaacctgctgttcttccaaaaacaaatcctaccataggacctgccccacctccccagggtccaacagacaagtcatgcacaatgtaaaaaccagccaagcaaggccataaagggaggtgacttaaaaaagaaaatggattagtgacaaaagtcactgatccataactttccttagttttgtgcttataactggagatcttttggcttttctatgttgtcgaatgtaatgtctgagactagctaaattaacacgggcatttgtattttgtaatttttttaaataactggacatatgtcattttaaggacaatagaaacacttagacttacttgaaaatccaatgctgcaccacttgtaatgaaggcaacaccgctctccacattgtacagagcttcaggtttaatgtagcccagctgagtcagaaaggttgtgacctgaaggcagaagaacccgaatgccacacctcattggagtatagccagtgttggtctgtggcacttgggctgaaaggtgataatggcattgcgtggtagctgacaatgagcaccttcggttccatgtggagcggggtttagctcatgcaaaagacttgcaattgtctccatgggacgatcccagtgggactgtcagcccacagctcgagtgggttggatgcttgcctctttcctaacagttatttccccgggtccagcttaaagactcgatggaaggaggtagaacctctgctgttactgcttgaacttaacctgggaaaggagaggaagacaccatctccaaagctattaatgtcactccttttgcgagcatgattaggccccggagatttccaagtccccccatctacacttacaaacgattagaagggtttaattttaaagactttctggttacactactccacgaactcctccaaagatccgttattcaataactgcctagaaaatgtttccatctcctctaaatccctgtgttctcctctgtggaaatgaaggcagcaagaagcacctgaggccttggttcatgcagtgttctcttttgactaaatcacctaggttcctttaaacatgctacaaagcccaggcatggtggtgcacacctgtactcccagctactcgggtggtttacacaggaggatggctttgggcctagtagttcgagtccagcctgggcagcatagtgtgagaccctgtctcttaaaaaaaaaaaaaatgctacaaagtcctgatgatcctaaatttgaaatcccaactgtcctctccatttgtctttgagccaaccctgaactggccctggtacctgagtaagagccatgcagggccatcagcagaacatggccttgtggttctcacccagttgtgtacctcacaaccacaacttctttttctttgtcccttttcccctttttggttttggttttgtatgtgggctctatgtaactcccatagtcagctgaactctcaattggagaccctctttctctggcatcctagcacacaggcaattttttaagcctatatttatgctacattttcccccatcttaagaaaatttgctttgatttccattctcctactagcagcagctgatatcacctgtagacctatgagcattttatctattctatcattgaagttactgataaagatttttgttgttgttgttgttgttgggagaaatggatttcccacaactaatccctctggcccaccattaatttccttcttggtttcatttcaaactggcagccaattgcacgcccatctaagagctacacagtgtagattttacttcatcagcccattggtgaatgcatcgtgcagaaaagaactgggatctgtactaaaatcaagatcattactttgatctctacctcagtttgccagtgtagtcattctattgcaggaagagattaaattgatgagatattgttactttcagagtcacactgctgattgcttgcctggggcctaatttcacaaatgaatagtgacttttttcccatgtatttctaggtatggtaaacttttaaacctccaaattttcagagccatactttttgcccattttgaaaaagaagcccaggacagcaccttgtctagcccctccccatttctcctgagcttttggggtccttcagcacccttggacaccgtggagatccagccaagactgagctttgaatagcactagcccttttaaacaatcctcacaaattccttaggaatttaaactttccaaaataatcccccacttttttttttttttttttttttttttgagttggagtcttgctctgtcgcccaggccagagtacagtggtgcaatctcggctccctgcaacctccatctcccgggttcaagcaattctcctgagtagctgggattacaggcgccaccaccacgcccagctaatttttgtatttttagtagagatggggtgtcaccatgttggccaggctggtctcaaactcctgacctcaggtgacccaccagcctcagcctcccaaagtgctgggattacagatgtgagccaccatgcccggccattccaccacttctttaaaatagtaagaattcttaaaaaccatattccttgtttgatggaagagtaagatgttaacagagggcatcaaagggccagaggtgtctttgaatttattttttttcaatgtcttttctgagcttcagccttagcttttcagatcttcctcctacctgttcatttattcagccttctatctggtcatcctccccagcggctcctctctctgatgtgtccacctacggtggaacgaggattgcctttctgtgctccccatcaggactttgctgtcttggccggcaggagtcgtgctgctgcagagcctcacaggctgtgccttgtttcaggaaacagctcctaatactctcccatcactcactttacctgtctccatcttatttccctatactcctattgtcagcttgagactttttttttttttcaattccaaatgaagggtatgacctcagagtgagtgaggactcagtaaagactcacctctccttacttggtttattaaatgtcttcagattccagagataagacaaggtggccacttcacaaagaatccagaatcatgctcagtaaagctcattaaaagccactgcagctgagaaggttcacagcccttctttatagccacagaggcagcacacaggggaggtgggaagacacagggaaacgagagaagaaggataatgaggccttgaggtgttctgcccccaatttcaaggagcttatcaggcttcatgtgcaatttggggaggggagctttttgatggtgggtaaataatggctctacaaagattacctgactccactgacacaagaatatgtattctcagctgatataactgtgtgttcacatcccatccatagaactcactgaaggagattcatcaagtcagccttttggactgggttggggtttggggagtggatttggggatagagagaaaggtgtacttagtacacattttctaatgggcgttacgtgaactgtttgaacctgctgagtggcgctttgtagagctccatgttcacgttcagtgtcaacaccattcaacagctttgcacatcttcgtacaacataatctggctttggtgccccttgagccacctgtagaataatttatagcagggtcccacaatctactgcaatgatcgtgaacagttatcagtggatatagtgctccaagagtcaaattgtatccgttaagggttttctaacttttgctatcccccccgcgaccaaaaaaagggggggtttataatttaaagaaaaggaaaagaggcgtgggttggtagttgtgtccttaacatttaggaatgacatagcctctggagtctacaaactgaagaaactttcatctgatcagccttggaaatccaaagttaaagagcctatgtgtctcttgaggcgggggttagaggattcaaatttgggatgatgctcattgattcctgaccatagcagtgagaggccattttttgtgcaggaaatgtgcttaggactcagtcttgttttcgattatccaccacagaaaccctgagacacagagcagcttagaagtctctacccaggcgtaaatagagctccctactccagaccacctgccacccacctcccaagttgagaacacaagctccagctgggctggagagtcaggcttggtgcagggtgactttggcgaagttttgtcagatccataaagcaaactggaatttgagctttcacttaccctagtatacgttcttaaaaaaaaaaaaaagtctatgtggtataatcgagatggatacctgtgtctttaaattacgtagggaattttgtatgtttaaataattgtactgggttccataatgcttatcttagaaactttagtaaaagaaaatatatgaaccgtgcatttgtgaatgccccccttagagcattcatccaagttcagtgtgtagtgtgatggttattatagatatttaaagtatagtaagtggctgtgtaacaggagagactgctgtttacctacgtactgaagggtaactgctgcccgcgtaattaaatcagtattgtcctttcctgtcggtttgatcaattgcggtaccggtagcttcctgcttgtgactgttacctaattgtgtcaatgtacatctgtagtatgtacatgtgaaagtgcctttctattttagaggagttttagccttgctcttgtaccgttgccccgctctgtgccccacccccacctcctcctcccaattcctgctgcccactcgagtgtttcgaagcttcctccctgtcccccaccttccccatccccgccttcctgtgcctcggtgctcagtaatgtcccatctcacctccctgtcggtcctcagactgtctcgttttccttgtagacgtgattgtgcctttctcacccctgtgtcctcccatcccaccgcatcagtcccccgctcatgtgctgctgacagcatcgcattcgcccgtgctctgtactgcctctcaccatttcattccctcctctctgaggtgaaaataaagggggatgcttttacagtctggaaagaaaaaaaatgttttgttaatctgttgtgacaatgcacttttatgtatagtactgtacatttttggcatgtaccattacaggcttcagtatacagtcaggtttgttcttcacggtgtatctttataataaataagatagttctggctgcctttgtctgcttccagtttgatgtgcatctctgtggtgtctttgttcctttcctttcattcatcactactttctccttgacagctagcttgcattaaataatgtgaaacttttacctttaaaatatttttttatctcactttcatttcttgttcatttggaaatagggtgtcctgcacagggccctgcccatgaagctgtggtttttcagtcatggtttggaggctcaatgtgtagtcagagaaaagagtcttggcagacacttaactgagaagctgagagtgtacaagcctcctaaacatacaccagattgaaatctttcttttgagaaagactctagttaaccacggcaagcccatctttggtttcatttgaataaattgaaaaataatccttaggttatttttctgtgcttagaactccccgtgtattggtatttttctttacttttttttttttttttttgagacgaatctctctgtgtcacccaggctgtagtgcagtggtgcaatctcagctcactgcaacctccccctcctggattcaagcgattctcctgcctcagcctcctaagtagctgtaattacaggcacccgccaccacacccagctacttttcgtatttttagtggaaacggggtttcaccatgttggccaggctggtctcaaactcctgacctaaagtgatctatctacctgcctcagcctcccaagtgctgggattacaggtgtgagccattgcatctggccaggtatttttctttaaatataaaaaaaagataacttgaggtctagcaatatgtagtagatagctttgtaaaacaatgtaagttgtgcaagattgaatattgataagatataaagtttaaaaaatgacaggcaaatcaaggaaaaacactttttattaaagtgcagaatactaacaaaagtgtgcaaatcattagtgtaacagttctcacgagctgacacactgatgtatccaccacccagtttaagcaatagcacattatcagcatcccagaagctactgtgctcatgcctctgtgaatgtatcagtatcctgactaatcacaccatggtgtagttttgcctgtcatcttagctttctataaatgggttcatacagtatgtagattttgtgtctggctccttttgttgaaatgtatgtttgtaagagtcgtcattgttagtaaaatagtggtttttccatttttactgctatatagaattccattacatgaatatgctcaatattatatttattttagtatttcctgattaaactttgggtagtatatgcagatatctttaaacatggagaaatgaatggggggtgagggacccacctgtcaaaggaattgttttcccaaactatgacggaataatgttgaactaacctgttgaccggaaggcctactcaaaggcaaggatacttttctttctttccaaaaaagcactgtctgatatggagactggaaatattcatagatgacactgaaactagttgaagctttacttgatgcttatcaagtcatgttctcttacccgatgctggatgctttttcttcaatgcctactttaggaccacagagttggatttagaggctagcccaccaggaacaaatgcccaaatcagtctgtagagttgttccaggaaagactccaccatcctgctaccctcaaatcttaagctcctcagcctgccacgaccatctcctgttgagaaaattgcgcctgcctccccatctctcactcccgaaccagagtcccaacggggtgtaactggtcgtcagttcccacagttcatatgcctgcaccctgtaagaatcttagaaaggcagagcaagggtgtttgctggcttctgccttgagtagttgggactcctaaaaaggaaaattccccaagtttgacctagaatgtcaaaaaggtcctaaaagcacagaatgatggtaaattctatccacaggccatatagccctggaaaatattgggaaactgaggcatgggttggtaatttattgaagtttagtaaacgaatttgaattaattaggaccagataatcaatttttggcttacttatactatagtataagcaaataagtatttaaactttagtataaatatttttgctcacttaataatcacggtgaggttcatcacctcttcagtagccttttatctgtttctacatagtaaatagaaaacttgccttctataataaaaacaaaatagtttttctatcaaggtcagtctcagcaagagaaatgggactgggctggatatcaacacatgtgcttgtgtgcatgtgcacgtgtgtgggtgggagggtgcggaggggttgggaagagagattgctcctcccgcagtgctgaaacaacatgccttgttcagtattaacatcttgaaggcagttatggcagcatgatccaggagatcgtcagctctaggatatttgcgatccaattctggcgacttatggatggatccttcacacccaacagctgtctatcaggggtgcttccgagggtcactgggtttcttttagctgcttggctgtgcagctgaagttaggacttttgatgaattaccctctcaatgatggtgtattgttctaatcttctgtctctgacatacccaaggaaccccttgtgtaaaaatcatgtccctctaaatgcaagtggatgattgtgccaataagccaggagagaaggaaacatcttcagtggtccagtggcacattcaaaattgtacaatgacatgacattaactcaaaaatgaagtttgaggttctgggcctttgatggactgcatctattaaaaacaaaaagtggtgtctcatgcctgtaatcccagcactttgagaggccaaggcaggaggatcaaaaaatgcgaatttttatatttttttgtgagatcccatctctaccaaaaaaaaaaaaaatacaaaaattagccagacatagtagtacatgcctatagtactaggtacttgggaggctgaggcaggaagattgcttgagcccagatgtttgaggctgcaataagctatgattgcaccactgcactccaacctgggtggaagagtgagaagctatctcaaaaaaaaaaaaaaaaaaaaaaaaaacatggtcaagatttgtaatagaaattgccatttgaattttggtctgtaagcccaaagattgttactgtgttagtaactaaatattacgagatgcattaggaaaagaaggaaaagaaattttaagtaagccaaaaatctattatatagtcataagtcaaactcagttactagacttcaacaaataccaacccatgcctccatttcccaaacagaaataataatatgaacatcttagtatattgtcttctaatccttacattatgttatttttaagcagagtcaaactcatattctgtatataattgtatatacattgggtttttctcccttatagcaattcacactaggagtctcagtcaacatgattttttaatggctgtataatattctagcgtatgaacacatcattatttaaccattttcctgtcactgagtgagcctgtttgaaggttttgtttttttttcaattgaatgttatgttgtggtgagcagctctgtatataataattaattgtctgtgtttggatcataaagttagcattgactccaaaaagtgaaatcactgggtcagaggatgcaattatctgtaaggctcatgacaaatattgccgacctgttttccagcaaagttgtacaaatttacatccctgccagtaatgcataacagtacacgagtataaaacatggtcatgtttctttaccagtgtactaggtgagtgataggctcaatgcaaattcttagcagtttgttaatgtgcacacccacatttccagagtacaaatctctatttcactcacctctgtgtcctaaacttcagatgactctttattgtttcagctaaacatcagcaaacagagattttcctcaggcaccttaagctcaacagacccaaaaattaaacccactttgtttcattccaaaaaatattctgcagcccctctacatcctccaatctgttccgctgcctatctctgctctaagctaattctgtgcaccattccccttgccacaacgattgccgtagcttccacggtggtgtggctgtgcccactgtctcctccttgaaatgattatctacactgctgccaataaatcatctttctcaaaaacaaaatgagaaacctaacaaacaatcattgaaaatgtaccatgtactgacatcgttttcctcaacacgttgcatgtcaatagccaacatgtattgagtaccagactccatgctacaaatgttaaccctcataagaaagccaagagagccacagttattatcatcatctttatccgtaagaaaattaagccgcaggagttaaacacttgccctggtcacacagctagatagtgacagagcaggatttgattccacgccatctggtgctggaggctatgctcataaccactgctgcattctgacctctgtaacatgctcatgtcattaccctgctcaaaagccacacgtgggtccccactgctgcaggacggcatactactgtgtcttattcatctttgtatcttcaagcctaatgcatcactaactaaatagcaaatcggcggaactgaaatgaattcaatgtctgccgctttgacctcagcctgccatttcagccttcctgctcaccacctcctcttcggaacctttagtttcagccatagcaagctacctttctttgaaaatgtgatgctgtgtgctccctccgcatatacttcatgtcattcctcagcctaaaatgtcccctacttcatcctgacaactgcctgttgaaattatattcatcattccaaacccaacaaaatggttacatccttcatgaagggttccccaaacctcccagctggcattaattgttctgttacattttgttttcattaaatcaggctcccttccggggatctagctgtgaatgagacacacagggctcctggtctcatggagtgtacttcctggtatgatttaaaaaaaaaaaaaaaaaaaaaaaaaccactacataagccaacagctaaaccggcaaaataatttcaggtgttgataactgctacaaaaagcaaaagtgaaataaacagggtgatagaatttagagtgtctaggagaagcattttagatgggacagcttgaatgccaccttggatgtggtagcatttgagctaagacctgaataatgagaaggaaccagccatgtgaaaaggaagagaaagacccaagcagaaggaactgcacatgggaaaacaggaccatgctcacgtggttaaagagtcaaacacattcactgtgactgtaccaccataagcaagaagccctggagatgaaaataaaggccagaatgtggacagagatcagattttggaggccaaagtaaggtacttaaaattagccgggcttggtggtgcacaactgtaatcccacctactcgggaggctgaagcaggggaattgcttgaacccatgagacggaggttgcagtgacccgagattgtgccactgcactacagcctgggcggcacagtgagactccatctcaaaaaaaaaaaaaaaagtaaggtacttagatgtcattctaagttcaaggaaagccattggaagtttccaaaaaggaacatgacagcatctatatttttagaagatgaccctcaaaaccacaatgagatatcacctcatacccattaggatggccactctcaaatgatcaaactccagaaaataacaagtattggccagggtgtagagaaactgacacccttgtgcactgttggtgggaatgtaaaatggtagagccactaaggaaaacagtgtggaagttcctcaaaaaattaaaaataaaaccctcatatgatccaccaagcccacttctgggtacatatccaaaagaattgaaaacagaagagatatttgcacactcatgttcacgcagcttaattcacaatagccacaagagagaagcaacccatgaatggatgaatgggtaaagaaaatgtgccatacacataaaatagaatattatgcagccttaaaaaagaaggaattcctgtcatatgccacaatatggatgaaacttaaggatactaagctaagtgaaatgagccaatcaataaaggacaaacattgcatgattttacttctatgagatatctaaagtagtcaaactcttataaacagaaagcagaatggtgattgccagggatcgggatgaggaagaaaatggaaattgttgttcagtgtttacagggtttcagttttgcaagataaaaagttctaaagatctgttgtccaacaatatgcatgcagataacatcatattaaacatggttaagatagtaaattttatactatgtaattttttaaccacaattttaaacatcactgtagatgttgtagttgtgtttggggtccacgggtggggaggagcttgggaaggaatggcatgagggaagtgagagaccacaattaaggagcaacacaggagatgagggtggcttggactagatagccaggtagaaggagaggaagggatgaaccgggggttcgtttcagagtcaaaatcaagatttgctaataaattaaatatgggaataaagaaagaaaagaatcaagagtggctcctagtatttgtttgagcaaatgggtggaatatattgatatatacttaaaaagaatgactggggaaaggaagaagttggccaggatgtacaaccaagtattcacgtttgaatttatttaatttaagataggtattagacttccaagtggagaagtctaggaggcagatggacttgaagctcaggggaggatttctggccagaaggtgtaaatttgatatttaaagctatgggactcccggaaagagaaagagaaaggaaggtacagagcacataaccaagccctgggaagcccagcttgggagagcttgggtggagtgaggagctggcagaggagacagaaggagcagccagggcggaggaggaaaaccaggaggagcatgtaatgtgatcagtacccagggaagaaatgattgccatttctagtgtgcatttgttaacataaatatgataataaaaatagttaacatttgttaaatatatatatttttttctttttctttttcttttttttgagacagagtctcactctgtcacccaggctggagtgcagtggcatgatcttggctcaccgcaacctctgcctcccaggctcaagtgatcctcccacctcagcctcccaagtacgagggattacaggtgcatgcaaccatgcccagctagtttttgtatttttttgtagagacggggtttcaccatgttgcttgttaaggccgggcacggtggctcacgcctgtaatgccagcactttgggaggccgagacaggcggatcacctgaggtcaggagtttgagaccagcctggccaacatggcgaaaccccatctctactaaaaatacaaaaaaattagccgggtgtggtggcgcccgcctatagtcccagctgttcgggaggctgaggcaggagaattgcttgaaccagggaggtggaggttgcagtgagccaaggtcacgccacggcactccagcttgggtgatagagtgggactccgtctcaaaataaataaataaataaatatattaaaaaataaacaagttcaggcttgttaaatattttttatgtttgtttgtttgctttgttttttttgagacgtagtcccgctccgtctcccaggctggagtgcagtggcgcgacctcggctcaccacgacctcggctcaccgcaacctctgcctcccggtttcaagcgattctcctgcctcagcctccagagcagctgggactacaagtgcgcacaaccacacccagctaatttttttgtatttttagtacagccggggtttcgccatgttggccaggctggtcttgaactcctgacctcaggtgatccacccgcctcggtctcccaaactgttggcattacaggcatgagccaccacgcctggctgagttaaatattttctatgtgccaagcactgtgctaactgctttcatattatcggatttagtcctgtaagaccggaatcattattatccccatttttcagattaaaacaaacaaacaaaagctgaggtttaaagaaattatctcttgtaaaatcacacagctaacaattgagccagtatctggacctagatctattgcctacagagccgcacgtttaactactgttatcttgcctccttattgctccacacacttgaaatataaatttttaaagacattttattcttttttgtcttcatcagaatttattgaatcctgattattttttccttaatgttgattttgtagactcatttgcaggaagaacaatgtcaggtggagagaaggaattgaatgaatatttttaataaatttgtagatgttaatatgatttacttatttgcaattttcatagctatatgatattctatcccatttccagtgtttttgctcttttagtagcaaatactctgaatctctgcatatgttactcattttctatcatcctattccttgtgatggatacccaagggtactcatctacaggatgaaagggtatgagcacgtttctaggtgccctgaccccaagattaggggttttgttagaggcaaagctaaaaggaaatgataaaataaatgaatatttatagaagttaaatctattaatctagccttattacaccgagtacaacagggaataataagccatctatctgaacgtgcacggttagggcctcaaggaaagtgggctcagcaatgagtgttggtacacatggaaaatcacatttgccatgttttctatggctttgggctgctgctgcatcactgcagtttaataggaggaggctggtgaaaatgttaccaactgccaggggtcaatggcgaaagaacacatttctctaggaaagattaccttctctgaagaagtgatagggggaataaggcataaaattatctgacctgagagaccttaacagctaggcctgcactgctcatgctttgggaccagaaagcggatggtttgatatggtagctgcacttctaaaaaaaaaagggggcattcttggcaggagaaagggtgttacatggaaagatcagcgatagtacacacgccttcccatagagtgaggtggctttcccacccctcaacactccttcagacccccactgtaacaaagggatgtgtctacctctaaattcatcatttactgaacaaataactcatgagggttaccatatgtctgacactgtaggaagagctgaagcagggcctaaaacactatagtgcaagtatctgtttacacatctgtatgagagtaattgatgctagctgctgtaacaaacaaccccccaaactcagtaacacaatcaagctgtatttctccttcacatcatagcctggtgtgggtcaggtaggtgactcagggttctaggctccttccatttttttgtcgctgccacactggaaatgggatagaatatcgtatagctatgagaattgcaaataagtaaattatattaacatgtacaaatttattaaaaatactctttcaattccttctctctgcctgacattgttcttcctggaaatgagtctacaaaatcaacattaaggaaaaaatgatcaggattcaataaattctggatagaaaaaagaataaaatgtctttaaaaatttatatttcaagtgtgtgggggcaataaagaggccagataatagtagttaaatgtggggctctgtaggcaatagatctaggtcagatactggctcaattgttagctgtgtgatttcacaagagataactgatgctagctgctgtaacaaacaaccccccaaactcagtaacacaatcaagctgaatttctccttcacatcacaacttggtgtggatcgggcaggtgactcagggttctgggctccttccattttttttgttgctgccaccttagtacgtggccaccatgaagaggaagagaaagcacttgcaatgatgtgaggttttctgtcttggtatggaggagacatgaatcactactgtacatgtccaagtcacatggcaagggaggccaggaaatgtcatcttcctataatgcaagaaaaagaacccagggccgggcacagtggctcacgcctataatccccacaatttgggaggctgaggcaagaggattgcttgagcccagagcaattaaacactgcctggtgcatagttagtgctcaagaattgtgctataatcaatgttactaaattatctaggattagatgtttctaaattaaaactatttcctgctttgtatttgtcctttattccaaaaacttaaaaatttctcatttctggtttgtcagggatgaaatactaaagcaacttcatggattgtgatttcaagtatatgaaaagtttaagacccaattgcttttgaaggagattcatctagaaaaaccagggattcaaacccaacacatcgggtgctaaagtctaccctcttagttgacatagaattaaattaaaatcagtattgattggattatgctttgataaaaatgtaacttcatttaagtctagtaaataattaggattatgaggtcaggagtttgagaccagcctggccaatatggtgaaaccccgtctctactaatgatacgaaaattagccgggcatggtggcgtgcacctgtagtcccagctactcgggaggctgaggcagaagtatcacttgaacccgggaggtggacgttgcagtgagccaagatcgcaccactgcactccagcctgggtgacagggtgagactccatcttaagaagaaaaaaaaagcaattacttttgcaccaacctaataaaaatgaaaaatcccaatgaaaatgcatgaatatcatgtgccttgacaacttacggagcatttggaacatgtcaaacagtaatcagaggtcaggttgaggaaaaaatgataagaaccctctctgccccaccattcacatcattcagtggatctatgtactaaatctagccagtgggttgtgagcaaaaatgatctgtgtcacttgtgggttaaaatataaaagagtgctaggcacactggctcgcacctgtaatcccagcactttgggaggctaagtgggaggatcgcttgagcctaggagttcaagaccagcctgggcaacatagcaagaccccatccctacaaaacagttttttaaaaaactagctgtagggcaggcacggtggttcacacctgtaatcccagaactttagaaggccgaggtgggtggatcacttgaggtcaggagttcaggaccaacctgaccaacatggtgaaaccccatctctactaaaaatacaaaattagccaggcgtggtggcgcatgcctgtaatcccagctactcaggaggctgaggcaggagacttgctttaacccaggaagcggaggttgcagtgagccaagattgcaccattgcactccaacctgggcaacaaaagtgaaactccatctcaacaaacaaacaaacaaacaaacagtagctggttgtggtggtgtgtgactgtgatcccagctacttgggaggctgaagtgaaaggatcgcttgagcctgggaggtagacgctgcagtgagctgagatcatacctctgcacttcagcctgggtgacagagtgagatcctgtctcaaaaaataataacaataacgtatgagagaggattcaagctttccaagcagtctcttcccctgccatggcactcatagaagcctcccgttaagatggcagagctgtaatgctagaaaagcacagactgttaagtcactgcatggaggatggtcatcctggagaattgtttggactcgagtggactctacaacagcaggaaataaactactgttatatcaagctactgacattgagaattaggttgcatagttatgccacagcataatgtagcctttcctgatgcatacaattacttttcctttcttttttcttttccctggagttcataattacctttgtttcatttgcttagctttctatttacataaataggtaaaaattccttctcaaaaatcttttacagaagtgttctcaaactcaatgcattgaaacatgctatagtttataaatcttggatccatcacttaaagaggcatttgacctgtttcagtatggataagttgttctctaagtctactgcatagctgagagcctaagatctctggggactcactccacttttctcttgagttggttccactatttcctggaacctcatacagccatctcagctagtcatgactgacctagatttaacacagtatatccttaatcagcttcctgattgagagtgtattttgagacattccatgtctagaaagtgtctttatctcacatgtaattgtgatagtctggctgagtataaaatcttacttaggatgttaacttaaaatcaatgtggtcaaggaaaggaggaaaaatatgtcctcctagtaattcccagtgtaagtggaaatgacccagccctagatttacttggctttagtttccatcaccatagatttctcaatcaaaaggcaaatatatctcatatgtcggaagattaatgtatgaataatcagtaccactggcatatggctactctcctattttccttacccctttgtcttcacaaggaagcccagactctgtttgccagtggctgggtcctggggccgataacttcaagctaaacattcaatatcagtatggtaggtgaggaagattttctcagagtggctcattatctggaaagtgtaagaatgaggtggcagaaagaggtagaaacagcatgaaaaggcagagccaaggagagatcgacaaacaagaaggattgtgcccatatttctctattctctctagcattatgaatcatttcccctcaggattttggagatgttgcatcagtgttgctaccgaacattccaaagccattctaattctgttactttgtatgttcttttttttccctatacataatttactattgcatgtttttctcagggtttctgaaatttcagaatatcctgatgtggatctattttgattcattgtactgaagaccatttcagcccatcttacactttgattctggaaagtcttcttttccctggagcttataattacttttatttcatttgcttagctttctatgtacataagtagataaaaattaattcattctcaaaatcttccacagaaatgctttcaaactcaatgcattaaaaacatgctatagtttataaaccttcttggatctatcaaggaagatttatttgattattttatctcctccattccatctgttttcttataattcctaatatttggaggttggacctcatgaactgatcctataattttactaattttcctccagtttttcatctatttgactttttgctctattttcagggaaatatcctcaactttatctgctaactcttctgttaagtactttatttctgctctcatgcttttaatttccaaaagctctttttgtgagctggctgttcatttttttatagaatcctgtccttatttgacaggtcctatatatttttttattttgagattattagtgatagttcttctaagttttcttctctctgcacactgtatttcctctaagttgcttttttaaatttttgacctgtgtttgctttgctttcgtttatgttacaggctttcctaaaattcctggtgatccttggctatctgctcgaatttaaaaacaagcactaaagaagggcactaaaaaacagattgtcatagcagtattatccataatagccaaatgatagaagcaatgcaaatgtccatcaacagagggacaaatgaataagcaaatgtggtatattgatacaatggaatactattctgtaatgaagatgggaaagaacggagtactgatacacgctacaacatgggtaaactgaaaacattattacgtgaaataagccagtcataaaccacatattgtgtatattttatccataagaaatgttcagaataggcaaatctataaaaatacaaagtagatttgtagttgctgagggctgggaaaagggtttggggagagaaatgactgctaatgggagtatgggatgttcttttggggctgataaaatgttccaaaattcattgtgtgataactacacatctgtaaatatactaaaaaccactgaattgtatccaataaagtactaaattgtatgatatatg

SEQ ID NO: 182056 - DNA, 5652 bp, Homo sapiens
  Payload ID: 15852
  Gene Symbol: SRGAP1
  Gene Name: SLIT-ROBO Rho GTPase activating protein 1
  ENST ID: ENST00000543397
  CDS Start-End: 1476-4544
cttgctgttaatgaacttggttaaacatggtcaagtgtatgtatgtatatattatcagtactggccttctctatctaagaggaatagcaagaaatttagagacattatttggacattgatttctactaactccactgaattagattcagccttcactttttgggaaatgcacggacactgggaaagatgaaatgaagaagttttccagcatgatgttcttgtctttggagcttagccttacttaggtcttagaacaaaaacaagtcggtagttattagttactgtatctcattttccaaaacacacgtttctttgttacagtcatttacacatatttttgcatgccacatttttgcttttgagcttttgctgaatcactaaatgaccacctttcatgttcctaatgtattaaaattatcagaggattctttgaggattaaatgtgtcagtaagggtattattttgaacaatgcgtaaaaggtgaaggccagctgaagaggcctttttgttgtgaacagaataatatactggaatctgaggactgcactgttatgaatggattatttggctatggaaagaagttatttttaggcacagcatccctataagccctgaagctatgtgttttacaaactagaaattatgcactaaataaaaattaccagatgtcagtctctgtatgtgccaaatggcaaatgtgtaatggttcagagcctggaagaaatgatgcttatttctttgccattcaaactcaaaagggatagctgaggtagagtgctgttgaaaaaattgcagtgtttccagctacccaaagatgttacgaattgttatctgaaaggctttcattctttcccctcatggctcgttgtgtgtttgtggcattacaaatgtaacccacatatttattctaatttattacattctttcctgaggctcctcttgttcttttaaagggtcagcagataacttattttaagaatcaacctggacacagtattctaacaaaggtccaatacagagctaaataaataataggagtcatagccagacacagtgactcacgcctgtaatcccaacattttgggaggccaaggcgggtggattacctggtggtgcatgcctgtagtctcagctactcaggaggctgaggcaggagaatcacttgaacccgggacgcagaggttacagtgaaccgagattgcgccactgcactccagcctgggcaacagagcgagacctctatctcaaaaataaataaataaatacatttaaaatatatatatatatatatatatatatatatatatatatatatatatatatatatatatttatatatatttcgtgacttatatcttgcacataccagcatacctcattaattttaatgtaaccatccattggcttctcttctctccttagaaattcgagctcaactggtagaacaacaaaaatgcctggagcagcaaacggagatgcgagttcagcttctccaggatctgcaagatttcttccgaaaaaaagctgaaattgagacggaatattcccggaatctagagaagttagcagaaaggttcatggcaaaaacaagaagcactaaggatcatcaacaatacaagaaagaccagaacctgttgtctccagtgaactgctggtatttgctcctgaaccaagtaaggagagaaagcaaagaccatgcaaccttgagtgacatctatctgaacaatgtgattatgcggttcatgcagataagtgaggattctaccaggatgtttaaaaagagcaaagagattgcattccaacttcatgaggatttaatgaaggttcttaatgagctttatacggtgatgaaaacataccatatgtatcatgcagagagcatcagtgcagagagcaagctgaaagaggccgaaaaacaagaggaaaagcaaattgggagatctggtgatccagtcttccatattcgactagaggagagacatcaacggcgaagctctgtaaagaaaattgaaaaaatgaaagaaaaaagacaagcaaaatattcagaaaataagctaaaatcaattaaggcacggaacgaatatctcctaacacttgaagccaccaatgcctcagttttcaagtactatattcatgatctttctgatttaattgattgctgtgatcttggctaccatgcaagtctgaacagagccctaagaacatatctgtctgcggagtacaaccttgaaacctccagacatgagggcttagacattattgagaatgcagttgataatttagagcccaggagcgataagcagagattcatggagatgtaccctgctgcgttctgtccaccaatgaagtttgagtttcagtctcacatgggtgatgaggtgtgccaggtcagtgcccagcagccagtccaggcagagctcatgctcaggtaccaacagttgcagtcccgccttgccacgctcaaaatcgagaatgaagaggttaagaaaacgactgaagccaccttgcagacgatacaagatatggtcaccatcgaggactatgatgtttctgaatgcttccagcacagtcgttccacagaatcagtgaagtccactgtctctgaaacctacctgagtaaacccagcatcgccaagagaagagccaaccagcaggaaactgaacagttctacttcatgaaactcagagaatatttggaaggcagtaatctcatcacaaaacttcaagccaaacatgacttgctgcagaggaccctgggagaaggtcatagagctgaatatatgactacaagccgaggacgaagaaactcgcacacaagacatcaggactcaggacaggttattcccctcattgtggaaagctgtattcggttcatcaatctctatggtcttcagcatcaggggattttcagagtgtctggttcccaggtggaagtcaatgatattaaaaattcatttgagagaggtgaaaatcctttggctgatgaccagagtaaccatgatattaactcagttgctggcgttctgaagctctatttccgtgggctggaaaaccccctctttcctaaggaaagatttaacgatctgatttcttgtatcagaatagataatctctatgagagggcgcttcacatccgcaaactcctcctgactttgcccaggtcggtccttatagtgatgaggtacctctttgccttcctcaatcatctatcacagtacagcgatgagaatatgatggacccttataacctggccatttgctttggcccaacattgatgcctgtcccagaaatacaggatcaagtgtcttgccaggcacatgtgaatgaaattatcaaaaccatcatcatccaccatgagactattttcccagatgctaaagagctggatggccctgtttatgagaaatgtatggctggagatgactattgcgacagcccatacagtgagcacggtacattggaggaagtggaccaagatgctggtacagagccccacacaagtgaagatgaatgtgagccaatagaagcaatagccaagtttgactatgttgggcggtctgccagagaactatccttcaagaagggtgcctccctgctgctgtatcaccgtgcatctgaggactggtgggaaggcaggcacaacgggattgacgggctggtgcctcaccagtatatagtggtgcaggatatggatgatacgttttcagacactctgagccaaaaagccgacagtgaggccagcagtgggccagtcacggaagacaagtcctcatccaaggacatgaactccccgacagaccgtcatcctgacggctatttagccaggcaacgaaaaagaggagagccaccccctccagtaaggcgtcctggcaggaccagtgatggccattgcccgctccaccctccacatgccctttctaactcctcagttgacctagggtccccaagccttgccagtcacccccggggcctgctgcagaaccgtggcctcaacaatgacagtcctgagcggaggcgcaggcctggccatggcagcctgaccaacatcagccggcacgactccctcaagaagatcgacagccctcccattagaaggtccacgtcatcagggcaatacacgggcttcaatgaccacaagccactggacccagagacaattgctcaggatattgaagaaacgatgaacacagctttgaatgaactccgagaactggagagacagagcacagcaaagcatgcccctgatgtggtgctggataccctggagcaagtgaaaaactctcccacccctgccacttccacggaatctctcagccctttgcacaacgttgccctcaggagctccgagcctcagattcgacgtagcacgagctcctccagtgacacaatgagtactttcaagcctatggtggcacccagaatgggcgtgcagctgaagcctccagcccttaggccaaaacctgctgttcttccaaaaacaaatcctaccataggacctgccccacctccccagggtccaacagacaagtcatgcacaatgtaaaaaccagccaagcaaggccataaagggaggtgacttaaaaaagaaaatggattagtgacaaaagtcactgatccataactttccttagttttgtgcttataactggagatcttttggcttttctatgttgtcgaatgtaatgtctgagactagctaaattaacacgggcatttgtattttgtaatttttttaaataactggacatatgtcattttaaggacaatagaaacacttagacttacttgaaaatccaatgctgcaccacttgtaatgaaggcaacaccgctctccacattgtacagagcttcaggtttaatgtagcccagctgagtcagaaaggttgtgacctgaaggcagaagaacccgaatgccacacctcattggagtatagccagtgttggtctgtggcacttgggctgaaaggtgataatggcattgcgtggtagctgacaatgagcaccttcggttccatgtggagcggggtttagctcatgcaaaagacttgcaattgtctccatgggacgatcccagtgggactgtcagcccacagctcgagtgggttggatgcttgcctctttcctaacagttatttccccgggtccagcttaaagactcgatggaaggaggtagaacctctgctgttactgcttgaacttaacctgggaaaggagaggaagacaccatctccaaagctattaatgtcactccttttgcgagcatgattaggccccggagatttccaagtccccccatctacacttacaaacgattagaagggtttaattttaaagactttctggttacactactccacgaactcctccaaagatccgttattcaataactgcctagaaaatgtttccatctcctctaaatccctgtgttctcctctgtggaaatgaaggcagcaagaagcacctgaggccttggttcatgcagtgttctcttttgactaaatcacctaggttcctttaaacatgctacaaagcccaggcatggtggtgcacacctgtactcccagctactcgggtggtttacacaggaggatggctttgggcctagtagttcgagtccagcctgggcagcatagtgtgagaccctgtctctt

SEQ ID NO: 182057 - DNA, 8406 bp, Homo sapiens
  Payload ID: 15852
  Gene Symbol: SRGAP1
  Gene Name: SLIT-ROBO Rho GTPase activating protein 1
  ENST ID: ENST00000631006
  CDS Start-End: 177-3245
gttgtgaccactgaacaaaacttgcccattgaaagcaaacccggaacagctggataatgtccaccccgagccgattcaagaaggacaaagagatcatagccgagtatgaaagtcaagtcaaagaaattcgagctcaactggtagaacaacaaaaatgcctggagcagcaaacggagatgcgagttcagcttctccaggatctgcaagatttcttccgaaaaaaagctgaaattgagacggaatattcccggaatctagagaagttagcagaaaggttcatggcaaaaacaagaagcactaaggatcatcaacaatacaagaaagaccagaacctgttgtctccagtgaactgctggtatttgctcctgaaccaagtaaggagagaaagcaaagaccatgcaaccttgagtgacatctatctgaacaatgtgattatgcggttcatgcagataagtgaggattctaccaggatgtttaaaaagagcaaagagattgcattccaacttcatgaggatttaatgaaggttcttaatgagctttatacggtgatgaaaacataccatatgtatcatgcagagagcatcagtgcagagagcaagctgaaagaggccgaaaaacaagaggaaaagcaaattgggagatctggtgatccagtcttccatattcgactagaggagagacatcaacggcgaagctctgtaaagaaaattgaaaaaatgaaagaaaaaagacaagcaaaatattcagaaaataagctaaaatcaattaaggcacggaacgaatatctcctaacacttgaagccaccaatgcctcagttttcaagtactatattcatgatctttctgatttaattgattgctgtgatcttggctaccatgcaagtctgaacagagccctaagaacatatctgtctgcggagtacaaccttgaaacctccagacatgagggcttagacattattgagaatgcagttgataatttagagcccaggagcgataagcagagattcatggagatgtaccctgctgcgttctgtccaccaatgaagtttgagtttcagtctcacatgggtgatgaggtgtgccaggtcagtgcccagcagccagtccaggcagagctcatgctcaggtaccaacagttgcagtcccgccttgccacgctcaaaatcgagaatgaagaggttaagaaaacgactgaagccaccttgcagacgatacaagatatggtcaccatcgaggactatgatgtttctgaatgcttccagcacagtcgttccacagaatcagtgaagtccactgtctctgaaacctacctgagtaaacccagcatcgccaagagaagagccaaccagcaggaaactgaacagttctacttcatgaaactcagagaatatttggaaggcagtaatctcatcacaaaacttcaagccaaacatgacttgctgcagaggaccctgggagaaggtcatagagctgaatatatgactacaagccgaggacgaagaaactcgcacacaagacatcaggactcaggacaggttattcccctcattgtggaaagctgtattcggttcatcaatctctatggtcttcagcatcaggggattttcagagtgtctggttcccaggtggaagtcaatgatattaaaaattcatttgagagaggtgaaaatcctttggctgatgaccagagtaaccatgatattaactcagttgctggcgttctgaagctctatttccgtgggctggaaaaccccctctttcctaaggaaagatttaacgatctgatttcttgtatcagaatagataatctctatgagagggcgcttcacatccgcaaactcctcctgactttgcccaggtcggtccttatagtgatgaggtacctctttgccttcctcaatcatctatcacagtacagcgatgagaatatgatggacccttataacctggccatttgctttggcccaacattgatgcctgtcccagaaatacaggatcaagtgtcttgccaggcacatgtgaatgaaattatcaaaaccatcatcatccaccatgagactattttcccagatgctaaagagctggatggccctgtttatgagaaatgtatggctggagatgactattgcgacagcccatacagtgagcacggtacattggaggaagtggaccaagatgctggtacagagccccacacaagtgaagatgaatgtgagccaatagaagcaatagccaagtttgactatgttgggcggtctgccagagaactatccttcaagaagggtgcctccctgctgctgtatcaccgtgcatctgaggactggtgggaaggcaggcacaacgggattgacgggctggtgcctcaccagtatatagtggtgcaggatatggatgatacgttttcagacactctgagccaaaaagccgacagtgaggccagcagtgggccagtcacggaagacaagtcctcatccaaggacatgaactccccgacagaccgtcatcctgacggctatttagccaggcaacgaaaaagaggagagccaccccctccagtaaggcgtcctggcaggaccagtgatggccattgcccgctccaccctccacatgccctttctaactcctcagttgacctagggtccccaagccttgccagtcacccccggggcctgctgcagaaccgtggcctcaacaatgacagtcctgagcggaggcgcaggcctggccatggcagcctgaccaacatcagccggcacgactccctcaagaagatcgacagccctcccattagaaggtccacgtcatcagggcaatacacgggcttcaatgaccacaagccactggacccagagacaattgctcaggatattgaagaaacgatgaacacagctttgaatgaactccgagaactggagagacagagcacagcaaagcatgcccctgatgtggtgctggataccctggagcaagtgaaaaactctcccacccctgccacttccacggaatctctcagccctttgcacaacgttgccctcaggagctccgagcctcagattcgacgtagcacgagctcctccagtgacacaatgagtactttcaagcctatggtggcacccagaatgggcgtgcagctgaagcctccagcccttaggccaaaacctgctgttcttccaaaaacaaatcctaccataggacctgccccacctccccagggtccaacagacaagtcatgcacaatgtaaaaaccagccaagcaaggccataaagggaggtgacttaaaaaagaaaatggattagtgacaaaagtcactgatccataactttccttagttttgtgcttataactggagatcttttggcttttctatgttgtcgaatgtaatgtctgagactagctaaattaacacgggcatttgtattttgtaatttttttaaataactggacatatgtcattttaaggacaatagaaacacttagacttacttgaaaatccaatgctgcaccacttgtaatgaaggcaacaccgctctccacattgtacagagcttcaggtttaatgtagcccagctgagtcagaaaggttgtgacctgaaggcagaagaacccgaatgccacacctcattggagtatagccagtgttggtctgtggcacttgggctgaaaggtgataatggcattgcgtggtagctgacaatgagcaccttcggttccatgtggagcggggtttagctcatgcaaaagacttgcaattgtctccatgggacgatcccagtgggactgtcagcccacagctcgagtgggttggatgcttgcctctttcctaacagttatttccccgggtccagcttaaagactcgatggaaggaggtagaacctctgctgttactgcttgaacttaacctgggaaaggagaggaagacaccatctccaaagctattaatgtcactccttttgcgagcatgattaggccccggagatttccaagtccccccatctacacttacaaacgattagaagggtttaattttaaagactttctggttacactactccacgaactcctccaaagatccgttattcaataactgcctagaaaatgtttccatctcctctaaatccctgtgttctcctctgtggaaatgaaggcagcaagaagcacctgaggccttggttcatgcagtgttctcttttgactaaatcacctaggttcctttaaacatgctacaaagcccaggcatggtggtgcacacctgtactcccagctactcgggtggtttacacaggaggatggctttgggcctagtagttcgagtccagcctgggcagcatagtgtgagaccctgtctcttaaaaaaaaaaaaaatgctacaaagtcctgatgatcctaaatttgaaatcccaactgtcctctccatttgtctttgagccaaccctgaactggccctggtacctgagtaagagccatgcagggccatcagcagaacatggccttgtggttctcacccagttgtgtacctcacaaccacaacttctttttctttgtcccttttcccctttttggttttggttttgtatgtgggctctatgtaactcccatagtcagctgaactctcaattggagaccctctttctctggcatcctagcacacaggcaattttttaagcctatatttatgctacattttcccccatcttaagaaaatttgctttgatttccattctcctactagcagcagctgatatcacctgtagacctatgagcattttatctattctatcattgaagttactgataaagatttttgttgttgttgttgttgttgggagaaatggatttcccacaactaatccctctggcccaccattaatttccttcttggtttcatttcaaactggcagccaattgcacgcccatctaagagctacacagtgtagattttacttcatcagcccattggtgaatgcatcgtgcagaaaagaactgggatctgtactaaaatcaagatcattactttgatctctacctcagtttgccagtgtagtcattctattgcaggaagagattaaattgatgagatattgttactttcagagtcacactgctgattgcttgcctggggcctaatttcacaaatgaatagtgacttttttcccatgtatttctaggtatggtaaacttttaaacctccaaattttcagagccatactttttgcccattttgaaaaagaagcccaggacagcaccttgtctagcccctccccatttctcctgagcttttggggtccttcagcacccttggacaccgtggagatccagccaagactgagctttgaatagcactagcccttttaaacaatcctcacaaattccttaggaatttaaactttccaaaataatcccccacttttttttttttttttttttttttttgagttggagtcttgctctgtcgcccaggccagagtacagtggtgcaatctcggctccctgcaacctccatctcccgggttcaagcaattctcctgagtagctgggattacaggcgccaccaccacgcccagctaatttttgtatttttagtagagatggggtgtcaccatgttggccaggctggtctcaaactcctgacctcaggtgacccaccagcctcagcctcccaaagtgctgggattacagatgtgagccaccatgcccggccattccaccacttctttaaaatagtaagaattcttaaaaaccatattccttgtttgatggaagagtaagatgttaacagagggcatcaaagggccagaggtgtctttgaatttattttttttcaatgtcttttctgagcttcagccttagcttttcagatcttcctcctacctgttcatttattcagccttctatctggtcatcctccccagcggctcctctctctgatgtgtccacctacggtggaacgaggattgcctttctgtgctccccatcaggactttgctgtcttggccggcaggagtcgtgctgctgcagagcctcacaggctgtgccttgtttcaggaaacagctcctaatactctcccatcactcactttacctgtctccatcttatttccctatactcctattgtcagcttgagactttttttttttttcaattccaaatgaagggtatgacctcagagtgagtgaggactcagtaaagactcacctctccttacttggtttattaaatgtcttcagattccagagataagacaaggtggccacttcacaaagaatccagaatcatgctcagtaaagctcattaaaagccactgcagctgagaaggttcacagcccttctttatagccacagaggcagcacacaggggaggtgggaagacacagggaaacgagagaagaaggataatgaggccttgaggtgttctgcccccaatttcaaggagcttatcaggcttcatgtgcaatttggggaggggagctttttgatggtgggtaaataatggctctacaaagattacctgactccactgacacaagaatatgtattctcagctgatataactgtgtgttcacatcccatccatagaactcactgaaggagattcatcaagtcagccttttggactgggttggggtttggggagtggatttggggatagagagaaaggtgtacttagtacacattttctaatgggcgttacgtgaactgtttgaacctgctgagtggcgctttgtagagctccatgttcacgttcagtgtcaacaccattcaacagctttgcacatcttcgtacaacataatctggctttggtgccccttgagccacctgtagaataatttatagcagggtcccacaatctactgcaatgatcgtgaacagttatcagtggatatagtgctccaagagtcaaattgtatccgttaagggttttctaacttttgctatcccccccgcgaccaaaaaaagggggggtttataatttaaagaaaaggaaaagaggcgtgggttggtagttgtgtccttaacatttaggaatgacatagcctctggagtctacaaactgaagaaactttcatctgatcagccttggaaatccaaagttaaagagcctatgtgtctcttgaggcgggggttagaggattcaaatttgggatgatgctcattgattcctgaccatagcagtgagaggccattttttgtgcaggaaatgtgcttaggactcagtcttgttttcgattatccaccacagaaaccctgagacacagagcagcttagaagtctctacccaggcgtaaatagagctccctactccagaccacctgccacccacctcccaagttgagaacacaagctccagctgggctggagagtcaggcttggtgcagggtgactttggcgaagttttgtcagatccataaagcaaactggaatttgagctttcacttaccctagtatacgttcttaaaaaaaaaaaaaagtctatgtggtataatcgagatggatacctgtgtctttaaattacgtagggaattttgtatgtttaaataattgtactgggttccataatgcttatcttagaaactttagtaaaagaaaatatatgaaccgtgcatttgtgaatgccccccttagagcattcatccaagttcagtgtgtagtgtgatggttattatagatatttaaagtatagtaagtggctgtgtaacaggagagactgctgtttacctacgtactgaagggtaactgctgcccgcgtaattaaatcagtattgtcctttcctgtcggtttgatcaattgcggtaccggtagcttcctgcttgtgactgttacctaattgtgtcaatgtacatctgtagtatgtacatgtgaaagtgcctttctattttagaggagttttagccttgctcttgtaccgttgccccgctctgtgccccacccccacctcctcctcccaattcctgctgcccactcgagtgtttcgaagcttcctccctgtcccccaccttccccatccccgccttcctgtgcctcggtgctcagtaatgtcccatctcacctccctgtcggtcctcagactgtctcgttttccttgtagacgtgattgtgcctttctcacccctgtgtcctcccatcccaccgcatcagtcccccgctcatgtgctgctgacagcatcgcattcgcccgtgctctgtactgcctctcaccatttcattccctcctctctgaggtgaaaataaagggggatgcttttacagtctggaaagaaaaaaaatgttttgttaatctgttgtgacaatgcacttttatgtatagtactgtacatttttggcatgtaccattacaggcttcagtatacagtcaggtttgttcttcacggtgtatctttataataaataagatagttctggc

SEQ ID NO: 182058 - DNA, 1477 bp, Homo sapiens
  Payload ID: 15853
  Gene Symbol: SRGAP2
  Gene Name: SLIT-ROBO Rho GTPase activating protein 2
  ENST ID: ENST00000419187
  CDS Start-End: 449-1366
catgttgtgcggaaggacttccactccccgcctgtgtcgttgatgtcagaccccaggccagcctccgggcgctgcagttctcccggctaatgctgaggctgcggctccggctctagcacaggcaccagccgccgccgcacccggccccagcgcccaccgtctgcatgtgcccgccgtagccgtctgcccagcccgcagcccgcgctccacggagcgctggagaccaccgtggggggccccttctgccctcgagagaagcggtcttggaggtattgatttaggtggttggattttttccgtggatctatcaattcacaattcgaatttggaagaaagaaggaaaacatgacgtctccagccaaattcaaaaaggataaggagatcatagcagagtacgatactcaggtcaaagagtaaagaagtcggccagcagctccaagatgatttgatgaaggtcctgaacgagctctactcggtgatgaagacatatcacatgtacaatgccgacagcatcagtgctcagagcaaactaaaggaggcggagaagcaggaggagaagcaaattggtaaatcggtaaagcaggaggaccggcagaccccacgctcccctgactccacggccaacgttcgcattgaggagaaacatgtccggaggagctcagtgaagaagattgagaagatgaaggagaagcgtcaagccaagtacacggagaataagctgaaggccatcaaagcccggaatgagtacttgctggctttggaggcaaccaatgcatctgtcttcaagtactacatccatgacctatctgaccttattgattgttgtgacttaggctaccatgcaagtctgaaccgggctctacgcaccttcctctctgctgagttaaacctggaacagtcgaagcatgagggtctggatgccatcgagaatgcagtagaaaacctggatgccaccagtgacaagcagcgcctcatggagatgtacaacaacgtcttctgcccccctatgaagtttgagtttcagccccacatgggggatatggcttcccagctctgtgcccagcagcctgtccagagtgagctggtacagagatgccaacaactgcagtctcgcttatccactctaaagattgaaaacgaagaggtaaagaagacaatggaggccaccctgcaaaccatccaggacattgtgactgtcgaggactttgatgtgtctgactgcttccagtacagcaactccatggagtccgtcaagtccacggtctctgaaaccttcatgagcaagcccagcattgctaagaggagagccaaccagcaagagacagagcagttttatttcacagtaagggagtgctatggcttttaaagagcgtcagcatgcactgcagcactcaagggagatttggaactcagagtccttgttaagtgtctgaaggacaggcgttgaatatcttagatacgaatgtgggcatactca

SEQ ID NO: 182059 - DNA, 498 bp, Homo sapiens
  Payload ID: 15853
  Gene Symbol: SRGAP2
  Gene Name: SLIT-ROBO Rho GTPase activating protein 2
  ENST ID: ENST00000572793
  CDS Start-End: 145-498
tggaggttgctgtgagccgagatcgtgcccttgcactccagcctgggcaacaagagtgaaactccatctcaaaaaaaaaaaaaaaaaagaaaagaaagaaagaaatctcacctttctgagatccgtgctcagctcacagagcagatgaaatgcctggaccagcagtgtgagcttcgggtgcaactgttgcaggacctccaggacttcttccgaaagaaggcagagattgagatggactactcccgcaacctggagaagctggcagaacgcttcctggccaagacacgcagcaccaaggaccagcaattcaagaaggatcagaatgttctctctccagtcaactgctggaatctcctcttaaaccagagtaaagaagtcggccagcagctccaagatgatttgatgaaggtcctgaacgagctctactcggtgatgaagacatatcacatgtacaatgccgacagcatcagtgctcagagcaaactaaaggaggcggag

SEQ ID NO: 182060 - DNA, 6301 bp, Homo sapiens
  Payload ID: 15853
  Gene Symbol: SRGAP2
  Gene Name: SLIT-ROBO Rho GTPase activating protein 2
  ENST ID: ENST00000573034
  CDS Start-End: 63-3278
ggttggattttttccgtggatctatcaattcacaattcgaatttggaagaaagaaggaaaacatgacgtctccagccaaattcaaaaaggataaggagatcatagcagagtacgatactcaggtcaaagagatccgtgctcagctcacagagcagatgaaatgcctggaccagcagtgtgagcttcgggtgcaactgttgcaggacctccaggacttcttccgaaagaaggcagagattgagatggactactcccgcaacctggagaagctggcagaacgcttcctggccaagacacgcagcaccaaggaccagcaattcaagaaggatcagaatgttctctctccagtcaactgctggaatctcctcttaaaccaggtgaagcgggaaagcagggaccataccaccctgagtgacatctacctgaataatatcattcctcgatttgtacaagtcagcgaggactcaggaagactctttaaaaagagtaaagaagtcggccagcagctccaagatgatttgatgaaggtcctgaacgagctctactcggtgatgaagacatatcacatgtacaatgccgacagcatcagtgctcagagcaaactaaaggaggcggagaagcaggaggagaagcaaattggtaaatcggtaaagcaggaggaccggcagaccccacgctcccctgactccacggccaacgttcgcattgaggagaaacatgtccggaggagctcagtgaagaagattgagaagatgaaggagaagcgtcaagccaagtacacggagaataagctgaaggccatcaaagcccggaatgagtacttgctggctttggaggcaaccaatgcatctgtcttcaagtactacatccatgacctatctgaccttattgatcagtgttgtgacttaggctaccatgcaagtctgaaccgggctctacgcaccttcctctctgctgagttaaacctggaacagtcgaagcatgagggtctggatgccatcgagaatgcagtagaaaacctggatgccaccagtgacaagcagcgcctcatggagatgtacaacaacgtcttctgcccccctatgaagtttgagtttcagccccacatgggggatatggcttcccagctctgtgcccagcagcctgtccagagtgagctggtacagagatgccaacaactgcagtctcgcttatccactctaaagattgaaaacgaagaggtaaagaagacaatggaggccaccctgcaaaccatccaggacattgtgactgtcgaggactttgatgtgtctgactgcttccagtacagcaactccatggagtccgtcaagtccacggtctctgaaaccttcatgagcaagcccagcattgctaagaggagagccaaccagcaagagacagagcagttttatttcacaaaaatgaaagagtacctggagggcaggaacctcatcaccaagttacaagccaagcatgaccttctgcagaaaaccctgggagaaagtcagcggacagattgcagtctagccaggcgcagctcaactgtgaggaaacaggactccagccaggcaattcctctggtggtggaaagctgtatccggtttatcagcagacacggactacagcatgaaggaattttccgggtgtcaggatcccaggtggaagtgaatgacatcaaaaatgcctttgagagaggagaggaccccctggctggggaccagaacgaccatgacatggattccatagctggtgtcctgaagctttacttccgggggctggaacaccctctcttccccaaggacatctttcatgacctgatggcctgcgtcacaatggacaacctgcaggagagagctctgcacatccggaaagtcctcctagtcctgcccaaaaccactctgattatcatgagatacctctttgccttcctcaatcatttatcacagttcagtgaagagaacatgatggacccctacaacctcgccatctgcttcgggccctcgctaatgtcagtgccagagggccacgaccaggtgtcctgccaagcccacgtgaatgagctgatcaaaaccatcatcatccagcatgagaacatcttcccaagccccagggagctggagggccctgtctacagcagaggaggaagcatggaggattactgtgatagccctcatggagagactacctcggttgaagactcaacccaggatgtgaccgcagagcaccacacgagcgatgacgaatgtgagcccatcgaggccattgccaagtttgactacgtgggccggacagcccgagagctatcctttaagaagggagcatccctgctgctttaccagcgggcttccgacgactggtgggaaggccggcacaatggcatcgacggactcatcccccatcagtacatcgtggtccaagacaccgaggacggtgtcgtggagaggtccagccccaagtctgagattgaggtcatttctgagccacctgaagaaaaggtgacagccagagcgggggccagctgtcccagtgggggtcatgtagccgatatttatcttgcaaacatcaacaagcaaaggaagcgtccagaatctgggagcatccggaaaacttttcggagtgacagccatgggctgagcagttccctgactgactcctcctccccaggggtgggggctagctgccgcccatcctcccagcccatcatgagccagagcctccccaaagaagggccagataagtgttccatcagtgggcacgggagcctcaactccatcagccgccactcatccctgaagaatcggctggatagtccacagatccggaagactgccacagcgggaaggtcaaaaagcttcaataaccatcggcccatggaccctgaggtcattgctcaggatattgaggcaacaatgaactcggccctgaatgagctacgggaactagaacggcagagcagtgtcaaacacacccctgacgtggttctggacaccttggagcccctcaaaacctccccagtggtggcccccacgtcagagccctccagccctctgcacacccagctcctcaaggaccccgagcccgccttccagcgcagcgccagtactgctggggacatcgcctgcgccttccggcctgtcaagtctgtcaagatggctgccccggtcaaaccaccagccacacggcccaagcccactgtcttccccaaaacaaatgccactagccctggtgtcaactcatcaacttccccacagtctactgacaagtcttgtactgtctgagggataataatttaattgttctagacaaggggactatagggactgactgttattaaaatcttcctatttaactagcttggggacttcagttgaaaattaggttctaagttgttcttgcaggaattagcctccccgtctcccaaaaccttgagaatgaagcccttggtatcgcctctcccttcccactgccctctgcttcccccagtcgtcgtaattcagccagctgcagtccgtaccgttcttaggttagccagagacaggttttcattatcaggtcactgtgaaatctggtaaggcagtcctgaggacatgggctcaagtctcagtcccctcagaccacggtgatgccttgaccagatggttggctactgccatccagctttcagtggcatcttgttttgggaactgattatagagaatcatatatagtccagtcttcattttacatacacacacatattttacacacacacacattttacacacacacacacacacacacacacacatatgtttttctagtctctggcatgtgtagcctctcctggtcatagaccagtctctttgtaagttattgtggcagttcacacagtagccaccaggggtctctgtttccatcacaaactttgttctgtctgggccagagaacctagcctttgaaatctctccatcatatgaaacataacgggatgggacaatcccgtaacctgtttggggttgggggctttctctctgtgttctttccattgatgtgaattggtcattggtgtttgctcttgcctctcctccatcccctagaagtacacccccgtcttattaaggagcttttaaagtttttctgaatgtatagacatttctcgggttcctacctttgtctctgatggaccattttccatttaagacattttcctgtataagacagttttatagctggttccttttagggtaaagagtcttaagagagttttattgtgtctatggcaggtttgggaaaggtaagaaatgggtcctttttcctcctaatgtttttggcacttaaaacataaaattcattatcctattaaaaaattaaattcagctttgctaatccagaaattgttcccaaatgaaaacttgttttaagtccaccccttagtttccttattttacaaggtctctcttcagggaccaacaggggcttagagagccttagttagattaaagggagaccctacctcttaaaaccagttttcatttatgcaaacaaggacaattaagggaaccctgaccccacaggctctcaagtcttcccaaggccagaatcgaaagaaaattaaaatttgaatgctgaatattctggctctactctggccttttttctggttcccttccaaaatgcacaaatcatacccttgtctgctccaattcagtctccaaacctggtgcctgtgctcctggcccccctagcatcatgctatcccaggagtatcaggaccagacacatccacagccaggctcatgggtctcagacagcaacttgagttaaagctgaaactcatccttcttctctgtgttttctggtttaaaagctgcacttatattttagccttattattttctgtagttccggagagatggtgggttgccattctggtaggaaaatctgagttttcttatctttgacctagaagagattctttttggaccaacctgcgaaattggtagttaggtctatggaaagtggtaggatttttttttttttaatcctgtgcaaaggaaaagaggtgctttgtgggaaatcactaatgagaaggctaacctgcagcaccagagaaacctttccaagtgctaggcaggagaactgaagaactctttcagtgaagtgagtcagcctagaagaggcaacccacagtcttgatttttgttgctgtttcctgacctgttcttgcctgtcacctgggcctacacaggtcccaagccaacggggctttcatacccaaggatctgtttccttgctgaaaatgaaaccctatctttcactttacattcctttcaatccaactgatcaaaactggtacccacacttgccctttctccctctctccagcacactcccctctaagaaagtaaaagcaaagctttcttaatggcaacactttgggcctgttctgttgctcctgccttatttctctttcaaccctgtacatgactcgtgttcaccatccccttgatcagtgtccatccgcgctaatttgcatcatgaactgaacagtgtgtgagtggtcacctactaaacccagctctgggggcagagctgtcttccccatctctggtgctcctaacacctgtgagatggtcctgtcgagaggactaggaaccgataggaggagagtccttctcggcagagctcactgcaaacaactggaattgaggttgcacactgtgatttttacaccgaaaagccaaaaggagctggccatccagggcctagggagaccagccttcctcagctatgcttgccgaaaccagcatgatgcttcaaagagccctgctccacccctcatggcatggatccttttcctggtgtggactctgaagggtcagtcttcggggaagagaggtggggtggggctactagcatcccaatttagaaaatagaggagtttgtagccagcagcctgtaaactggaaacactggtctcagccaacctcctcagggcgccctggcttctccccaaggagatgaggagcggtgatgccagcaccgggatgcgcagagcactggaagggctggtgcagatctacttcccatgcagaagagaagtcacatcttccagggaatcgcaatgttgtggcgtctgacttgtatgtcacatttgtgtaaaatggtatattctttaaaatagtgttgataactggaatattgtatgtatgcttggagatgctttgtgtgaacctaagactgtcactcaacagatgttggattggggaaaatccaaagcacaacttcaaaataaaatacatttttaggtttcgatgctgca

SEQ ID NO: 182061 - DNA, 3212 bp, Homo sapiens
  Payload ID: 15853
  Gene Symbol: SRGAP2
  Gene Name: SLIT-ROBO Rho GTPase activating protein 2
  ENST ID: ENST00000605610
  CDS Start-End: 299-2668
agaccccaggccagcctccgggcgctgcagttctcccggctaatgctgaggctgcggctccggctctagcacaggcaccagccgccgccgcacccggccccagcgcccaccgtctgcatgtgcccgccgtagccgtctgcccagcccgcagcccgcgctccacggagcgctggagaccaccgtggggggccccttctgccctcgagagaagcggtcttggaggtattgatttaggtggttggattttttccgtggatctatcaattcacaattcgaatttggaagaaagaaggaaaacatgacgtctccagccaaattcaaaaaggataaggagatcatagcagagtacgatactcaggtcaaagagatccgtgctcagctcacagagcagatgaaatgcctggaccagcagtgtgagcttcgggtgcaactgttgcaggacctccaggacttcttccgaaagaaggcagagattgagatggactactcccgcaacctggagaagctggcagaacgcttcctggccaagacacgcagcaccaaggaccagcaattcaagaaggatcagaatgttctctctccagtcaactgctggaatctcctcttaaaccaggtgaagcgggaaagcagggaccataccaccctgagtgacatctacctgaataatatcattcctcgatttgtacaagtcagcgaggactcaggaagactctttaaaaagagtaaagaagtcggccagcagctccaagatgatttgatgaaggtcctgaacgagctctactcggtgatgaagacatatcacatgtacaatgccgacagcatcagtgctcagagcaaactaaaggaggcggagaagcaggaggagaagcaaattggtaaatcggtaaagcaggaggaccggcagaccccacgctcccctgactccacggccaacgttcgcattgaggagaaacatgtccggaggagctcagtgaagaagattgagaagatgaaggagaagcgtcaagccaagtacacggagaataagctgaaggccatcaaagcccggaatgagtacttgctggctttggaggcaaccaatgcatctgtcttcaagtactacatccatgacctatctgaccttattgattgttgtgacttaggctaccatgcaagtctgaaccgggctctacgcaccttcctctctgctgagttaaacctggaacagtcgaagcatgagggtctggatgccatcgagaatgcagtagaaaacctggatgccaccagtgacaagcagcgcctcatggagatgtacaacaacgtcttctgcccccctatgaagtttgagtttcagccccacatgggggatatggcttcccagctctgtgcccagcagcctgtccagagtgagctggtacagagatgccaacaactgcagtctcgcttatccactctaaagattgaaaacgaagaggtaaagaagacaatggaggccaccctgcaaaccatccaggacattgtgactgtcgaggactttgatgtgtctgactgcttccagtacagcaactccatggagtccgtcaagtccacggtctctgaaaccttcatgagcaagcccagcattgctaagaggagagccaaccagcaagagacagagcagttttatttcacaaaaatgaaagagtacctggagggcaggaacctcatcaccaagttacaagccaagcatgaccttctgcagaaaaccctgggagaaagtcagcggacagattgcagtctagccaggcgcagctcaactgtgaggaaacaggactccagccaggcaattcctctggtggtggaaagctgtatccggtttatcagcagacacggactacagcatgaaggaattttccgggtgtcaggatcccaggtggaagtgaatgacatcaaaaatgcctttgagagaggagaggaccccctggctggggaccagaacgaccatgacatggattccatagctggtgtcctgaagctttacttccgggggctggaacaccctctcttccccaaggacatctttcatgacctgatggcctgcgtcacaatggacaacctgcaggagagagctctgcacatccggaaagtcctcctagtcctgcccaaaaccactctgattatcatgagatacctctttgccttcctcaatcatttatcacagttcagtgaagagaacatgatggacccctacaacctcgccatctgcttcgggccctcgctaatgtcagtgccagagggccacgaccaggtgtcctgccaagcccacgtgaatgagctgatcaaaaccatcatcatccagcatgagaacatcttcccaagccccagggagctggagggccctgtctacagcagaggaggaagcatggaggattactgtgatagccctcatggagagactacctcggttgaagactcaacccaggatgtgaccgcagagcaccacacgagcgatgacgaatgtgagcccatcgaggccattgccaagtttgactacgtgggccggacagcccgagagctatcctttaagaagggagcatccctgctgctttaccagcgggcttccgacgactggtgggaaggccggcacaatggcatcgacggactcatcccccatcagtacatcgtggtccaagacacgttgatatcctgagtgagtctgcaccctcccagcctcttcccggctcgttctgcagggaaatcctccctctgttgatagcatcgcaaacctggtggcaatctgtgcgtggacaggaccctcccaaatttagcattatgacttcaccacaggatcaagagaagatgaattgtgggggagaaggggctttctttgtcatcagtagccagaggggccaggagagcagtggagagacctgggaccggcttggatgctctgagcggggctagaggcgctacgacagtgtgtggcggtgtcctgccacgacgccgccgtctccagagccaccacacagttgactgtccttacccggcagtgctcaggacctcagccgataaaccacaacctggacttgccgcctccttctccaggaggccgccccagcacggcctccccaggaagcagcatggggtagaaggcagatgcctcgaatccaggtgtcccctagccacgctttcctgaggagctgaggagcccgcagaactcagcggattatttatttttatttaaacgacccttc

SEQ ID NO: 182062 - DNA, 1108 bp, Homo sapiens
  Payload ID: 15853
  Gene Symbol: SRGAP2
  Gene Name: SLIT-ROBO Rho GTPase activating protein 2
  ENST ID: ENST00000579225
  CDS Start-End: 849-1108
aatctgtgaccacgcctcggcagtgctagtcacacctccaagttttgccagctcctccccctcattccgggcctctcgggatcagctcttcctattggctatgggccccatcggtcgatagaaaacgggcggtgattggtaaaggggtgggctctacttcccggcggggtcctgcggagttggcggaggctcctccagggactggggcaccgatctgcgtagaaacgggtggcggggaagagaggggaggagagctctgagtgggaagcggagccgggggcctgggacccgtcgcgtcagagccaggcaagtgaaccggagcaaacgacttccgatccagtctgcgctgttgcggctcccgtttgggatttgatttgcagcatctttgagcctctacgacaaaaaaccgcgaagcacgcccagccctcccccggcaccccgaaaagcacccactccctcccggggacacagctgggcgcgtccacacccccgcagccccacaccatgttgtgcggaaggacttccactccccgcctgtgtcgttgatgtcagaccccaggccagcctccgggcgctgcagttctcccggctaatgctgaggctgcggctccggctctagcacaggcaccagccgccgccgcacccggccccagcgcccaccgtctgcatgtgcccgccgtagccgtctgcccagcccgcagcccgcgctccacggagcgctggagaccaccgtggggggccccttctgccctcgagagaagcggtcttggaggtattgatttaggtggttggattttttccgtggatctatcaattcacaattcgaatttggaagaaagaaggaaaacatgacgtctccagccaaattcaaaaaggataaggagatcatagcagagtacgatactcaggtcaaagagatccgtgctcagctcacagagcagatgaaatgcctggaccagcagtgtgagcttcgggtgcaactgttgcaggacctccaggacttcttccgaaagaaggcagagattgagatggactactcccgcaacctggagaagctggcagaacgcttcctggccaagacacgcagcaccaaggaccagcaattcaa

SEQ ID NO: 182063 - DNA, 2484 bp, Homo sapiens
  Payload ID: 15853
  Gene Symbol: SRGAP2
  Gene Name: SLIT-ROBO Rho GTPase activating protein 2
  ENST ID: ENST00000605476
  CDS Start-End: 1-1353
gtaaagaagacaatggaggccaccctgcaaaccatccaggacattgtgactgtcgaggactttgatgtgtctgactgcttccagtacagcaactccatggagtccgtcaagtccacggtctctgaaaccttcatgagcaagcccagcattgctaagaggagagccaaccagcaagagacagagcagttttatttcacaaaaatgaaagagtacctggagggcaggaacctcatcaccaagttacaagccaagcatgaccttctgcagaaaaccctgggagaaagtcagcggacagattgcagtctagccaggcgcagctcaactgtgaggaaacaggactccagccaggcaattcctctggtggtggaaagctgtatccggtttatcagcagacacggactacagcatgaaggaattttccgggtgtcaggatcccaggtggaagtgaatgacatcaaaaatgcctttgagagaggagaggaccccctggctggggaccagaacgaccatgacatggattccatagctggtgtcctgaagctttacttccgggggctggaacaccctctcttccccaaggacatctttcatgacctgatggcctgcgtcacaatggacaacctgcaggagagagctctgcacatccggaaagtcctcctagtcctgcccaaaaccactctgattatcatgagatacctctttgccttcctcaatcatttatcacagttcagtgaagagaacatgatggacccctacaacctcgccatctgcttcgggccctcgctaatgtcagtgccagagggccacgaccaggtgtcctgccaagcccacgtgaatgagctgatcaaaaccatcatcatccagcatgagaacatcttcccaagccccagggagctggagggccctgtctacagcagaggaggaagcatggaggattactgtgatagccctcatggagagactacctcggttgaagactcaacccaggatgtgaccgcagagcaccacacgagcgatgacgaatgtgagcccatcgaggccattgccaagtttgactacgtgggccggacagcccgagagctatcctttaagaagggagcatccctgctgctttaccagcgggcttccgacgactggtgggaaggccggcacaatggcatcgacggactcatcccccatcagtacatcgtggtccaagacaccgaggacggtgtcgtggagaggtccagccccaagtctgagattgaggtcatttctgagccacctgaagaaaaggtgacagccagagcgggggccagctgtcccagtgggggtcatgtagccgatatttatcttgcaaacatcaacaagtaagctctgcttttcattttctgctcccctgaatgacttgcaacacccagcctcaccctctggcctaacccccatctccattcctgtgctgcacgtagggctcccagctcccccagcctaacagtttgcatgtggtcattgctgctgcaaggcggacagggctgaggatgctgctacaagcctcggggcaggtccaggtctccagctagctgccctcgtgctgtggaagggtgctttactgtgtgttcccgcagtgtctgtccacccagacctttgtggcagtcttacagctaaaactttgaccaaagctttggtcactttatgcaacctggttttgtactgtttctcagaggtgccttcttttttccaatccatactcaaataatagtctttgatgtctgtcttccttgacccgtgttcgtgcaaagattcagagtctgtgtgtggcttctactaggctgatgttacaccaggtgggtttattgagatatcatgtgtctgttcctccccctgtcctgcattcactcctgtggaggaaaggaggccacgatgtccctaaggaaagctttgtcctgagctcttcattcattggctaacccctagctcccttttcttctgccctttcacaccaggagaaataattttccattttgttcctattgctttggccttttgtattattctacccccttagtccctttgcagatccccactcctgctcagcaggctcttacctctgacccccagctttcattgtggctgttagcaacatcctggggtttaaactccacccacgcccgatctggctgtctagagggattctacgcctgcgtgctgccgcctccccaagaggcattcaggttattggagaactaatctcatctcaaggggccagacaccaagtcccaaagcctacagacctctttccgccaggccctgaaacctggccccgtgccagcaggatgacaagccccagggcgctcctgatgaatatggattggagatgatgtacagtttttattcccctctggcttttgaggaatgaaatgatttgcactttgaaaacctgttaaccgtagcctctggacactgagactggaaggagaataaaggatgcttgttgtttttaaacta

SEQ ID NO: 182064 - DNA, 1013 bp, Homo sapiens
  Payload ID: 15853
  Gene Symbol: SRGAP2
  Gene Name: SLIT-ROBO Rho GTPase activating protein 2
  ENST ID: ENST00000604925
  CDS Start-End: 1-673
cctctttgccttcctcaatcatttatcacagttcagtgaagagaacatgatggacccctacaacctcgccatctgcttcgggccctcgctaatgtcagtgccagagggccacgaccaggtgtcctgccaagcccacgtgaatgagctgatcaaaaccatcatcatccagcatgagaacatcttcccaagccccagggagctggagggccctgtctacagcagaggaggaagcatggaggattactgtgatagccctcatggagagactacctcggttgaagactcaacccaggatgtgaccgcagagcaccacacgagcgatgacgaatgtgagcccatcgaggccattgccaagtttgactacgtgggccggacagcccgagagctatcctttaagaagggagcatccctgctgctttaccagcgggcttccgacgactggtgggaaggccggcacaatggcatcgacggactcatcccccatcagtacatcgtggtccaagacaccgaggacggtgtcgtggagaggtccagccccaagtctgagattgaggtcatttctgagccacctgaagaaaaggtgacagccagagcgggggccagctgtcccagtgggggtcatgtagccgatatttatcttgcaaacatcaacaactttcattgtggctgttagcaacatcctggggtttaaactccacccacgcccgatctggctgtctagagggattctacgcctgcgtgctgccgcctccccaagaggcattcaggttattggagaactaatctcatctcaaggggccagacaccaagtcccaaagcctacagacctctttccgccaggccctgaaacctggccccgtgccagcaggatgacaagccccagggcgctcctgatgaatatggattggagatgatgtacagtttttattcccctctggcttttgaggaatgaaatgatttgcactttgaaaacctgttaaccgtagcctctggacactgagactggaaggaga

SEQ ID NO: 182065 - DNA, 884 bp, Homo sapiens
  Payload ID: 15853
  Gene Symbol: SRGAP2
  Gene Name: SLIT-ROBO Rho GTPase activating protein 2
  ENST ID: ENST00000604010
  CDS Start-End: 1-884
gaatgtgagcccatcgaggccattgccaagtttgactacgtgggccggacagcccgagagctatcctttaagaagggagcatccctgctgctttaccagcgggcttccgacgactggtgggaaggccggcacaatggcatcgacggactcatcccccatcagtacatcgtggtccaagacaccgaggacggtgtcgtggagaggtccagccccaagtctgagattgaggtcatttctgagccacctgaagaaaaggtgacagccagagcgggggccagctgtcccagtgggggtcatgtagccgatatttatcttgcaaacatcaacaacaacttacatcttgacaacacaaagcccgtgaccaccaagcaaaggaagcgtccagaatctgggagcatccggaaaacttttcggagtgacagccatgggctgagcagttccctgactgactcctcctccccaggggtgggggctagctgccgcccatcctcccagcccatcatgagccagagcctccccaaagaagggccagataagtgttccatcagtgggcacgggagcctcaactccatcagccgccactcatccctgaagaatcggctggatagtccacagatccggaagactgccacagcgggaaggtcaaaaagcttcaataaccatcggcccatggaccctgaggtcattgctcaggatattgaggcaacaatgaactcggccctgaatgagctacgggaactagaacggcagagcagtgtcaaacacacccctgacgtggttctggacaccttggagcccctcaaaacctccccagtggtggcccccacgtcagagccctccagccctctgcacacccagctcctcaaggaccccgagcccgcctt

SEQ ID NO: 182066 - DNA, 4705 bp, Homo sapiens
  Payload ID: 15853
  Gene Symbol: SRGAP2
  Gene Name: SLIT-ROBO Rho GTPase activating protein 2
  ENST ID: ENST00000624873
  CDS Start-End: 63-3275
ggttggattttttccgtggatctatcaattcacaattcgaatttggaagaaagaaggaaaacatgacgtctccagccaaattcaaaaaggataaggagatcatagcagagtacgatactcaggtcaaagagatccgtgctcagctcacagagcagatgaaatgcctggaccagcagtgtgagcttcgggtgcaactgttgcaggacctccaggacttcttccgaaagaaggcagagattgagatggactactcccgcaacctggagaagctggcagaacgcttcctggccaagacacgcagcaccaaggaccagcaattcaagaaggatcagaatgttctctctccagtcaactgctggaatctcctcttaaaccaggtgaagcgggaaagcagggaccataccaccctgagtgacatctacctgaataatatcattcctcgatttgtacaagtcagcgaggactcaggaagactctttaaaaagagtaaagaagtcggccagcagctccaagatgatttgatgaaggtcctgaacgagctctactcggtgatgaagacatatcacatgtacaatgccgacagcatcagtgctcagagcaaactaaaggaggcggagaagcaggaggagaagcaaattggtaaatcggtaaagcaggaggaccggcagaccccacgctcccctgactccacggccaacgttcgcattgaggagaaacatgtccggaggagctcagtgaagaagattgagaagatgaaggagaagcgtcaagccaagtacacggagaataagctgaaggccatcaaagcccggaatgagtacttgctggctttggaggcaaccaatgcatctgtcttcaagtactacatccatgacctatctgaccttattgattgttgtgacttaggctaccatgcaagtctgaaccgggctctacgcaccttcctctctgctgagttaaacctggaacagtcgaagcatgagggtctggatgccatcgagaatgcagtagaaaacctggatgccaccagtgacaagcagcgcctcatggagatgtacaacaacgtcttctgcccccctatgaagtttgagtttcagccccacatgggggatatggcttcccagctctgtgcccagcagcctgtccagagtgagctggtacagagatgccaacaactgcagtctcgcttatccactctaaagattgaaaacgaagaggtaaagaagacaatggaggccaccctgcaaaccatccaggacattgtgactgtcgaggactttgatgtgtctgactgcttccagtacagcaactccatggagtccgtcaagtccacggtctctgaaaccttcatgagcaagcccagcattgctaagaggagagccaaccagcaagagacagagcagttttatttcacaaaaatgaaagagtacctggagggcaggaacctcatcaccaagttacaagccaagcatgaccttctgcagaaaaccctgggagaaagtcagcggacagattgcagtctagccaggcgcagctcaactgtgaggaaacaggactccagccaggcaattcctctggtggtggaaagctgtatccggtttatcagcagacacggactacagcatgaaggaattttccgggtgtcaggatcccaggtggaagtgaatgacatcaaaaatgcctttgagagaggagaggaccccctggctggggaccagaacgaccatgacatggattccatagctggtgtcctgaagctttacttccgggggctggaacaccctctcttccccaaggacatctttcatgacctgatggcctgcgtcacaatggacaacctgcaggagagagctctgcacatccggaaagtcctcctagtcctgcccaaaaccactctgattatcatgagatacctctttgccttcctcaatcatttatcacagttcagtgaagagaacatgatggacccctacaacctcgccatctgcttcgggccctcgctaatgtcagtgccagagggccacgaccaggtgtcctgccaagcccacgtgaatgagctgatcaaaaccatcatcatccagcatgagaacatcttcccaagccccagggagctggagggccctgtctacagcagaggaggaagcatggaggattactgtgatagccctcatggagagactacctcggttgaagactcaacccaggatgtgaccgcagagcaccacacgagcgatgacgaatgtgagcccatcgaggccattgccaagtttgactacgtgggccggacagcccgagagctatcctttaagaagggagcatccctgctgctttaccagcgggcttccgacgactggtgggaaggccggcacaatggcatcgacggactcatcccccatcagtacatcgtggtccaagacaccgaggacggtgtcgtggagaggtccagccccaagtctgagattgaggtcatttctgagccacctgaagaaaaggtgacagccagagcgggggccagctgtcccagtgggggtcatgtagccgatatttatcttgcaaacatcaacaagcaaaggaagcgtccagaatctgggagcatccggaaaacttttcggagtgacagccatgggctgagcagttccctgactgactcctcctccccaggggtgggggctagctgccgcccatcctcccagcccatcatgagccagagcctccccaaagaagggccagataagtgttccatcagtgggcacgggagcctcaactccatcagccgccactcatccctgaagaatcggctggatagtccacagatccggaagactgccacagcgggaaggtcaaaaagcttcaataaccatcggcccatggaccctgaggtcattgctcaggatattgaggcaacaatgaactcggccctgaatgagctacgggaactagaacggcagagcagtgtcaaacacacccctgacgtggttctggacaccttggagcccctcaaaacctccccagtggtggcccccacgtcagagccctccagccctctgcacacccagctcctcaaggaccccgagcccgccttccagcgcagcgccagtactgctggggacatcgcctgcgccttccggcctgtcaagtctgtcaagatggctgccccggtcaaaccaccagccacacggcccaagcccactgtcttccccaaaacaaatgccactagccctggtgtcaactcatcaacttccccacagtctactgacaagtcttgtactgtctgagggataataatttaattgttctagacaaggggactatagggactgactgttattaaaatcttcctatttaactagcttggggacttcagttgaaaattaggttctaagttgttcttgcaggaattagcctccccgtctcccaaaaccttgagaatgaagcccttggtatcgcctctcccttcccactgccctctgcttcccccagtcgtcgtaattcagccagctgcagtccgtaccgttcttaggttagccagagacaggttttcattatcaggtcactgtgaaatctggtaaggcagtcctgaggacatgggctcaagtctcagtcccctcagaccacggtgatgccttgaccagatggttggctactgccatccagctttcagtggcatcttgttttgggaactgattatagagaatcatatatagtccagtcttcattttacatacacacacatattttacacacacacacattttacacacacacacacacacacacacacacatatgtttttctagtctctggcatgtgtagcctctcctggtcatagaccagtctctttgtaagttattgtggcagttcacacagtagccaccaggggtctctgtttccatcacaaactttgttctgtctgggccagagaacctagcctttgaaatctctccatcatatgaaacataacgggatgggacaatcccgtaacctgtttggggttgggggctttctctctgtgttctttccattgatgtgaattggtcattggtgtttgctcttgcctctcctccatcccctagaagtacacccccgtcttattaaggagcttttaaagtttttctgaatgtatagacatttctcgggttcctacctttgtctctgatggaccattttccatttaagacattttcctgtataagacagttttatagctggttccttttagggtaaagagtcttaagagagttttattgtgtctatggcaggtttgggaaaggtaagaaatgggtcctttttcctcctaatgtttttggcacttaaaacataaaattcattatcctattaaaaaattaaattcagctttgctaatccagaaattgttcccaaatgaaaacttgttttaagtccaccccttagtttccttattttacaaggtctctcttcagggaccaacaggggcttagagagccttagttagattaaagggagaccctacctcttaaaaccagttttcatttatgcaaacaaggacaattaagggaaccctgaccccacaggctctcaagtcttcccaaggccagaatcgaaagaaaattaaaatttgaatgctgaatattctggctctactctggccttttttctggttcccttccaaaatgcacaaatcatacccttgtctgctccaattcagtctccaaacctggtgcctgtg

SEQ ID NO: 182067 - DNA, 7120 bp, Homo sapiens
  Payload ID: 15854
  Gene Symbol: SRGAP2B
  Gene Name: SLIT-ROBO Rho GTPase activating protein 2B
  Uniprot ID: P0DMP2
  ENST ID: ENST00000612199
  CDS Start-End: 849-2225
aatctgtgaccacgcctcggcagtgctagtcacacctccaagttttgccagctcctccccctcattccgggcctctcgggatcagctcttcctattggctatgggccccatcggtcgatagaaaacgggcggtgattggtaaaggggtgggctctacttcccggcggggtcctgcggagttggcggaggctcctccagggactggggcacagatctgcgtagaaacgggtggcggggaagagaggggaggagagctctgagtgggaagcggagccgggggcctgggacccgtcgcgtcagagccaggcaagtgaaccggagcaaacgacttccgatccagtctgcgctgttgcggctcccgtttgggatttgatttgcagcatctttgagcctctacgacaaaaaaccgcgaagcacgcccagccctcccccggcaccccgaaaagcacccactccctcccggggacacagctgggcgcgtccacacccccgcagccccacaccatgttgtgcggaaggacttccactccccgcctgtgtcgttgatgtcagaccccaggccagcctccgggcgctgcagttctcccggctaatgctgaggctgcggctccggctctagcacaggcaccagccgccgccgcacccggcctcagcgcccaccgtctgcatgtgcccgccgtagccgtctgcccagcccgcagcccgcgctccacggagcgctggagaccaccgtggggggccccttctgccctcgagagaagcggtcttggaggtattgatttaggtggttggattttttccgtggatctatcaattcacaattcgaatttggaagaaagaaggaaaacatgacgtctccagccaaattcaaaaaggataaggagatcatagcagagtacgatactcaggtcaaagagatccgtgctcagctcacagagcagatgaaatgcctggaccagcagtgtgagcttcgggtgcaactgttgcaggacctccaggacttcttccgaaagaaggcagagattgagatggactactcccgcaacctggagaagctggcagaacgcttcctggccaagacatgcagcaccaaggaccagcaattcaagaaggatcagaatgttctctctccagtcaactgctggaatctcctcttaaaccaggtgaagcgggaaagcagggaccataccaccctgagtgacatctacctgaataatatcattcctcgatttgtacaagtcagcgaggactcaggaagactctttaaaaagagtaaagaagtcggccagcagctccaagatgatttgatgaaggtcctgaacgagctctactcggtcatgaagacatatcacatgtacaatgccgacagcatcagtgctcagagcaaactaaaggaggcggagaagcaggaggagaagcaaattggtaaatcggtaaagcaggaggaccggcagaccccacgctcccctgactccacggccaacgttcgcattgaggagaaacatgtccggaggagctcagtgaagaagattgagaagatgaaggagaagcgccaagccaagtacacggagaataagctgaaggccatcaaagcccggaatgagtacttgctggctttggaggcaaccaatgcatctgtcttcaagtactacatccatgacctatctgaccttattgattgttgtgacttaggctaccatgcaagtctgaaccgggctctacgcaccttcctctctgctgagttaaacctggaacagtcgaagcatgagggtctggatgccatcgagaatgcagtagaaaacctggatgccaccagtgacaagcagcgcctcatggagatgtacaacaacgtcttctgcccccctatgaagtttgagtttcagccccacatgggggatatggcttcccagctctgtgcccagcagcctgtccagagtgagctgctacagagatgccaacaactgcagtctcgcttatccactctaaagattgaaaacgaagaggtaaagaagacaatggaggccaccctgcaaaccatccaggacattgtgactgtcgaggacttcgatgtgtctgactgcttccagtacagcaactccatggagtccgtcaagtccacggtctctgaaaccttcatgagcaagcccagcattgctaagaggagagccaaccagcaagagacagagcagttttatttcacagtgagggagtgctatggcttttaaagagcgtcagcatgcactgcagcactcaagggagatttggaactcagagtccttgttaagtgtctgaaggacaggcgttgaatatcttagatacgaatgtgggcatactcagagaccatccctacagttaaaggtgcaaacattaaaagttgtatatgtctaacagggatccgcccaagagaaaggatgctcccaagtatacaactaagaagattttcttttttaagaaatttttaactagctagtaggctttcactggaaagtttccttctcaggcacaggggatcctgaaaggggaacttcatcttttagttcttggagagtacatacaaatattcataataacacatattttgtttataaaaatctataatctcttctaggtgatatgatgacattattttataacttttattgttgggaaactattttttctaattattgctaaaacttaaaggatgggtaatatgcagcattactattttgcacataattccaaaacatcgtattttcttattcatgtatctctagtcttcttttagacagttggacccttttttctctttttttttttttttttttttttttaagtattgttaacaatcctttggaagtcactactggtctttgtgtgctgctttttaataattgagttattttgagcttgccaagtaggatctattgcctggactaaaatttatttcctaatcttctgatgaccaagaaaggaaaaattaagtttgcagatgtgagatgaaatatagccagtgaatatgcatactgattctgaatgaaaggaattaacttttcagtcaagaaacagtctgcatgcagtaaattgaatttttcctgcaactggaatgatttgtttaattcttctttgaacactgccctttctccagtaagaacactaatgatttgctaatattttttaaagaaatctgtttttttaattagttaagctcagacttcctcttattttttatcctagagaaaactgctaaaagggaatgatatatcagtactattcttctaaaacaactttttaaaaatgattatacaaagccaaatatgctcattatataaaatttagaagcaaaaagaaggaaataaaaattttccataattctaccagctagagataatggtgttagaatatattcctttctaatctgttttctatgcatgcacaaacacatatgtgagcacatatttataattttattctaaaaaataggatactgctgtacatattgttttacaatctaagtcatataattataatattctttaagcatatttatgagtaaaatattaaaacctatacaaaaaaataatagaatggcattttagctcattcattgatttttataaaatatttaacacactccctggtttgtagttagcgttcaataaatgctaaaaatttatcttcaccatcatcattaatttatttattaatcattattaaattattcattgatcattttttgaggatttactattgccagacactgtgctacaagctgggaatgctgacagtataagataaagagggaaatgatgggggatgggtcatgtaaagggagaactttcatttttacttcatatatatctaagcagttataataggttgatttttgtaatttaaaaaatgtaaaaatgcatacatgcactagtgcatgaatggcagccaggatgagtggaattggagaagcatcacacacacagtgacttttgtgtttgatcttgaagaatgagcgaaccaggcagggagtcggggaggagaatcgcattccttgaggaaagagcagcatgtgggaaaacataaatgcacgcaataacctggctcacatgttaagagaactttctgactataatgagggatgtgttgctgccccaagcttcattatctaaggagtttgttgaacactctctagaggcttttaataataggattgtttagctggtctgtctggactggttagatataacactatttaaatgacccaatctcattacattgtgaagatttccattttttaggttacgtaagaaattttggacctaaaaatcttgcattttaagacagtctttgtcagaattactttttggctctaaatgaattctgtaacatttgtattctaaattgacctttagtaaaagcaggaatggccatattcaaactggtaacctcgcaaatcctgcccaccctttcactttctgtctcaatacattgatgtcctctaacccatttcctgtcttatgtggctttagtgccacttatcaaaattgtgtgcaaatttccttggctaacagtaacagtttttgtctgggcttgtctagcagtggaattctgcctgagttcatcatttttgtgactggtacttgaagtgcatcagatgattaatttcatgataagagggctttttggggtggtgaaatagacatttatggaaaatgggatacccacattaagcagggtgactacctgtttaccatacaacccacacaaagccaatacaactatagatgtgctttatttagtctgttgcctctgcaaacattgcccgtgtgtttctctatgcccttcaaaaacatcagagcagcacatcctggaagatcctatcttttgtaagtttaagaagcagcctcttgtcacaggttgactcctaggtagtgtgcctagtgaccaagagggctgctaagaaagctttctgaccacttgtggctgtcattggactgatttgcccagatgacatcaattgggaatttgaggcatgacctataaagatcagttgcttgcaagagtctcaggaaaataattgtggagttaagaaacttgaagcgatttttaaaaattacctaacccaaccttctcatttgaaaaattaaaaaataaataggccagatatggcagctcatgcctgtaatcccagcgctgtgggagcctgaggcgggtgggtctcttgaggccaggagttcaagaccagcctggacaacatggtgaaaccctgtctctactaaaaacacaaaaattagctgagtgtggtggcaggcgcctgtaatcccagctactcaggaggctaaggtgggaggattacttgaaccggggaggcataggttgtagtgagccaagatcgtgtcactgcactccagcctgggtgacagagtaagactctgcctaaaaaaaaaaaagaaagattaaaaaataaataaatctgctgggcgtggtggctcacgcctgtaatcccagcactttgggaggccgaggcgggcggatcacctgaggtcgggagtttgagaccagcctgatcaacatggagaaacctcgtctctactaaaaacacgaaaaaattagctgggcgtggtggcgcatgcctcattcacgtacatgggagagtctacaaagtcacacgtattcataggttaagccacatgctgacaaatgtcataagaagaccctacacttttaccttggccgatccctcccctcagtgcaagctctgtgcaagagtgaacttgaacttcactcagtgcaagagtgaacacacactttgtgccggctttaaagaacccagcacaaagccagtctgcatggcctacagacatattttgctggacaatgattacttgcttttctttttgtttttcttgtatttgcctgtttgattggctcctgacataccagaaaatcactgtcaaaacattagcttaacatttgttaaggaaacaaaaagacttcggtgaccacaccttataaaccaaacagttttgtaaatcactttggaaaatttcactaaaaaaaaaaatccttaacaatataataagtaaagaaaatttaaaaccacaaaacatcactgtgtttgtagggggaggtctgatttacagagtaaccacatagtaattataattattagaatgtccagttttcaaaaaacgttacaaggcatacaaagaatgggaaagtgtggctcattcaaaggaacaaaataaagtgacagaaaatatccctaaagaaacccagacatcaaacttaccagacaaagactttaaaacaactgtcttcattatactcaaatgtcaaaaggaaaacataaacaaagaaataaaggaatcagaaaaaatattaaaaagtaggaatatcagcaaagagataacaaattctggagtggaaaactacaatgataaaaatttaaaaatcaccagagggatttaagagtatatttgcacacacagaggaagccatgaacttgaagagaagaaaatggaaaatactctgagaaacagaaagaataaaaaataaacaatgagcacagactaatgaatctgtgggacatcatcaaatagaccaacattcatattctagaaggataaattatgttgttaaaaagtttaccattctttcttttcacctttcttccttcttccttccccctcctcctcctttttacttttcttcctcttcctttctcttcttctttctctccttcattatccctttcgctgtctctctttctccctttctcttttttcttttctttcaattttctcaattactaagagatgtttaagtacccttagcatgttagtagatacggttatttctccctttagttctcttttgagatttatagtcactcaaataaagagataacccaaacataagcgtcacaaacaggctttcataccattcttaatttggtcctgtaattcttcattgctgtattaattttctgatgcttttaaggatgttttataacaagttgtgtagctttttccaatggaatgtttattctgaattatctaattcatattgtaagtatagagggagtttaacataaaattattaaactaatatttgtgaaagaatgtatttgtgcatttaacaaata

SEQ ID NO: 182068 - DNA, 1477 bp, Homo sapiens
  Payload ID: 15854
  Gene Symbol: SRGAP2B
  Gene Name: SLIT-ROBO Rho GTPase activating protein 2B
  ENST ID: ENST00000619678
  CDS Start-End: 449-1366
catgttgtgcggaaggacttccactccccgcctgtgtcgttgatgtcagaccccaggccagcctccgggcgctgcagttctcccggctaatgctgaggctgcggctccggctctagcacaggcaccagccgccgccgcacccggcctcagcgcccaccgtctgcatgtgcccgccgtagccgtctgcccagcccgcagcccgcgctccacggagcgctggagaccaccgtggggggccccttctgccctcgagagaagcggtcttggaggtattgatttaggtggttggattttttccgtggatctatcaattcacaattcgaatttggaagaaagaaggaaaacatgacgtctccagccaaattcaaaaaggataaggagatcatagcagagtacgatactcaggtcaaagagtaaagaagtcggccagcagctccaagatgatttgatgaaggtcctgaacgagctctactcggtcatgaagacatatcacatgtacaatgccgacagcatcagtgctcagagcaaactaaaggaggcggagaagcaggaggagaagcaaattggtaaatcggtaaagcaggaggaccggcagaccccacgctcccctgactccacggccaacgttcgcattgaggagaaacatgtccggaggagctcagtgaagaagattgagaagatgaaggagaagcgccaagccaagtacacggagaataagctgaaggccatcaaagcccggaatgagtacttgctggctttggaggcaaccaatgcatctgtcttcaagtactacatccatgacctatctgaccttattgattgttgtgacttaggctaccatgcaagtctgaaccgggctctacgcaccttcctctctgctgagttaaacctggaacagtcgaagcatgagggtctggatgccatcgagaatgcagtagaaaacctggatgccaccagtgacaagcagcgcctcatggagatgtacaacaacgtcttctgcccccctatgaagtttgagtttcagccccacatgggggatatggcttcccagctctgtgcccagcagcctgtccagagtgagctgctacagagatgccaacaactgcagtctcgcttatccactctaaagattgaaaacgaagaggtaaagaagacaatggaggccaccctgcaaaccatccaggacattgtgactgtcgaggacttcgatgtgtctgactgcttccagtacagcaactccatggagtccgtcaagtccacggtctctgaaaccttcatgagcaagcccagcattgctaagaggagagccaaccagcaagagacagagcagttttatttcacagtgagggagtgctatggcttttaaagagcgtcagcatgcactgcagcactcaagggagatttggaactcagagtccttgttaagtgtctgaaggacaggcgttgaatatcttagatacgaatgtgggcatactca

SEQ ID NO: 182069 - DNA, 486 bp, Homo sapiens
  Payload ID: 15854
  Gene Symbol: SRGAP2B
  Gene Name: SLIT-ROBO Rho GTPase activating protein 2B
  ENST ID: ENST00000621582
  CDS Start-End: 1-131
ttaaaaagagtaaagaagtcggccagcagctccaagatgatttgatgaaggtcctgaacgagctctactcgcatcagtgctcagagcaaactaaaggaggcggagaagcaggaggagaagcaaattggtaaatcggtaaagcaggaggaccggcagaccccacgctcccctgactccacggccaacgttcgcattgaggagaaacatgtccggaggagctcagtgaagaagattgagaagatgaaggagaagcgccaagccaagtacacggagaataagctgaaggccatcaaagcccggaatgagtacttgctggctttggaggcaaccaatgcatctgtcttcaagtactacatccatgacctatctgaccttattgatcagtgttgtgacttaggctaccatgcaagtctgaaccgggctctacgcaccttcctctctgctgagttaaacctggaacagtcgaagcatgagggtctggatgcc

SEQ ID NO: 182070 - DNA, 7204 bp, Homo sapiens
  Payload ID: 15855
  Gene Symbol: SRGAP2C
  Gene Name: SLIT-ROBO Rho GTPase activating protein 2C
  Uniprot ID: P0DJJ0
  ENST ID: ENST00000367123
  CDS Start-End: 858-2237
aatctgtgaccacgcctcggcagtgctagtcacacctccaagttttgccagctcctccccctcattccgggcctctcggtatcagctcttcctattggctatgggccccatcggtcgatagaaaacgggcggtgattggtaaaggggtgggctctacttcccggcggggtcctgcggagttggcggaggcggcggaggctcctccagggactggggcaccgatctgcgtagaaacgggtggcggggaagagaggggaggagagctctgagtgggaagcggaaccgggggcctgggacccgtcgcgtcagagccaggcaagtgaaccggagcaaacgacttccgatccagtctgcgctgttgcggctcccgtttgggatttgatttgcagcatctttgagcctctacgacaaaaaaccgcgaagcacgcccagccctcccccggcaccccgaaaagcacccactccctcccggggacacagctgggcgcgtccacacccccgcagccccacaccatgttgtgcggaaggacttccactccccgcctgtgtcgttgatgtcagaccccaggccagcctccgggcgctgcagttctcccggctaatgctgaggctgcggctccggctctagcacaggcaccagccgccgccgcacccggcctcagcgcccaccgtctgcatgtgcccgccgtagccgtctgcccagcccgcagcccgcgctccacggagcgctggagaccaccgtggggggccccttctgccctcgagagaagcggtcttggaggtattgatttaggtggttggattttttccgtggatctatcaattcacaattcgaatttggaagaaagaaggaaaacatgacgtctccagccaaattcaaaaaggataaggagatcatagcagagtacgatactcaggtcaaagagatccgtgctcagctcacagagcagatgaaatgcctggaccagcagtgtgagcttcgggtgcaactgttgcaggacctccaggacttcttccgaaagaaggcagagattgagatggactactcccgcaacctggagaagctggcagaacacttcctggccaagacacgcagcaccaaggaccagcaattcaagaaggatcagaatgttctctctccagtcaactgctggaatctcctcttaaaccaggtgaagtgggaaagcagggaccataccaccctgagtgacatctacctgaataatatcattcctcgatttgtacaagtcagcgaggactcaggaagactctttaaaaagagtaaagaagtcggccagcagctccaagatgatttgatgaaggtcctgaacgagctctactcggtcatgaagacatatcacatgtacaatgccgacagcatcagtgctcagagcaaactaaaggaggcggagaagcaggaggagaagcaaattggtaaatcggtaaagcaggaggaccggcagaccccatgctcccctgactccacggccaacgttcgcattgaggagaaacatgtccggaggagctcagtgaagaagattgagaagatgaaggagaagcaccaagccaagtacacggagaataagctgaaggccatcaaagcccagaatgagtacttgctggctttggaggcaaccaatgcatctgtcttcaagtactacatccatgacctatctgaccttattgatcagtgttgtgacttaggctaccatgcaagtctgaaccgggctctacgcaccttcctctctgctgagttaaacctggaacagtcgaagcatgagggtctggatgccatcgagaatgcagtagaaaacctggatgccaccagtgacaagcagcgcctcatggagatgtacaacaacgtcttctgcccccctatgaagtttgagtttcagccccacatgggggatatggcttcccagctctgtgcccagcagcctgtccagagtgagctggtacagagatgccaacaactgcagtctcgcttatccactctaaagattgaaaacgaagaggtaaagaagacaatggaggccaccctgcaaaccatccaggacattgtgactgtcgaggactttgatgtgtctgactgcttccagtacagcaactccatggagtccgtcaagtccacggtctctgaaaccttcatgagcaagcccagcattgctaagaggagagccaaccagcaagagacagagcagttttatttcacagtaagggagtgctatggcttttaaagagcgtcagcatgcactgcagcactcaagggagatttggaactcagagtccttgttaagtgtctgaaggacaggcattgaatatcttagatacgaatgtgggcatactcagagaccatccctacacttaaaggtgcaaacattaaaagttgtatatgtctaacagggatccgcccaagagaaaggatgctcccaagtatacaactaagaagattttcttttttaagaaatttttaactagctagtaggctttcactggaaagtttccttctcaggcacaggggatcctgaaaggggaacttcatcttttagttcttggagagtacatacaaatattcataataacacatattttgtttataaaaatctataatctcttctaggtgatatgatgacattattttataacttttattgttgggaaactattttttctaattattgctaaaacttaaaggatgggtaatatgcagcattactattttgcacataattccaaaacatcgtattttcttattcatgtatctctagtcttcttttagacagttggacccttttttctttttctttttttttttttttttttaagtattgttaacaatcctttggaagtcactactggtctttgtgtgctgctttttaataattgagttattttgagcttgccaagtaggatctattgcctggactaaaatttatttcctaatcttctgatgaccaagaaaggaaaaattaagtttgcagatgtgagatgaaatatagccagtgaatatgcatactgattctgaatgaaaggaattaacttttcagtcaagaaacagtctgcatgcagtaaattgaatttttcctgcaactggaatgatttgtttaattcttctttgaacactgccctttctccagtaagaacactaatgatttgctaatattttttaaagaaatctgtttttttaattagttaagctcagacttcctcttattttttatcctagagaaaactgctaaaagggaatgatatatcagtactattcttctaaaacaactttttaaaaatgattatacaaagccaaatatgctcattatataaaatttagaagcaaaaagaaggaaataaaaattttccataattctaccagctagagataatggtgttagaatatattcctttctaatctgttttctatgcatgcacaaacacatatgtgagcacatatttataattttattctaaaaaataggacactgctgtacatattgttttacaatctaagtcatataattataatattctttaagcatatttatgagtaaaatattaaaacctatacaaaaaaataacagaatggcattttagctcattcattgatttttataaaatatttaacacactccctggtttgtagttagcgttcaataaatgctaaaaatttatcttcaccatcatcattaatttatttattaatcattattaaattattcattgatcattttttgaggatttactattgccagacactgtgctacaagctgggaatgctgacagtataagataaagagggaaatgatgggggatgggtcatgtaaagggagaactttcatttttacttcatatatatctaagcagttataataggttgatttttgtaatttaaaaaatgtaaaaatgcatacatgcactagtgcatgaatggcagccaggatgagtggaattggagaagcatcacacacacagtgacttttgtgtttgatcttgaagaatgagcgaaccaggcagggagtcggggaggagaatcgcattccttgaggaaagagcagcatgtgggaaaacataaatgcacgcaataacctggctcacatgttaagagaactttctgactataatgagggatgtgttgctgccccaagcttcattatctaaggagtttgttgaacactctctagaggcttttaataataggattgtttagctggtctgtctggactggttagatataacactatttaaatgacccaatctcattacattgtgaagatttccattttttaggttacgtaagaaattttggacctaaaaatcttgcattttaagacagtctttgtcagaattactttttggctctaaatgaattctgtaacatttgtattctaaattgacctttagtaaaagcaggaatggccatattcaaactggtaacctcgcaaatcctgcccaccctttcactttctgtctcaatacattgatgtcctctaacccatttcctgtcttatgtggctttagtgccacttatcaaaattgtgtgcaaatttccttggctaacagtaacagtttttgtctgggcttgtctagcagtggaattctgcctgagttcatcatttttgtgactggtacttgaagtgcatcagatgattaatttcatgataagagggctttttggggtggtgaaatagacatttatggaaaatgggatacccacattaagcagggtgactacctgtttaccatacaacccacacaaagccaatacaactatagatgtgctttctttagtctgttgcctctgcaaacattgcccgtgtgtttctctatgcccttcaaaaacatcagagcagcacatcctggaagatcctatcttttgtaagtttaagaagcagcctcttgtcacagcttgactcctaggtagtgtgcctagtgaccaagagggctgctaagaaagctttctgaccacttgtggctgtcattggactgatttgcccagatgacatcaattgggaatttgaggcatgacctataaagatcagttgcttgcaagagtctcaggaaaataattgtggagttaagaaacttgaagcgatttttaaaaattacctaacccaaccttctcatttgaaaaattaaaaaataaataggccagatatggcggctcatgcctgtaatcccagcgctgtgggagcctgaggcgggtgggtctcttgaggccaggagttcaagaccagcctggacaatgtggtgaaaccctgtctctactaaaaacacaaaaattagctgggtgtggtggcaggcgcctgtaatcccagctactcaggaggctaaggtgggaggattacttgaactggggaggcataggttgtagtgagccaaggtcgtgtcactgcactccagcctgggtgacagagtaagactctgcctaaaaaaaaaaaaagaaagattaaaaaataaataaatctgctgggcgtggtggctcacgcctgtaatcccagcactttgggaggccgaggcgggtggatcacctgaggtcgggagtttgagaccagcctgatcaacatggagaaacctcgtctctactaaaaacacaaaaaaattagctgggcgtggtggcgcatgcctcattcacgtacatgggagagtctacaaagtcacacgtattcataggttaagccacatgctgacaaatgtcataagaagaccctacacttttaccttggccgatccctcccctcagtgcaagctctgtgcaagagtgaacttgaacttcactcagtgcaagagtgaacacacactttgtgccggctttaaagaacccagcacaaagccagtctgcatggcctacagacatattttgctggacaatgattacttgcttttctttttgtttttcttgtatatgcctgtttgattggttcctgacataccagaaaatcactgtcaaaacattagcttaacatttgttaaggaaacaaaaagacttcggtgaccacaccttataaaccaaacagttttgtaaatcactttggaaaatttcactaaaaaaaaaaatccttaacaatataataagtaaagaaaatttaaaaccacaaaacattactgtgtttgtagggggaggtctgatttacagagtaaccacatagtaattataattattagaatgtccagttttcaaaaaacgttacaaggcatacaaagaatgggaaagtgtggctcattcaaaggaacaaaataaagtgacagaaaatatccctaaggaaacccagacatcaaacttaccagacaaagactttaaaacaactctcttcattatactcaaatgtcaaaaggaaaacataaacaaagaaataaaggaatcagaaaaaatattaaaaagtaggaatatcagcaaagagataacaaattctggagtggaaaactacaatgataaaaatttaaaaatcaccagagggatttaagagtatatttgcacacacagaggaagccatgaacttgaagagaagaaaatggaaaatactgtctctgagaaacagaaagaataaaaaataaacaatgagcagagactaatgaatttgtgggacatcatcaaatagaccaacattcatattctagaaggataaattatgttgttaaaaagtttaccattctttcttttcacctttcttccttcttccttccccctcctcctttttacttttcttcctcttcctttctcttcttctttctcgccttcattatccctttcgctgtttctctttctccctttctcttttttcttttctttcaattttctcaattactaagagatgtttaagtacccttagcatgttagtagatatggttatttctccctttagttctcttttgagatttatagtcactcaaataaagagataacccaaacataagcgtcacaaacaggctttcataccattcttaatttggtcctgtaattcttcattgctgtattaattttctgatgcttttaaggatgttttataacaaattgtgtagctttttccaatggaatgtttattctgaattatctaattcatattgtaagtatagagggagtttaatataaaattattaaactaatatttgtgaaagaatgtatttgagcatttaacaaatatgttaatcctcagactgttattgggcagctgagcatacaggaataaaaataacacaatttttatgtgtacaa

SEQ ID NO: 182071 - DNA, 1477 bp, Homo sapiens
  Payload ID: 15855
  Gene Symbol: SRGAP2C
  Gene Name: SLIT-ROBO Rho GTPase activating protein 2C
  ENST ID: ENST00000304465
  CDS Start-End: 449-1366
catgttgtgcggaaggacttccactccccgcctgtgtcgttgatgtcagaccccaggccagcctccgggcgctgcagttctcccggctaatgctgaggctgcggctccggctctagcacaggcaccagccgccgccgcacccggcctcagcgcccaccgtctgcatgtgcccgccgtagccgtctgcccagcccgcagcccgcgctccacggagcgctggagaccaccgtggggggccccttctgccctcgagagaagcggtcttggaggtattgatttaggtggttggattttttccgtggatctatcaattcacaattcgaatttggaagaaagaaggaaaacatgacgtctccagccaaattcaaaaaggataaggagatcatagcagagtacgatactcaggtcaaagagtaaagaagtcggccagcagctccaagatgatttgatgaaggtcctgaacgagctctactcggtcatgaagacatatcacatgtacaatgccgacagcatcagtgctcagagcaaactaaaggaggcggagaagcaggaggagaagcaaattggtaaatcggtaaagcaggaggaccggcagaccccatgctcccctgactccacggccaacgttcgcattgaggagaaacatgtccggaggagctcagtgaagaagattgagaagatgaaggagaagcaccaagccaagtacacggagaataagctgaaggccatcaaagcccagaatgagtacttgctggctttggaggcaaccaatgcatctgtcttcaagtactacatccatgacctatctgaccttattgattgttgtgacttaggctaccatgcaagtctgaaccgggctctacgcaccttcctctctgctgagttaaacctggaacagtcgaagcatgagggtctggatgccatcgagaatgcagtagaaaacctggatgccaccagtgacaagcagcgcctcatggagatgtacaacaacgtcttctgcccccctatgaagtttgagtttcagccccacatgggggatatggcttcccagctctgtgcccagcagcctgtccagagtgagctggtacagagatgccaacaactgcagtctcgcttatccactctaaagattgaaaacgaagaggtaaagaagacaatggaggccaccctgcaaaccatccaggacattgtgactgtcgaggactttgatgtgtctgactgcttccagtacagcaactccatggagtccgtcaagtccacggtctctgaaaccttcatgagcaagcccagcattgctaagaggagagccaaccagcaagagacagagcagttttatttcacagtaagggagtgctatggcttttaaagagcgtcagcatgcactgcagcactcaagggagatttggaactcagagtccttgttaagtgtctgaaggacaggcattgaatatcttagatacgaatgtgggcatactca

SEQ ID NO: 182072 - DNA, 8415 bp, Homo sapiens
  Payload ID: 15856
  Gene Symbol: SRGAP3
  Gene Name: SLIT-ROBO Rho GTPase activating protein 3
  Uniprot ID: O43295
  ENST ID: ENST00000360413
  CDS Start-End: 263-3490
ctgtgctcctagggtgattcttcttttgcaagaggagctgaccagggcaagctactagagccatttctcggcaagtaaagagatttttccttccagaaggagaaggatttttctccctgctctgcagccaagtgaaagagattagtccctaaacctgtgaaatcgaccagagctgtgtgattaccagggcttgagagaggactcgaaaagaaaaggagaaataaatcaaacagcctgtcagttcctttggccacgtcagaagatgtcatctcaaactaagttcaagaaagacaaagagatcattgctgaatatgaagcccaaataaaagagatccgcacgcagctggtggagcagttcaaatgtctggagcagcaatcagagtcgcgactgcagctgcttcaagacctccaggagtttttccgccggaaagctgagattgagctcgagtactcccgcagcctggagaagctggctgagcgcttctcctccaaaatccgcagctcccgggagcaccagttcaagaaggaccagtacctcctctcgcctgtgaactgttggtatctggttctgcatcagacccggcgggagagccgagaccatgccaccctcaatgacatcttcatgaacaatgtcatcgtccgcctctcccagatcagtgaggatgtcatcagactcttcaaaaagagcaaggagattggcctgcagatgcacgaggagctcctgaaggtgaccaatgagctctacacagtcatgaaaacctaccacatgtaccatgcagagagcatcagtgcggaaagcaagctgaaggaggctgagaagcaggaggagaagcagttcaataagtcaggagacctcagcatgaacctgctccggcacgaggaccggccccagcgccgcagctctgtgaagaagattgagaagatgaaggagaagaggcaggccaagtactctgagaacaagctgaaatgcacaaaggcccggaatgactacttgctcaatctggcagccaccaacgcagctataagcaaatactacatccatgatgtctctgatctgatcgattgctgtgatttgggcttccatgccagcctggcccgcaccttccggacctatctctcagctgaatacaacctggagacctctcgccacgaagggctggatgtcattgagaatgcagtggacaacctggattcccgaagtgacaagcacacagtcatggacatgtgcaatcaagtcttctgccctccactcaagttcgagttccagccccacatgggggatgaggtctgccaggtcagcgctcagcagcccgtccagacagaactgctcatgcgttatcaccagctgcagtccagactggccaccctcaagatagagaatgaggaggttaggaaaaccctggatgccaccatgcagacattacaggacatgctgactgtggaggactttgatgtctccgatgccttccaacacagtcgatcgacagagtccgtcaagtcggctgcctctgagacctacatgagcaagatcaacattgccaagaggagagccaaccagcaggaaacagaaatgttttattttacaaaatttaaagagtatgtgaatggcagtaacctcatcaccaagctgcaggccaagcacgatttactcaagcagaccctgggcgaaggggaaagagcagaatgcggcaccaccagaggaagaagaaatgctcgaaccaggaaccaggattcaggacaagctataccgcttgtagtcgagagctgcatccgttacatcaatttatatggactccagcagcaggggatcttcagagtgccaggatctcaggtggaagtcaatgacatcaaaaattcctttgagagaggtgaagacccccttgtggacgatcaaaatgaacgagatatcaattcagtcgctggtgttttaaaactgtatttccgaggactggaaaacccactctttcctaaggaaaggtttcaagatttgatatctactattaaactggagaacccagccgagagggtgcaccagatccaacaaatcctcgtcacccttccccgcgtggtcattgtggtcatgagatacctcttcgctttcctcaaccacctctcccagtatagcgacgagaacatgatggatccctacaacctggccatctgcttcgggcctaccctcatgcacatccctgatgggcaggaccctgtgtcctgccaggcacacatcaatgaagtcatcaaaaccatcatcatccatcatgaagccatcttccccagcccccgggagctagagggacctgtgtatgaaaaatgcatggctggaggggaagaatattgtgacagcccacacagcgagccaggggccatcgatgaagttgaccatgacaatggcactgagcctcataccagcgatgaagaagtggagcagatcgaggctattgccaagtttgactacatggggcggtccccgcgtgagctatccttcaagaagggggcctcgctgctcctgtaccaccgcgcctcggaggactggtgggagggccggcacaacggcgtggatggactcatcccccatcagtacatagttgtacaggacatggatgatgccttctccgacagcctgagccagaaggctgacagcgaggccagcagtgggccattgctggatgacaaggcctcttccaaaaacgacctccagtcccccacggagcacatctcggattacggctttgggggggtgatgggccgagtgcggttacgatctgatggagcagccatccccagacgccgaagcgggggcgacacacacagcccgccccggggcctgggccccagcatagacacaccaccccgggctgctgcctgccccagcagcccccacaaaatccccctcacccgggggaggatcgagagccctgagaagcggaggatggcgacgttcgggagcgctggcagcatcaactaccctgacaagaaggcgctctccgaagggcactcgatgaggtcgacctgcggttccaccaggcacagcagcctaggggaccacaagtccctggaggccgaggccctggcagaagacatcgagaagaccatgagcacggctctgcacgagttgcgggaactcgagaggcagaacacggtcaagcaggcgccagatgtggtgctggacaccctggagcccctgaagaacccgccaggccccgtcagctcggagcccgccagtccccttcacaccatcgtcatccgcgaccccgatgccgccatgcgccgcagcagcagctcctccaccgagatgatgaccaccttcaagccagccctgtccgcccgcctggctggcgcccagctccgcccgccccccatgcggcccgtgcggccggtggtccagcaccggtccagcagcagcagcagctcgggcgtgggcagcccggccgtgacgcccaccgagaagatgttccccaacagctcagcggacaagtcgggcaccatgtgacctgcaggatgggccgcgccgccgtggcccgctgtggctcaccacggcccagggtggccttggtggcttccacgtgcttcccagtgaccctggccttggagggcagaggtccgtctgggagggtgtgtctgtgcagagctgaggcccgggcgctggctgcagctcacgtccagccatgggaatcccacggacctctcgcgtgtcaacagacgaccagaggagtgctggagctccagcagccccaaccacagcattccctaacatggaggcaaaataccacatggcttctcccgcatatcgtcactggaaacttcctctctcgacattctctctacatacgtatatgtgtgtgtatatcgatgtgtgcatatatacacatgtatacgtatgtacgtgtctgtaggtgtgtgtatatatatatatatttatgcatctatatacatatactagatctggacacacgcatactaagtgtatatagtatctcctttttctttttatgaaacttagatttacctcagatccatgccaccaaacatctcccaccgagttatttggtgggatttgcagggacttttctgggagaacttaaaggcccatagtaactgcgaatgaagcaatataccactaacctgcagaaaaacacaaacaaaaacagactcccactgtctccagaagtcgtggccttccagaacagtctgcccctcaaggaagggtggggcaggcagtacccccaagcaggctgctcccagaggtggggaacccttcataggaaatccccacccccgtccaccccagagaccctgcccttccacccggaggccaaaggccaactgtactcccaaaggcatgggagaaggttggcgagaagacccctgactaccacatccttgtgtttgtgtgtagagacgggggatagtgagaacctaagccccatcgtagcacagtattacatgtggttgggaaaaataaaaatacagtggtgtggaatactccaaaacctagaaatgctgtaggaataaatctgtggtaactatagaggtttaacttatatcattttcaaactatttaattttttcttttcctggttctactaattatactgtgtcagatttggaactaaacaggcaaggaggctttgagtcacatcgttttcattttaaatcaggctgtgatgcactgtggctggtgccgtcttgcatgaaacgcatgagccgtgagcgcccagttcagactggggccagggaggggcagtccttggcactttctgtcctagaggacactgtcagttgagttaatacaagtgacatagcttcccttccctcccccttcacccactccctccagaacatttagtgtagatgaaaatgtggtgatagaaatgggtgcatgatcttcacgtgtgacagccaggcctttgcctcttggccaagtaaagcccttccgggtcgctctccttcgattccattttacctcctcttctgatcacttccagagatgagctgtttctggataatggcacacgggcaaatctgtgtgccctgtgggccgctgttacttaccctctcctgcgagacccaggggcttttccctactgttcccacgcttcctctctctcgaggccactgaagtttggagtcaaaaggcccagagtctgagtcccagccctgagcacttaggagccttctgacttagggtttgtcactccacctcattgagcctgactgttctgctccataaaatagggtaataaaggtcaaacatcagtgagcaagctgtgtacactggaaaacactgaatcaatacaatgcgtttgtgattatcattagtaaggtaagtcttagatcagagccctccagcccttctttttgaaacctcccaatggcatttcagaagtgagcagtggaattttcctgccatcctaataagagccctggattccatcattaacatttcagcccattggatgaagtggtgccctctcctctggtcccccgcgaaaaggtaaatacacccaaagggagggacctagttaagtcactggcacctagataagttaggagggtaaagccactacctcgtctgaaggactggacttgacaccccacagtggaagggagcatcaggagaggaacaaaaaaagggatctcagggagaggccagtgtcaaacttgacctcccttgtttggcctagaatgaacccttctctttagctcctggatatgaaaggccatctgcttggagcacagaaagatattgccattttacagcttaagagagtaaggccttgggctgtgctgtgacctgcccaagatttgacactggctaggagcagaggctgcgtcaggctcttaaagtcatgtgtttgcatgctggatgctatactgtccagccaggacacaagacttctgatttctaccctcaagatactcccagatcctaaatccagtagcctcccaggcaaaatatagcaatctgccacaactgccagatgaaaagcaacaatcagagtagaaaaatctgttgcctgatatacataacaccaatcagaccgtgtggatttttctctgaattgactgattttgtttttttcttactgaaaatggacctgcctttcactgaattttctgagggcagagtcttagctgttttctttaagcaccttttttttttttttccattgggaaatggctgatgagttcacatttagggatgtacacacacagatggcagacgtctccccactcatccagccccagatctgagccttgacgcaggccaagtggaaaaatactttcccgcccccctcccctgttcccacttcctcatctggcactatgcatgtctcactcaccctccacagcactcagtcccatcgacgttcactgaacattggctttctctttctgactcctgcctgttttagtccactatatattgctgtatttgcttaaatgctggaaagtaactgttaaaatgtgaaattgtaatttttaaaaaggctacaattaaattttagccaatgccactcaccaaatctttgcacctagtagatagatcaatgtaaaaacaaatacctaactgtacagtgagtgtgggggaaatgtagtaacctagttagtagtcttcaatataaccaattgtacaaggggaagtggtgtttacctacttgttcatcaccattattgaaagccgtactgatcagttagttgacaacgggcatttttttttctttgcttcatggaatgatttcttttcttaaccttcgacttatcctgaggtcaagccttttgtctttatgtgtaaccgacgttcagtctattctaggaatgaaccagcaagttgttcatttaaaactgaccaaagacaattaattcctggtctagtttcctgggccttgtggctcagctgccactaaagagctttttggataaaattgagaacaagctgtgcttcctaccccactctccccgtccccttttattcccttttcctcttaaagagctgctctgagctgtgggattctatgaaaaattcttgcctttccttgtttcagtgctaacgatttctcacctcgaagcgccttttgaaccccggacagagtgcacaatcggagggaattgcgagcttgggaattagactttggagtcttttctctgaagtcaccaggccaggggtcaggagagagatggattcccaagggatgaaaggtttctattcaatgaagaaatcggagtgggaagagacacagggaaattgagccatattttggctatcggctggaaccagcagttcagagatctgccttataaacatttaaaaccggtttgtggtacacaaagaggaaccagtgtgggaaggggcctttatgtggggctttcttctctgttggagtcccttggagtgccttgttgggtatatttctctgtcattcaggaggcacgaatgtggaggacttctcgtgacctggtcgtgatgtggcattcagtgcatgtccacagctaatggaaaaacacgaggactcgggtaatggttcttcctctcagtctttctattcctaacttttcacacatccagatggttccacactagtgcaaatgcctcactctcctgagaaacccagaaagaagagtggctggctcacaaccatggggttagcccctgctgggctgggagtcggggtggcggccaggaggaaaggcagaaaggggtgagccgaggtgttgcctagctgattttctgctgtgcagagctaatgctgacatttcatgtcaacttccccggttctctggggtctcctctcctctgagcagccacatagaacattccccacatatccaaagctgcccaggggagccgagagaagggactttgctgtcaggtccaagccctcctgacctccctgagattgatctgccagtgtcctgctgtccctctgggactggccacatggccatcgctgccccttgttgacacctcctttctgtgtgagttgtccccggccaataacaaagctgttccttgaaccagaacaaccagagtgcacttttccttccttagacggaagtagatcctggctagggtttctgcccaggcccttgttcccggcagtgtgactgtttacatggtttggcaataggtttgattctgattgcttcagagtggctggtctattttgtttcctttggtttccttcctccccaaattgtgacaggaaaaacagaccaaaaccaccctaggaaattgctggttgcctgtccccacgtgatgataaatgttgccctcttctggatatcgtttctctaccttacgaccaaacgcccgtcctatagagtgtctgattggatcctctgtcgcgtattctgatggtgcctgctggtttgacgtggagctatcctgtgaaataaaacagcttaacttttctc

SEQ ID NO: 182073 - DNA, 8656 bp, Homo sapiens
  Payload ID: 15856
  Gene Symbol: SRGAP3
  Gene Name: SLIT-ROBO Rho GTPase activating protein 3
  Uniprot ID: O43295
  ENST ID: ENST00000383836
  CDS Start-End: 429-3728
gtgtgtgtgtatgcctgtgtgcacagcacaactgtgtgcgtgtcccggtgagtgtgcctgtgcatgcgtgagtgtgtgtacgtgtgcatgtgtgtgtgagtgcgcttggttattactattattattatttttggaagaaaaatctttgaaaatctggggcaggttactgtgctcctagggtgattcttcttttgcaagaggagctgaccagggcaagctactagagccatttctcggcaagtaaagagatttttccttccagaaggagaaggatttttctccctgctctgcagccaagtgaaagagattagtccctaaacctgtgaaatcgaccagagctgtgtgattaccagggcttgagagaggactcgaaaagaaaaggagaaataaatcaaacagcctgtcagttcctttggccacgtcagaagatgtcatctcaaactaagttcaagaaagacaaagagatcattgctgaatatgaagcccaaataaaagagatccgcacgcagctggtggagcagttcaaatgtctggagcagcaatcagagtcgcgactgcagctgcttcaagacctccaggagtttttccgccggaaagctgagattgagctcgagtactcccgcagcctggagaagctggctgagcgcttctcctccaaaatccgcagctcccgggagcaccagttcaagaaggaccagtacctcctctcgcctgtgaactgttggtatctggttctgcatcagacccggcgggagagccgagaccatgccaccctcaatgacatcttcatgaacaatgtcatcgtccgcctctcccagatcagtgaggatgtcatcagactcttcaaaaagagcaaggagattggcctgcagatgcacgaggagctcctgaaggtgaccaatgagctctacacagtcatgaaaacctaccacatgtaccatgcagagagcatcagtgcggaaagcaagctgaaggaggctgagaagcaggaggagaagcagttcaataagtcaggagacctcagcatgaacctgctccggcacgaggaccggccccagcgccgcagctctgtgaagaagattgagaagatgaaggagaagaggcaggccaagtactctgagaacaagctgaaatgcacaaaggcccggaatgactacttgctcaatctggcagccaccaacgcagctataagcaaatactacatccatgatgtctctgatctgatcgattgctgtgatttgggcttccatgccagcctggcccgcaccttccggacctatctctcagctgaatacaacctggagacctctcgccacgaagggctggatgtcattgagaatgcagtggacaacctggattcccgaagtgacaagcacacagtcatggacatgtgcaatcaagtcttctgccctccactcaagttcgagttccagccccacatgggggatgaggtctgccaggtcagcgctcagcagcccgtccagacagaactgctcatgcgttatcaccagctgcagtccagactggccaccctcaagatagagaatgaggaggttaggaaaaccctggatgccaccatgcagacattacaggacatgctgactgtggaggactttgatgtctccgatgccttccaacacagtcgatcgacagagtccgtcaagtcggctgcctctgagacctacatgagcaagatcaacattgccaagaggagagccaaccagcaggaaacagaaatgttttattttacaaaatttaaagagtatgtgaatggcagtaacctcatcaccaagctgcaggccaagcacgatttactcaagcagaccctgggcgaaggggaaagagcagaatgcggcaccaccaggcccccctgtcttccccctaaaccacagaaaatgaggagacctaggcctctctcagtgtatagccataaactctttaacggcagtatggaagcattcattaaggattcaggacaagctataccgcttgtagtcgagagctgcatccgttacatcaatttatatggactccagcagcaggggatcttcagagtgccaggatctcaggtggaagtcaatgacatcaaaaattcctttgagagaggtgaagacccccttgtggacgatcaaaatgaacgagatatcaattcagtcgctggtgttttaaaactgtatttccgaggactggaaaacccactctttcctaaggaaaggtttcaagatttgatatctactattaaactggagaacccagccgagagggtgcaccagatccaacaaatcctcgtcacccttccccgcgtggtcattgtggtcatgagatacctcttcgctttcctcaaccacctctcccagtatagcgacgagaacatgatggatccctacaacctggccatctgcttcgggcctaccctcatgcacatccctgatgggcaggaccctgtgtcctgccaggcacacatcaatgaagtcatcaaaaccatcatcatccatcatgaagccatcttccccagcccccgggagctagagggacctgtgtatgaaaaatgcatggctggaggggaagaatattgtgacagcccacacagcgagccaggggccatcgatgaagttgaccatgacaatggcactgagcctcataccagcgatgaagaagtggagcagatcgaggctattgccaagtttgactacatggggcggtccccgcgtgagctatccttcaagaagggggcctcgctgctcctgtaccaccgcgcctcggaggactggtgggagggccggcacaacggcgtggatggactcatcccccatcagtacatagttgtacaggacatggatgatgccttctccgacagcctgagccagaaggctgacagcgaggccagcagtgggccattgctggatgacaaggcctcttccaaaaacgacctccagtcccccacggagcacatctcggattacggctttgggggggtgatgggccgagtgcggttacgatctgatggagcagccatccccagacgccgaagcgggggcgacacacacagcccgccccggggcctgggccccagcatagacacaccaccccgggctgctgcctgccccagcagcccccacaaaatccccctcacccgggggaggatcgagagccctgagaagcggaggatggcgacgttcgggagcgctggcagcatcaactaccctgacaagaaggcgctctccgaagggcactcgatgaggtcgacctgcggttccaccaggcacagcagcctaggggaccacaagtccctggaggccgaggccctggcagaagacatcgagaagaccatgagcacggctctgcacgagttgcgggaactcgagaggcagaacacggtcaagcaggcgccagatgtggtgctggacaccctggagcccctgaagaacccgccaggccccgtcagctcggagcccgccagtccccttcacaccatcgtcatccgcgaccccgatgccgccatgcgccgcagcagcagctcctccaccgagatgatgaccaccttcaagccagccctgtccgcccgcctggctggcgcccagctccgcccgccccccatgcggcccgtgcggccggtggtccagcaccggtccagcagcagcagcagctcgggcgtgggcagcccggccgtgacgcccaccgagaagatgttccccaacagctcagcggacaagtcgggcaccatgtgacctgcaggatgggccgcgccgccgtggcccgctgtggctcaccacggcccagggtggccttggtggcttccacgtgcttcccagtgaccctggccttggagggcagaggtccgtctgggagggtgtgtctgtgcagagctgaggcccgggcgctggctgcagctcacgtccagccatgggaatcccacggacctctcgcgtgtcaacagacgaccagaggagtgctggagctccagcagccccaaccacagcattccctaacatggaggcaaaataccacatggcttctcccgcatatcgtcactggaaacttcctctctcgacattctctctacatacgtatatgtgtgtgtatatcgatgtgtgcatatatacacatgtatacgtatgtacgtgtctgtaggtgtgtgtatatatatatatatttatgcatctatatacatatactagatctggacacacgcatactaagtgtatatagtatctcctttttctttttatgaaacttagatttacctcagatccatgccaccaaacatctcccaccgagttatttggtgggatttgcagggacttttctgggagaacttaaaggcccatagtaactgcgaatgaagcaatataccactaacctgcagaaaaacacaaacaaaaacagactcccactgtctccagaagtcgtggccttccagaacagtctgcccctcaaggaagggtggggcaggcagtacccccaagcaggctgctcccagaggtggggaacccttcataggaaatccccacccccgtccaccccagagaccctgcccttccacccggaggccaaaggccaactgtactcccaaaggcatgggagaaggttggcgagaagacccctgactaccacatccttgtgtttgtgtgtagagacgggggatagtgagaacctaagccccatcgtagcacagtattacatgtggttgggaaaaataaaaatacagtggtgtggaatactccaaaacctagaaatgctgtaggaataaatctgtggtaactatagaggtttaacttatatcattttcaaactatttaattttttcttttcctggttctactaattatactgtgtcagatttggaactaaacaggcaaggaggctttgagtcacatcgttttcattttaaatcaggctgtgatgcactgtggctggtgccgtcttgcatgaaacgcatgagccgtgagcgcccagttcagactggggccagggaggggcagtccttggcactttctgtcctagaggacactgtcagttgagttaatacaagtgacatagcttcccttccctcccccttcacccactccctccagaacatttagtgtagatgaaaatgtggtgatagaaatgggtgcatgatcttcacgtgtgacagccaggcctttgcctcttggccaagtaaagcccttccgggtcgctctccttcgattccattttacctcctcttctgatcacttccagagatgagctgtttctggataatggcacacgggcaaatctgtgtgccctgtgggccgctgttacttaccctctcctgcgagacccaggggcttttccctactgttcccacgcttcctctctctcgaggccactgaagtttggagtcaaaaggcccagagtctgagtcccagccctgagcacttaggagccttctgacttagggtttgtcactccacctcattgagcctgactgttctgctccataaaatagggtaataaaggtcaaacatcagtgagcaagctgtgtacactggaaaacactgaatcaatacaatgcgtttgtgattatcattagtaaggtaagtcttagatcagagccctccagcccttctttttgaaacctcccaatggcatttcagaagtgagcagtggaattttcctgccatcctaataagagccctggattccatcattaacatttcagcccattggatgaagtggtgccctctcctctggtcccccgcgaaaaggtaaatacacccaaagggagggacctagttaagtcactggcacctagataagttaggagggtaaagccactacctcgtctgaaggactggacttgacaccccacagtggaagggagcatcaggagaggaacaaaaaaagggatctcagggagaggccagtgtcaaacttgacctcccttgtttggcctagaatgaacccttctctttagctcctggatatgaaaggccatctgcttggagcacagaaagatattgccattttacagcttaagagagtaaggccttgggctgtgctgtgacctgcccaagatttgacactggctaggagcagaggctgcgtcaggctcttaaagtcatgtgtttgcatgctggatgctatactgtccagccaggacacaagacttctgatttctaccctcaagatactcccagatcctaaatccagtagcctcccaggcaaaatatagcaatctgccacaactgccagatgaaaagcaacaatcagagtagaaaaatctgttgcctgatatacataacaccaatcagaccgtgtggatttttctctgaattgactgattttgtttttttcttactgaaaatggacctgcctttcactgaattttctgagggcagagtcttagctgttttctttaagcaccttttttttttttttccattgggaaatggctgatgagttcacatttagggatgtacacacacagatggcagacgtctccccactcatccagccccagatctgagccttgacgcaggccaagtggaaaaatactttcccgcccccctcccctgttcccacttcctcatctggcactatgcatgtctcactcaccctccacagcactcagtcccatcgacgttcactgaacattggctttctctttctgactcctgcctgttttagtccactatatattgctgtatttgcttaaatgctggaaagtaactgttaaaatgtgaaattgtaatttttaaaaaggctacaattaaattttagccaatgccactcaccaaatctttgcacctagtagatagatcaatgtaaaaacaaatacctaactgtacagtgagtgtgggggaaatgtagtaacctagttagtagtcttcaatataaccaattgtacaaggggaagtggtgtttacctacttgttcatcaccattattgaaagccgtactgatcagttagttgacaacgggcatttttttttctttgcttcatggaatgatttcttttcttaaccttcgacttatcctgaggtcaagccttttgtctttatgtgtaaccgacgttcagtctattctaggaatgaaccagcaagttgttcatttaaaactgaccaaagacaattaattcctggtctagtttcctgggccttgtggctcagctgccactaaagagctttttggataaaattgagaacaagctgtgcttcctaccccactctccccgtccccttttattcccttttcctcttaaagagctgctctgagctgtgggattctatgaaaaattcttgcctttccttgtttcagtgctaacgatttctcacctcgaagcgccttttgaaccccggacagagtgcacaatcggagggaattgcgagcttgggaattagactttggagtcttttctctgaagtcaccaggccaggggtcaggagagagatggattcccaagggatgaaaggtttctattcaatgaagaaatcggagtgggaagagacacagggaaattgagccatattttggctatcggctggaaccagcagttcagagatctgccttataaacatttaaaaccggtttgtggtacacaaagaggaaccagtgtgggaaggggcctttatgtggggctttcttctctgttggagtcccttggagtgccttgttgggtatatttctctgtcattcaggaggcacgaatgtggaggacttctcgtgacctggtcgtgatgtggcattcagtgcatgtccacagctaatggaaaaacacgaggactcgggtaatggttcttcctctcagtctttctattcctaacttttcacacatccagatggttccacactagtgcaaatgcctcactctcctgagaaacccagaaagaagagtggctggctcacaaccatggggttagcccctgctgggctgggagtcggggtggcggccaggaggaaaggcagaaaggggtgagccgaggtgttgcctagctgattttctgctgtgcagagctaatgctgacatttcatgtcaacttccccggttctctggggtctcctctcctctgagcagccacatagaacattccccacatatccaaagctgcccaggggagccgagagaagggactttgctgtcaggtccaagccctcctgacctccctgagattgatctgccagtgtcctgctgtccctctgggactggccacatggccatcgctgccccttgttgacacctcctttctgtgtgagttgtccccggccaataacaaagctgttccttgaaccagaacaaccagagtgcacttttccttccttagacggaagtagatcctggctagggtttctgcccaggcccttgttcccggcagtgtgactgtttacatggtttggcaataggtttgattctgattgcttcagagtggctggtctattttgtttcctttggtttccttcctccccaaattgtgacaggaaaaacagaccaaaaccaccctaggaaattgctggttgcctgtccccacgtgatgataaatgttgccctcttctggatatcgtttctctaccttacgaccaaacgcccgtcctatagagtgtctgattggatcctctgtcgcgtattctgatggtgcctgctggtttgacgtggagctatcctgtgaaataaaacagcttaacttttctcaaa

SEQ ID NO: 182074 - DNA, 3929 bp, Homo sapiens
  Payload ID: 15856
  Gene Symbol: SRGAP3
  Gene Name: SLIT-ROBO Rho GTPase activating protein 3
  ENST ID: ENST00000618999
  CDS Start-End: 354-1361
gggccccagtgcccccgtccccaccaccagtctcatgctcctacccttgtgtgcccgcagagatccgcacgcagctggtggagcagttcaaatgtctggagcagcaatcagagtcgcgactgcagctgcttcaagacctccaggagtttttccgccggaaagctgagattgagctcgagtactcccgcagcctggagaagctggctgagcgcttctcctccaaaatccgcagctcccgggagcaccagttcaagaaggaccagtacctcctctcgcctgtgaactgttggtatctggttctgcatcagacccggcgggagagccgagaccatgccaccctcaatgacatcttcatgaacaatgtcatcgtccgcctctcccagatcagtgaggatgtcatcagactcttcaaaaagagcaaggagattggcctgcagatgcacgaggagctcctgaaggtgaccaatgagctctacacagtcatgaaaacctaccacatgtaccatgcagagagcatcagtgcggaaagcaagctgaaggaggctgagaagcaggaggagaagcagttcaataagtcaggagacctcagcatgaacctgctccggcacgaggaccggccccagcgccgcagctctgtgaagaagattgagaagatgaaggagaagaggcaggccaagtactctgagaacaagctgaaatgcacaaaggcccggaatgactacttgctcaatctggcagccaccaacgcagctataagcaaatactacatccatgatgtctctgatctgatcgattgctgtgatttgggcttccatgccagcctggcccgcaccttccggacctatctctcagctgaatacaacctggagacctctcgccacgaagggctggatgtcattgagaatgcagtggacaacctggattcccgaagtgacaagcacacagtcatggacatgtgcaatcaagtcttctgccctccactcaagttcgagttccagccccacatgggggatgaggtctgccaggtcagcgctcagcagcccgtccagacagaactgctcatgcgttatcaccagctgcagtccagactggccaccctcaagatagagaatgaggaggttaggaaaaccctggatgccaccatgcagacattacaggacatgctgactgtggaggactttgatgtctccgatgccttccaacacagtcgatcgacagagtccgtcaagtcggctgcctctgagacctacatgagcaagatcaacattgccaagaggagagccaaccagcaggaaacagaaatgttttattttacaaaggggcctgatgatgttttccccatttgccatccaagactctgatgaggcttaaacgtacgtgtgtgaaaactgtcaagtgctctgtggatacaagtcgagtgactcttaatggccaataggccaggtcctgggagcctaggaccatggaaaaggagagaggacaccacaacctcccaccagcccagtcgttccagaaacccatcaagaaatttaaagagtatgtgaatggcagtaacctcatcaccaagctgcaggccaagcacgatttactcaagcagaccctgggcgaaggggaaagagcagaatgcggcaccaccaggcccccctgtcttccccctaaaccacagaaaatgaggagacctaggcctctctcagtgtatagccataaactctttaacggcagtatggaagcattcattaagaggaagaagaaatgctcgaaccaggaaccaggattcaggacaagctataccgcttgtagtcgagagctgcatccgttacatcaatttatatggactccagcagcaggggatcttcagagtgccaggatctcaggtggaagtcaatgacatcaaaaattcctttgagagaggtgaagacccccttgtggacgatcaaaatgaacgagatatcaattcagtcgctggtgttttaaaactgtatttccgaggactggaaaacccactctttcctaaggaaaggtttcaagatttgatatctactattaaaaagttgccccatacccagtttcatttggggtgtttctcacagtactctgagagatatttgcagccaggaaagtgtcccaggagatggcaagagaagagaactggagaacccagccgagagggtgcaccagatccaacaaatcctcgtcacccttccccgcgtggtcattgtggtcatgagatacctcttcgctttcctcaaccacctctcccagtatagcgacgagaacatgatggatccctacaacctggccatctgcttcgggcctaccctcatgcacatccctgatgggcaggaccctgtgtcctgccaggcacacatcaatgaagtcatcaaaaccatcatcatccatcatgaagccatcttccccagcccccgggagctagagggacctgtgtatgaaaaatgcatggctggaggggaagaatattgtgacagcccacacagcgagccaggggccatcgatgaagttgaccatgacaatggcactgagcctcataccagcgatgaagctcctcgggctgatgggcagaaggcttctctggacaccaggactgaagatgaggagggacagagagaatagggcttgctgggtcagcgaagaagcagccatgggactcacccagtggggcttcctccccataagaaccaccccccagaaagtgctgcctcccacttctcagggtaaaggttcacagtggcccccagaatgcatgagtcagagctttgggtccccctccgagatgatccttcttctttttgttctttgtaaggctgctggtttctgggaatgacaaaggcaggaaaaatcattctgggaaggaagaagccacagtctgggagagccagtttcatgttccctgaaggctctcaaagtatcctgtgtgtattagtggggggtattgaatcaggggcactctttggtggaaaatcaattgcattttctaaatgttacattcttgccatccctggccaaacagtggcagaatagtgagctgcagagacagtcaaggggtcactgtgctcagaaaaaagagacctggagttgaagcacagagggagtccttatggtcatgtaatctgaggcaagccacatcacctctggcctctatttccttatctataaaatgggaatgacagcaccaagcaaattatggcatgggttaaaatgaggtgacatatgtgaaggagcctagcacagtgcctgggacagggaggtggataagaaacatcaatggactctgtatcaaacagacatccttcctaatcctgatagaaaaactgagtcctggagaattttcttgacctaactggcattggcagttactggtcattggcaaccagaacctcctgatttgtttacctgtttcctcttagacatttcatttaggggatcatcaatatctgtcttctttgctcttgacagcacccggtatgaatggaatccagcaggcctcaaaggtcaaatcaggcagagaaccatgagtccaggtctttgccatgcatgaatcagccaatgaatgccaaattgcaggaacaatttagttgtttgtgtatctgttgcctttcttgtctcaaagattctgtaccaactgggcgtggtggctcacacctgtaaccccaacactttgggaagttgaggtgggcagatcacttgagcccaggaattcgagaccagcctgggcaacatggtgaaactccgtctctacaaaaaaaaccaaaatacaaaaattagccaggcatggtggcatatgcctgtggtcccagcaactcaggaggctgaagtgggagaattacttaagcccagggaggttgaggctgcagtgagccatgattgtgccactgtactccagcctgagtgacagaacaaggtcctgtctc

SEQ ID NO: 182075 - DNA, 1173 bp, Homo sapiens
  Payload ID: 15857
  Gene Symbol: SCIMP
  Gene Name: SLP adaptor and CSK interacting membrane protein
  Uniprot ID: Q6UWF3
  ENST ID: ENST00000399600
  CDS Start-End: 106-522
actgtctctagcagtgggtgaaggcctgtgagtgaggaatgcctctcaccagctgtgcctgagctgcagcactccagccactgctgtctccttagctgctcacatatggatactttcacagttcaggattccactgcaatgagctggtggaggaataatttctggatcatcttagctgtggccatcatcgttgtctctgtgggtctgggcctcatcctgtactgtgtctgcaagaaatgggaaattgccaagcccctgaaacacaagcaagtagatgaagaaaagatgtatgagaatgttcttaatgagtcgccagttcaattaccgcctctgccaccgaggaattggccttctctagaagactcttccccacaggaagccccaagtcagccgcccgctacatactcactggtaaataaagttaaaaataagaagactgtttccatcccaagctacattgagcctgaagatgactatgacgatgttgaaatccctgcaaatactgaaaaagcatcattttgaaacagccatttcttctttttggcaaaactgaagagggttcacacaacttattttaaaacaatcaagaatggttgaacttcagtaggtctctgggccctgaaagccagtggtgattttatgaagctctataagataaagcacttcccaaaccttagatgaagacacccctgcgatcggatgactgcagccagaggagacacatgggtgctcggctctgaggacttagaggggtcagccttgtgctgttgaggaaactttccatgggaaggaccacggggctccatggctcccacctgtgggaaactactcatttcttggcattctttcccccttcattccctttggtttgcatggttctgagtgatattaaatctcagcatttggttgtgcagaccctcccaggctcccatccccagcaaggccctcaccaagcatgctggtctttaccctctcaccccacccacctcctgcactgtgaggctgtgggtgagttacagctgagtgctctcgtgcccaggttcccacaccacatctcgcgagtttgcaagggcagggagtaccttttgttctcgtgaaccctccccacctagacaccctgcaaaccccagtgcctttatatgatgtaggccaaattgaccatagagatttgag

SEQ ID NO: 182076 - DNA, 569 bp, Homo sapiens
  Payload ID: 15857
  Gene Symbol: SCIMP
  Gene Name: SLP adaptor and CSK interacting membrane protein
  ENST ID: ENST00000574297
  CDS Start-End: 106-498
actgtctctagcagtgggtgaaggcctgtgagtgaggaatgcctctcaccagctgtgcctgagctgcagcactccagccactgctgtctccttagctgctcacatatggatactttcacagttcaggattccactgcaatgagctggtggaggaataatttctggatcatcttagctgtggccatcatcgttgtctctgtgggtctgggcctcatcctgtactgtgtctgtaagtggcagcttagacgaggcaagaaatgggaaattgccaagcccctgaaacacaagcaagtagatgaagaaaagatgtatgagaatgttcttaatgagtcgccagttcaattaccgcctctgccaccgaggaattggccttctctagaagactcttatggagtcttgctctgtcacccaggctggagtgcaatggcacgatctcggctcactgcaagctccgcctcccgggttcatgccattctcctacctcagcctccggagtagctgggactacaggcacccgccaccacgcccagctaattttttgtatttttagtagagaaggagtttcaccg

SEQ ID NO: 182077 - DNA, 2155 bp, Homo sapiens
  Payload ID: 15857
  Gene Symbol: SCIMP
  Gene Name: SLP adaptor and CSK interacting membrane protein
  Uniprot ID: Q6UWF3
  ENST ID: ENST00000571800
  CDS Start-End: 69-440
aatgcctctcaccagctgtgcctgagctgcagcactccagccactgctgtctccttagctgctcacatatggatactttcacagttcaggattccactgcaatgagctggtggaggaataatttctggatcatcttagctgtggccatcatcgttgtctctgtgggtctgggcctcatcctgtactgtgtctgcaagaaatgggaaattgccaagcccctgaaacacaagcaagtagatgaagaaaagatgtatgagaatgttcttaatgagtcgccagttcaattaccgcctctgccaccgaggaattggccttctctagaagactcttatggagtcttgctctgtcacccaggctggagtgcaatggcacgatctcggctcactgcaagctccgcctcccgggttcatgccattctcctacctcagcctccggagtagctgggactacaggcacccgccaccacgcccagctaattttttgtatttttagtagagaaggagtttcaccgcgttagccaggatggtctcgatctcctgacctcgtgatccaccggcctcggcctcccaaagtgctgggattataagcgtgagccacttttttttgtttttgagatggagtctcgctctgtcccccaggctggagtgcagtggcgcgatctccactcactgcaagctccgcctcccaggttcacaccattctcccacctcagcctcctgagtagctgggactacaggtgcccaccaccacgcctggctaattttttgtatttttagtagagacggggtttcaccatgttagccaggatggtctaaatttcctgacctcatgatctgtccacctcggcctcccgaagtgctgggattacaggtgtgagacaccacgcccgtcccctatgaaggtgtcttagatagctcaggctgctgtaacaaaaataccatagactggggtgcttacacaacagaaatttgttttctcgttgttctgaagctggaagcccgagatgagggtgttggccgatttctgtgaggtttctggtgagggttctcctcctggcttgcagacagctgccttcttgctatgtccccacaaatggcctttccttggtgcattcaagctggggaagagcatcagggagtcagatttctggtgtttcttcttacaaggacactgatcctgttggatcaaggcctcatccctatggccacatatagcctcactgggggttaaggcttgaacacctgaattttggggggacacaaacattcagtctgtaacactaggatttatagatgcagcatcctgattattttatttttgaggcagagtcttggtttctcacccaggctggagtgcagtggcatgatttcagctcactgcaatctccacttcctaggtccaagctattttcctgcctcagcctcctgagtaactgggattataggcgtgcaccaccacactcagctaattttttgtatgtttagtagagacggggtttcaccatattgaccaggctcgtcttgaactcctgacctcaagtgatccacccgcctcgacctcccaaggtgctgggattacaggcatgagccaccacacacagccagcatcctgtttaaaagagatagccagaggccaggcacagtggcatatgcttgtaataccaacactttggaaggccagggcgggctgatgacttgagctcaggagtctgagaacagcctgggcaacatggcaaaatcctatctttacaaaaattagccagcgtgatggtgcacacttatagtcccagctacttggaaggctgaggtggggggatcgcttgagcctgggaggtctgcagtgagccacgatagcatcactgcacctggacgacagagtgagaccctgtctcaaaaaaaaaaaaaaaagggatggaaaagcaaaaagggggcagcataagtaccgacgcacccaatagcctgatataagggtgtaaattcatgttcaaatcccagcttggaacataaacagaaagaaacatggggtgtcactaggcctttcacttcctatcagaaaaactctgcctggttcctttgactggaatgttcttccttaagctctttgcctcgctggattttcctcatccttcagatgtcagctcagaagttaccacctc

SEQ ID NO: 182078 - DNA, 2383 bp, Homo sapiens
  Payload ID: 15857
  Gene Symbol: SCIMP
  Gene Name: SLP adaptor and CSK interacting membrane protein
  Uniprot ID: Q6UWF3
  ENST ID: ENST00000574081
  CDS Start-End: 106-543
actgtctctagcagtgggtgaaggcctgtgagtgaggaatgcctctcaccagctgtgcctgagctgcagcactccagccactgctgtctccttagctgctcacatatggatactttcacagttcaggattccactgcaatgagctggtggaggaataatttctggatcatcttagctgtggccatcatcgttgtctctgtgggtctgggcctcatcctgtactgtgtctgtaagtggcagcttagacgaggcaagaaatgggaaattgccaagcccctgaaacacaagcaagtagatgaagaaaagatgtatgagaatgttcttaatgagtcgccagttcaattaccgcctctgccaccgaggaattggccttctctagaagactcttccccacaggaagccccaagtcagccgcccgctacatactcactggtaaataaagttaaaaataagaagactgtttccatcccaagctacattgagcctgaagatgactatgacgatgttgaaatccctgcaaatactgaaaaagcatcattttgaaacagccatttcttctttttggcaaaactgaagagggttcacacaacttattttaaaacaatcaagaatggttgaacttcagtaggtctctgggccctgaaagccagtggtgattttatgaagctctataagataaagcacttcccaaaccttagatgaagacacccctgcgatcggatgactgcagccagaggagacacatgggtgctcggctctgaggacttagaggggtcagccttgtgctgttgaggaaactttccatgggaaggaccacggggctccatggctcccacctgtgggaaactactcatttcttggcattctttcccccttcattccctttggtttgcatggttctgagtgatattaaatctcagcatttggttgtgcagaccctcccaggctcccatccccagcaaggccctcaccaagcatgctggtctttaccctctcaccccacccacctcctgcactgtgaggctgtgggtgagttacagctgagtgctctcgtgcccaggttcccacaccacatctcgcgagtttgcaagggcagggagtaccttttgttctcgtgaaccctccccacctagacaccctgcaaaccccagtgcctttatatgatgtaggccaaattgaccatagagatttgagttttcacctaggttttctccccgtgcttgcaagttgtactgtaacaatggacaaaggacaaaagttaccttctgatttacacctagaagcatcattttgcaataggtgtgttgggggtgctacaggaaaaatacatttcccccaggacaaatcatggggaacaggaaagaaaaggggcatgtaacaatggcatatacaagatgagagttcagggggcttaatatcccctgtccatcattttcatcagtacttactcgagttctaggaaaacagcctcaagccccttccttccagatcactgtccctgggcatctgggaggaggcagaaggtccactgtgatgtgctgcagccaatgagatgggccagggacatgggcagatgtcttgttaaacaagtgtcctaatggggtcaacaaggcccgagtcagctttataggctcttagacctcatcaattccttctagctgatcgccagagccctaggacttgactcattctaactatactcacaagatgctggtttctaagtgacctctgggaaatctggcaaatgaacagccttgcagagagagcactgtgaacctggaaaggcctgagagtgactcagatttccctcaagagatgggaaaatgtgttcctcccattttcaagctttctccctcaatcaacgctggagcactggggacctgggcttcctccctggttctctctttccagactctatgaaggcttccaccttgctattaatacctccttgggaggccaaggtgggcggatcacctgaggtcgggagttcgagaccagcctgaccaacatggagaaaccccatttctactaaaaatacaaaattagtcaggcatggtcgcgcatgcctgtaatcccagctacttgggaggctgaggcagaagaatcgcttgaaactgggaggcggaggttgcggtgagccgagaacatgccattgcactccagcctggacaacaagagtgaaactccatctaaaaataaataaataaataaataaataaaccctccttatgttaggccagtagttatctaactatggccttatgggactctggtatcccaccagccaaagagaggactcttcccaaattatagaacaaaaataagccaaaggattggagtgtttcaaacacatgctttcgtcttataaatgttctgtaaaccc

SEQ ID NO: 182079 - DNA, 3793 bp, Homo sapiens
  Payload ID: 15858
  Gene Symbol: SLU7
  Gene Name: SLU7 homolog, splicing factor
  Uniprot ID: O95391
  ENST ID: ENST00000297151
  CDS Start-End: 389-2149
tagtcccctggtgaggcttaagctcttgtctgttctggtcttttttttttttttttaacttcctaaaattctccgattctaaaagaaagctcctaaatagaagccaaaaagtagccgcccaacttgaaactccccacaagccgggtaaatagcgcgatacgcagcagctagagttctcgcgtttcccacggcgcaggagcactggagggcccccctccgcccccggccccgccaggaaattagtgcgcatgtgccggtcatccggaagttaccgcagtggccgccggaattaggcgaaaagccggaagtaaacattacgagattggcttggattctgtcggatggacttggggctagctgcggcggggctggaggaggccagataaccatgtcagccacagttgtagatgcagttaatgctgcacccctatcggggtccaaagaaatgagtttggaagaaccaaagaagatgaccagagaggactggagaaagaagaaggagctagaagaacagcgaaaattgggcaatgctcctgcagaagttgatgaagaaggaaaagacatcaacccccatattcctcagtatatttcttcagtgccatggtatattgatccttcaaaaagacctactttaaaacaccagagaccacaaccagaaaaacaaaagcagttcagctcatctggagaatggtacaagaggggtgtaaaagagaattccataattactaagtaccgcaaaggagcatgtgaaaattgtggggccatgacacacaaaaagaaagactgctttgagagacctaggcgagttggagccaaatttacaggtactaatatagctccagatgaacatgtccagcctcaactgatgtttgactatgatgggaagagggatcggtggaatggctacaatccagaagaacacatgaaaattgttgaagagtatgccaaagttgatttggcaaaacgaacattgaaagcccagaaactccaagaggaattagcctcaggaaaattagtggaacaggctaattctccaaaacaccagtggggagaagaggaaccaaattctcagatggaaaaagatcataatagtgaagatgaggatgaagataaatatgcagatgatattgacatgcctggacagaattttgactccaagagacgaattactgtccggaatctcaggattcgagaagatattgcaaaatatttgaggaatttagatccaaattctgcctactatgatccaaaaactagagcaatgagagagaatccttatgccaatgcaggaaagaatccagatgaagtgagttatgctggagataactttgttaggtacacaggagataccatttcaatggctcagacacagttgtttgcatgggaagcctatgacaagggatctgaagtgcatctacaggcagatcctacaaagctagagctgttgtataagtccttcaaagtcaaaaaagaagatttcaaagaacagcagaaagaaagcatcctggaaaagtatggtggccaagaacatttggatgcccctccagctgaattgcttttagcccagactgaagactatgtggagtactcaagacatgggacagtcatcaaaggacaggagcgggctgttgcctgctctaagtatgaggaggatgtgaagatccacaatcacacacatatctggggatcgtactggaaagaaggccgatggggatacaaatgctgtcactcttttttcaagtattcctattgtactggagaagctgggaaggagattgttaactctgaggagtgtattataaatgagataactggggaagaatctgtgaaaaaacctcaaaccctcatggagctgcatcaagaaaaactgaaagaggaaaagaagaagaagaaaaagaaaaagaagaagcatcgaaagagcagttcagatagtgatgatgaagaaaagaagcatgaaaaattgaaaaaggcactgaacgcagaggaggcccgccttcttcatgtcaaggagaccatgcagattgatgagaggaagcggccttacaatagcatgtatgaaactcgagaacctactgaagaggaaatggaggcatatagaatgaaacgtcagaggccagatgaccccatggcctctttccttggacagtagcaactagtcagaagaccatccaagatagatgcagctgatacattcttttcagcttcttattgatgattgtagatagaaaaatccttgtttattcttcttgctgcctggctttaataaatatttcagatgcctcacagtaagttcactcctttccatactgaggaaacaagaaaagaagaagaggcacatgaagtgtgcttttgggaatagaatttaaaattggattaagattttatttccagttttttttatttatttatttttttttttgagacggagtcttgctctgtcgcccaggctgaagtgcggtggcgcgatctcggctcactgcaagctccacctcccaggttcacgccattctcctgcctcagcctccctagtagttgggactacaggcgcccgccaccatgctcagctaattttttgtatttttagtagagacggtttcatcgtgttagccaggatggtctcgatctcctgaccttgtgatccacccgcctcagcctcccaaagtgctgagattacaggcgtgagccaccgcgcctggcctatttccagttttatgtgagtcatgtaaaaaagccttggctctctacctattaagaatgtctctttctctgtatttattaagcttcaaactttattgcttcgatttttgtggccctatatttagtattagcacaccttggttttgagaaaaaaacagggctttgtttttttaaataattactagcaactctgtgactacatttatttttattttttttagagacaggatcttgctatgttgcccaggctagagagcagtggcttttcacagacaaagtcataatgccctgcagtcttgggctcaagcgattctctcttccttggcctctggagtagactaaatgtgttagtctttgaatggaaaacaactattttctcatcattgggtcaatattgactgatcagtagtaggtcttttaccattctggacataagtctaggtgtagaaatcctttcctttatcatagaggatatggtttacattaccgtttgttttcattgtgattgcccctatgtaacaatcatgaatattagattttttaaattgtagaatatcctaatatttatagccagcagctgttactttgtttgtaaaatttgcaaaaaaacaaaacctgaagttggtttattgaaagaattataaggatagcttctagggatattagtaatagattgccatgatcctgaagcctcttctcagaacactgtgaagataatactgacagtagaatcagtgaaaacagcctaacaaaacctctgacatcagtatatcaacttttaacagcccactcactggcttttctaaactaccaaaaaccacctgtaggatactgcattaagtcagcatctcagaaacagtggtgtgagtaactgagtcaaattgtcaagtactttggatatacatagtgtcgagctttagattggtatgaaattaaacagcaatgcaaatagatttaattcctatttactttaagaatgaaaaacaatgttcattttcctacctaaacagggtggttcaacataaaggctgatgttgtgtccgttttgtattttatcttttgttaaagatacataaatgacaatacttaactgtga

SEQ ID NO: 182080 - DNA, 807 bp, Homo sapiens
  Payload ID: 15858
  Gene Symbol: SLU7
  Gene Name: SLU7 homolog, splicing factor
  ENST ID: ENST00000520664
  CDS Start-End: 503-807
attacgagattggcttggattctgtcggatggacttggggctagctgcggcggggctgggtaagaaaatattgttagaacttgcgggcgacggggagttggggaacctgagaaaatgagtcgaaggctcctaattattggatatatcttcacgggggtgatgagccctcaggtgttgagggagcgaggacgggggaccgaaaagccactgtcctgagacccattcatggcactcgtgccctgccaggccaggcctgcgtcttcagggaaacagtcgggataactatgagagtgtcgcctttgtggcggtgcctcgaagaccttgagcaatccccggactgcgagcagggaaagctgcttccagtacccaaattgacagactgtatttcctcgccagaaaaatttacttgagcttcagtttttcctgttaagtcgagatgatccgacttcagtggggtatcatgcgggtataaatgaaaacatctataggaggccagataaccatgtcagccacagttgtagatgcagttaatgctgcacccctatcggggtccaaagaaatgagtttggaagaaccaaagaagatgaccagagaggactggagaaagaagaaggagctagaagaacagcgaaaattgggcaatgctcctgcagaagttgatgaagaaggaaaagacatcaacccccatattcctcagtatatttcttcagtgccatggtatattgatccttcaaaaagacctactttaaaacaccagagaccacaaccagaaaaacaaaagcagttcagctcatctggagaatggta

SEQ ID NO: 182081 - DNA, 568 bp, Homo sapiens
  Payload ID: 15858
  Gene Symbol: SLU7
  Gene Name: SLU7 homolog, splicing factor
  ENST ID: ENST00000521826
  CDS Start-End: 138-568
tttcttgcaaactttgtggcacgttttctgggaagaaaaaactaggatcgtgtaatattaaaaaataaatcgagaggctttttttttttgctctccatattattaagctgcatggactgagaggaggccagataaccatgtcagccacagttgtagatgcagttaatgctgcacccctatcggggtccaaagaaatgagtttggaagaaccaaagaagatgaccagagaggactggagaaagaagaaggagctagaagaacagcgaaaattgggcaatgctcctgcagaagttgatgaagaaggaaaagacatcaacccccatattcctcagtatatttcttcagtgccatggtatattgatccttcaaaaagacctactttaaaacaccagagaccacaaccagaaaaacaaaagcagttcagctcatctggagaatggtacaagaggggtgtaaaagagaattccataattactaagtaccgcaaaggagcatgtgaaaattgtggggccatgacacacaaaaagaaagactgctttgagagacctaggcgagttggagccaaatt

SEQ ID NO: 182082 - DNA, 577 bp, Homo sapiens
  Payload ID: 15858
  Gene Symbol: SLU7
  Gene Name: SLU7 homolog, splicing factor
  ENST ID: ENST00000519349
  CDS Start-End: 206-577
attacgagattggcttggattctgtcggatggacttggggctagctgcggcggggctggatggtgctgtattgaatttttggacggtactgcattggaggattttaagcttgggcagtaggacattgtattaatctgttttcacattgccaatgaagacatagcccagacctgccaatttactaaagaaaggaggccagataaccatgtcagccacagttgtagatgcagttaatgctgcacccctatcggggtccaaagaaatgagtttggaagaaccaaagaagatgaccagagaggactggagaaagaagaaggagctagaagaacagcgaaaattgggcaatgctcctgcagaagttgatgaagaaggaaaagacatcaacccccatattcctcagtatatttcttcagtgccatggtatattgatccttcaaaaagacctactttaaaacaccagagaccacaaccagaaaaacaaaagcagttcagctcatctggagaatggtacaagaggggtgtaaaagagaattccataattactaagtaccgcaaaggagcatgtgaaaattgtggg

SEQ ID NO: 182083 - DNA, 1091 bp, Homo sapiens
  Payload ID: 15859
  Gene Symbol: SLX1A
  Gene Name: SLX1 homolog A, structure-specific endonuclease subunit
  Uniprot ID: Q9BQ83
  ENST ID: ENST00000251303
  CDS Start-End: 169-996
aggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctgggagatggtgctcgtcgtgcacggcttcccgtcctccgtggccgcccttcggtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggcacactggacagacctgctggagacctgatcctcagtgtccttaccccctcctacctcttttctgtgccacctgctgtgggtccagcaggtttttacttgagtacaataaaaagtctgagtcaa

SEQ ID NO: 182084 - DNA, 762 bp, Homo sapiens
  Payload ID: 15859
  Gene Symbol: SLX1A
  Gene Name: SLX1 homolog A, structure-specific endonuclease subunit
  Uniprot ID: Q9BQ83
  ENST ID: ENST00000345535
  CDS Start-End: 182-667
cccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctgggagatggtgctcgtcgtgcacggcttcccgtcctccgtggccgcccttcgggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggcacactggacagacctgctggagacctgatcctcagtgtccttaccccctcctacctcttttctgtgccacctgctgtgggtccagcaggtttttacttgagtacaataaaaagtctgagtcaa

SEQ ID NO: 182085 - DNA, 589 bp, Homo sapiens
  Payload ID: 15859
  Gene Symbol: SLX1A
  Gene Name: SLX1 homolog A, structure-specific endonuclease subunit
  ENST ID: ENST00000563995
  CDS Start-End: 137-382
ctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctgggagatggtgctcgtcgtgcacggcttcccgtcctccgtggccgcccttcggctgtgagaagtcactgctttggggagacctgatctggctgtgccagatggacactgagaaagaagtagaagactcagaattagaagaggcacactggacagacctgctggagacctgatcctcagtgtccttaccccctcctacctcttttctgtgccacctgctgtgggtccagcaggtttttacttgagtacaataaaaagtctgagtcaa

SEQ ID NO: 182086 - DNA, 1165 bp, Homo sapiens
  Payload ID: 15860
  Gene Symbol: SLX1B
  Gene Name: SLX1 homolog B, structure-specific endonuclease subunit
  Uniprot ID: Q9BQ83
  ENST ID: ENST00000330181
  CDS Start-End: 243-1070
gctgaatggtacgcgctcgccgactggacagcagtctggcttccgcggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctgggagatggtgctcgtcgtgcacggcttcccgtcctccgtggccgcccttcggtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggcacactggacagacctgctggagacctgatcctcagtgtccttaccccctcctacctcttttctgtgccacctgctgtgggtccagcaggtttttacttgagtacaataaaaagtctgagtcaa

SEQ ID NO: 182087 - DNA, 762 bp, Homo sapiens; identical to SEQ ID NO: 182084
  Payload ID: 15860
  Gene Symbol: SLX1B
  Gene Name: SLX1 homolog B, structure-specific endonuclease subunit
  Uniprot ID: Q9BQ83
  ENST ID: ENST00000351581
  CDS Start-End: 182-667

SEQ ID NO: 182088 - DNA, 400 bp, Homo sapiens
  Payload ID: 15860
  Gene Symbol: SLX1B
  Gene Name: SLX1 homolog B, structure-specific endonuclease subunit
  ENST ID: ENST00000567248
  CDS Start-End: 136-400
atctccgcggcggaactcagggaaggagctagctggggcgggggtgatgatccaggctgggttccagcatagggctcttggtgggcacgctggggtcgggtggaatgcaggagagagaggaggtgggacagggagatggtgctcgtcgtgcacggcttcccgtcctccgtggccgcccttcggtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggcct

SEQ ID NO: 182089 - DNA, 6062 bp, Homo sapiens
  Payload ID: 15861
  Gene Symbol: SLX4IP
  Gene Name: SLX4 interacting protein
  Uniprot ID: Q5VYV7
  ENST ID: ENST00000334534
  CDS Start-End: 181-1407
gcgaaagtgcttcccttaagcttctgaaggttggctgcagttccggctacctgtgtagtccgagtttccacagccaggtactactccgccagtgaccctggacagtaacaaaacatataaagcccgagcccaaaccccgccaccatcataggtctgtagttactgtggaatcaataagccatggcatctaagaaatttgctgttaaatgtgggaattttgctgtcctcgtggatcttcatatcttgccacaaggttcaaacaaagatacaagctggttttctgaacagaagaaagaggaagtctgtttactgttaaaagaaaccattgattcaagagttcaggagtacttggaagttcgcaaacagcacaggccatcaaatgcagaattcacaagatccaatcccttgtccttaaaaggttatggctttcaaatcacagcctatttcctcaagagagggatacgccttcgctgcatcaggagcacacagaatgctgaactctgtgtattccctgacagatttgtggtttgtgtcagtcagcttgcattcagtcgtgatcttttagcaagtcagaatgaagatttgacagaaagagttctccatggagtgtctgattactttgctgagtgtgcagagagttcacttcctcccagtgcaaagctccggagaaatgctctgaaagaaattgtgaaaagaactgaaacaaaaagcagtgtcacgagcaaatcgcagaccagaagagacactgtggaaacatctagtgactcagtgattgcagagatagcaaggaggaggaatgatggtcaggcttcctccagtcccccatcagaatccatgggacaagcaaaggattccataaaggcagctgagagccactgggggcttcctgttcaaaagctggaaaaagttaatcagacccagccagaagacactagtggccagcaaaaacctcatcctggggagcggttaaagacagggcttctaagcaggagccccgtctgtagctgtgagtcagcatcaccatgtccaaaacaaagtccacgagtggccaaaacccaacagaaacgcaggaactgcagctctgcggaagacttcgaccaccacgggagagtttctcttggaagtgatcgattagtcccgagagaaataatagtggaaaaaagcaaagctgtcagggttttgccagcttcagagttgtcagatccagggttacttttgaaacaagatttggcaaaaaccacgtctaaggaagagttgcatgttttggaaagtctctcctccagacatcttatgaaaaataacccagggcaggcacagcaaaccggcttagccacaaacactgaaagattatctacaattcagaacagcccaaccaagaaaagaaagaaatacgaaagaggccattaacaccgaagaggtttgtaccgttggagttgaggacatagtggccaaacctgtgacaagagagctgcgaatatagatgccgggattttaaaggaattaattagaatgactaatttaaataggaagtgtgttatctgtgttatggctatggtttgttttcaaagcatttcaaaccgggaggctatatgcttgttctaacagcgttgcttctttatcattgtattttatgactgtcttcagagaattagtaatgacaaagagccatccaccttgtcagggaggagactgtgcaaggactgcatgaagaaactgatcatgagccccttcttggcacatcactgtgcagaccacacaatggaccgtgcaaagacagtgctgccgtgctgcctttcagctccaggggtacaatccatccccctgctcctcagcctgagtaggagggcagtgaaagaacaagctagtggttcttagcgcgtggtcctgggaccagcttcgttgtctggaaatgtgctagaaatgtggttattgggccctgccccatgctgagtaactgcctttgggtgattctgaaacatgctcgcgtttgagaaccactggactaatagaacactccccagtgcttcctgcagcctggttgccatggcctccagctcaccagttggggccagatgtgcacatgcatcccctcggactccctcaaactcgtaaaacacttgggtttggtgtatgggtcactctcttccgggttctacagtatggcagccatggcacccatgaaggtgttactttcccttataattgttgaagtcgatgggcgattctgcccaaccttaggagaagacatcagagaggctcgttgttgcctgtagctcaagcatgtcccagtccctgctcttgcacccacctccaggattttggtttgggacagactataacctaacaggaactcagtgaccaggttccagtttcccagttggaaggcttcgcaggcagttcaaatttcaagatgggagccttccctttacaatgtcacccactgtctccagtgggcttgatgaaatgtcacatagtgaattgtagcaatgacttattttggatggacacccgctaaaagtttccaataaccgaatttcactctaaaagaggaaagaaacaatattcaaggtccattcattcaatacatcttttttttttttctgttcaacatggggtggtcctttgaaatggcacctcccctaagtaataaggaaaaccaagtatattccctaaagtgttgaagttagcagaaaaatcacccagaaaagcccaaaacaatgacaagagtacagaaacaggcatagtgtaggttcatgcttgagatggattagtggtttattccatcccgttctatcctttcccgtatctcctgtccccacttgttaagaccagtaagactcatgaagcagcagctatatttcatggcaccattttgggtcatgaaattccatcttggtcaccaagcctgactgtggtggtagatactgttactttaatgttccaaaccctgcctagaaacctgttcctgtcccatgatcccagcctcaccacccccacttgaaacagcccttcctactggtatcctgtcctcttccctcttggcttttttcctgctcccagcggaacccagtcaggggattctataggagaagagggagcccaacagaatactaacttcagtggagctgactctgcttatacaataggggtgggctgcacagagtggaaaccgagtacctggtagaatgtgcatttccatggcccactgtaggcgcctctcttagagcaaacagtattttaggtgtgctctttattgaacacaggaccacagtgtgtcactgaatcttcttaaacagaagcaattagaacgatttagatatagggagggcacaagtaataagtaacccaggggatagaccaagaagcagctctctggaagagtctggaattaaaaagacggctgtactagaacagtagccactgcctgctccagaactaggggggagatatttgagctggagccaccagagaacatttctattgagaagtttttatttgtttgttctgttggttttttgttatttctgttttcttctaatctttctctgaagtatcactctggtattgagaaatttttatttcattagctaacctgggcttggtggttaaggctagtacttgtacttagaatgattctctgtcaggaaaagtcttggctttagagtttgttatagttggggatataacaattactgtgatcgaagagaaaaaatagcacctttggttgtagatagatgtagttttcctcacagccctcacgtcccttcatgtaaaagggattttaacaggatttacagagggaatggctctcagttcccacactgtgacatgtgtttgaggaattttgcctttaagcatttttcttgcacatggctgaaacacccctggctctcttgttatttgagtggttgcatgattctttggatatttggaagtacaaaggggtaaatggatgccaggggttttttgttgttgttgcttattaggtaggatatgaagagttctcactgttgggaatggtatgtgttttgacattctttttttttttttttttttttttgagacagagtctcgctctgtcgcccaggctggagtgcagtggggcgatcttggctcactgcaagctccgcctcctgggttcacgtcattctcctgtctcagcctcctgagtagctgggactacagacgctcgccaccacgcccggctaattttttgtatttttttttttttttttttttttttagcagaaacgggttttcaccgtgttggccagggtggtctcgatctcctgactcgtgatccgcccgcctcggcctcccaaagtgctgggattacaggtgagagccaccgcacccggcctgttttgacattcttaatgatcttaataatttggcatctgaaagtctgaaacagtgtcagtattgttagtcaaaaagaacaagttcttcaaccacttgcgtagtaccccaaattatattcaagtccctgtgactccaatgcttggagaagtcattgatatgatttgattaatgttataactttgaatttcctaactttctcagcggcatagattctaagccacttccatgtgctttcagatggcatcttaatagattggtgttgaggttattttaatgtccataaacaagaaaggtctgggaacaatctgtatgatttttctttcacattttcttatctttgccactggaggttaactgtcgtccagatatgcatatgaattgtgaaatgcaaagaagcaaacatttgggggtaggggagtaagtgctgtagttcttttgttcacttattttaatactatagaagtgtatttcattttataaaaagcaagaatcataaaaaccctctgtattttgatttatgaagaatatagcttctctctgaagtatctcaagatatatcttggggaccacaatgggatcacagtgtaattgtttgctgttggtgtcatgtttggattttagcatggtttgttatgcatgtcagtggcctctgatttcagaaagagcttggcgagggcagaacacataagggaaggaaacctctgctcaagagagtggcctgggatcacagtgtcgtcattcccaatttccttgaattccttcttggcagaccttactgtaatattacacaaaactgtaatgagtggccctcctttggaggtaacagatgcctttcctaagaactcaaagttctcttttcagcgtgctgtgacttgaatatggaaatcattttaatttcttcttttctcttatggggaaatttccatgcttggtttgtcaagacaagagaattcattccttattattgaaacattaatgaactgaaacacgttgaagcaagtaaaaaatcaaaattaggttggtttatcttaaatagttaaaagccttccttagtacaaaataaattaagcattgtaaaacgaagttaattcaggtaattactcagtacagaaatctaaccgtatatatcattggtattgcaatttaagggtataattaaattctcagaaatctgcaggactcactctaatttgctttctatatttatttacaagacagggaacaaatatgtgtcaatgtgcagcttaacagaggggacttgaatggataaaattatctttaattatctagagctacccagtactgggcttgaatttaatcatagtcaaatgtttcctctggcagcataatattaccatacaccatattaccttataattgccattacagttccttatcaaaaatgttaattctttgcttgagcaaaaatcaataaaaccttatgtttgaccctaaagtatttgatcagggaacagaaggtgtgaattggacagatcccccgaataactttcttcaatcaagttgaaaaaccaaacagctatgtaagtccccaggagagctctttttcccttatcttctcatttgttttgttataaactgtttaaatagttcaaatggttgtgcatgcctaggggatgaaacctatgtaatagaaatgtactgttttatgaataaggagtaaaattgttttaaaaaattaa

SEQ ID NO: 182090 - DNA, 597 bp, Homo sapiens
  Payload ID: 15861
  Gene Symbol: SLX4IP
  Gene Name: SLX4 interacting protein
  ENST ID: ENST00000488816
  CDS Start-End: 1-236
gttatggctttcaaatcacagcctatttcctcaagagagggatacgccttcgctgcatcaggagcacacagaatgctgaactctgtgtattccctgacagatttgtggtttgtgtcagtcagcttgcattcagtcgtgatcttttagcaagtcagaatgaagatttggataaccagagcaccattgcctgcttccttcttcctgaaggaaggggaaaatccacccttcacaattaaagtcctggcactgagccacatccagaggaggctgatctatgccctcccaataccaggggtgtcccagacagaagcatctggcagctacccaaggaattctggggtcctgcagaatccaagtttacaaaccaccagaacaaggttttgcttcaggatagtgtttgactccactgctgcgaaatgactgtctcctggctagtaggatctagatttctccctccctttgaccccaccttgtggaaacccagctgtctactggcagacattggtgagaaagcggagctacgctagggcagggagatgtcatggaaacctcaactcttcgctgtccgggtccttcaggccacctccccaatgagcc

SEQ ID NO: 182091 - DNA, 7307 bp, Homo sapiens
  Payload ID: 15862
  Gene Symbol: SLX4
  Gene Name: SLX4 structure-specific endonuclease subunit
  Uniprot ID: Q8IY92
  ENST ID: ENST00000294008
  CDS Start-End: 642-6146
gcgagtctccgttaagaaggtgccgcggcggcgccggagatgtgtaattaagtgaaccatatatgtttcatcatcatggagatcttggagaattatctgagcaccaggttcatatgtattcgatctcagaggcatctattggacaacaaaacactctttcagttgtgaactttatttatttattattattattttttgagacagagttttgctcttgttgcccaggttagagtgcagtggcacgatctcggctcactgcaatctccgcctcccaggttcaagcgattctcttgcctctgcctcccgagtagctgggattacaggcatctgctaccacgcctggccaattttttgtattttcagttgaaacgaggtttcaccatattggccaggctggtctcgaacttctgacctcaggtgatccaccccccgcctcgtcctccaaaagagctgggattacaagtgtgagccaccgcgcccggcccagttgtggactttaacagagggaagctttaaacatgtttaaccacaggcccaatttgaacaaagatacttcaatcattatagagaggaaaacagtactttttgttcaattgtgcaaactctccaagtatctaatggagaagtagagaagaaccctaatgaaactgagtgtgaatgaggctcagctaggcttctacttgggttcactttctcatctgtctgcctgtcctgggattgaccctcgctcctctgaagaccagcctgaaagccttaaaactggtcagatgatggatgagtctgatgaggactttaaagaactctgcgctagctttttccaaagggtgaaaaaacatggaatcaaggaagtgtcaggagaaaggaagacacaaaaggctgcctcaaacggcactcagataagaagcaaattgaaaaggaccaaacaaactgctaccaagaccaaaacccttcaaggccctgcagagaagaaacctccgtctggcagccaggcccctaggactaaaaagcaaagggtaaccaaatggcaagcaagtgaaccggcccactctgtgaatggggaggggggtgtgcttgcctctgctccagatccacctgtgctccgggaaacagcacaaaacacccagacgggtaaccagcaagaaccatcgccaaacctttccagagagaaaaccagagagaatgtgcccaacagcgactcccagcctcctccttcctgtttgacaacagcagtgccaagtccctccaaaccccgcacagcacaattggtcctacagcgaatgcagcagttcaagagagcagaccccgagcgtttgagacacgcttcagaagagtgctccctcgaggctgcgcgggaagaaaatgtcccaaaggatcctcaagaggagatgatggcggggaatgtgtatgggcttgggccccctgccccagagagcgacgctgcggtggccttgaccctgcagcaggagtttgcacgggtaggagcatcggcacatgatgatagcctggaggaaaagggtttgttcttctgccagatttgtcaaaagaacctctcagccatgaacgtgacccgaagggaacagcatgtgaacaggtgcttggatgaagctgaaaagacactaagaccttctgtgcctcagatccctgagtgcccgatttgtgggaaaccgtttcttaccttaaagagcagaaccagtcacttgaagcagtgtgctgtgaagatggaggttggcccccagctcctgcttcaggctgtgcggctgcagacagcacagcctgagggtagcagcagcccacccatgttcagcttcagtgatcacagtagaggtctgaaacggagaggacccaccagcaagaaggagccacggaagaggcggaaggtggacgaggcaccgtccgaggacctgctggtggccatggctctgtcccggtcggagatggagccgggtgcggctgtaccagcgctcaggctggaaagtgccttttctgagaggataagaccagaagcagagaataaaagtcgcaagaagaaacccccggtatcccccccattgttgttagtccaggactctgaaaccacaggccgacagatagaggaccgtgtggccctgctcctctctgaggaagtggaattgtctagcacgccaccacttcctgccagcaggattttaaaggaagggtgggaaagagcgggccagtgtcctcctccacctgaacgcaagcagagctttctgtgggagggcagcgcactgactggggcctgggccatggaggacttctacacggccaggctggtccctcctctcgtgccccagcggcctgcccagggccttatgcaggagcccgtgccgcctctggtgccacctgagcactcagagctgagcgagcgaaggtcacccgctctccacggcacccccactgcaggctgtggctccaggggcccgtcgccttcggccagccagagggagcaccaggccctgcaggacctcgtggacctggcgagggagggactgagcgccagcccgtggcccggcagtgggggcctggctggctcggaagggactgcagggttggacgtggtgcccggcggccttcctctgactgggtttgtggtgccatcgcaggacaagcacccggacaggggcggccgcaccttgctctccctcgggctgctggttgctgactttggcgccatggtcaataacccacacctgagtgatgtccagtttcagacggacagcggggaggtgctttacgcccacaagttcgtgctttatgcccgatgcccgctcctcatccagtatgtgaacaatgaaggcttctccgctgtagaggacggggttctgacccagcgtgtcctgctgggtgacgtgagcaccgaggccgcccgcacgttcctgcactatctctacactgcggacactggccttcctcctggccttagctctgagctgagctccctggcccacaggtttggcgtgagtgagctcgttcacctgtgcgaacaggtgcctattgccactgactcagagggcaaaccatgggaggagaaggaagcagagaattgcgaaagcagggccgagaatttccaggaactcttgaggtcaatgtgggcagatgaagaggaggaagcggagactttgttgaaatccaaggaccacgaagaagatcaagaaaacgtgaatgaagcagaaatggaagaaatttatgaatttgcagctactcagcgaaagcttctccaggaagaaagggcagcgggtgccggcgaggacgctgactggctggagggtggcagtccggtttctgggcaactcctagcaggtgtccaggtgcagaaacagtgggacaaggtggaggagatggagccgttggagccaggaagagatgaggccgccaccacctgggagaagatgggacagtgcgctctcccgccaccccagggccagcactcaggggcacggggagcagaggcccctgagcaggaggcgccagaggaggcgcttggccattccagctgctccagcccttccagggactgccaggcagagagaaaagaaggctctcttccgcactcagatgatgccggggattacgaacagctcttctcatcaactcagggagagatctcagagccgtcccaaataacaagtgagcccgaggaacaaagtggcgctgtcagggaaagggggctggaggtttctcatcgcctggctccctggcaggcatctccaccgcacccgtgccgcttcctattggggcctccccagggcgggagtccccgcgggtctcatcacacaagtgggtcgtccctgtcaacaccccggtcccgtggcggaacttcccaggtgggctccccaaccttgctgtctccagctgtgccatcaaagcagaaaagggacaggagcatcctcacgctgtctaaagagccagggcaccagaaaggcaaagagcgtcggtccgtgctggagtgcagaaataagggggtcctgatgttcccagaaaaatctccgtctattgacctaacccagtcaaatcctgaccattcgagctccagatctcagaaatcttcatccaaactgaacgaagaagatgaggtcatcctcttactggactcggatgaggagctggagctagaacaaaccaaaatgaagtccatttctagtgatcctctggaagaaaagaaagctctagaaattagccctaggtcctgtgagctgttttccatcattgatgttgatgcagatcaggaaccttcccagagcccaccaagaagcgaagctgtgctgcagcaggaggatgagggggcgctgccggagaatcggggctctttgggcaggagaggggctccctggctgttctgtgaccgtgagagcagccccagcgaggccagcaccacagacacctcgtggctggtgcccgccaccccgctggccagcagaagccgtgactgttcttcccagacccaaatcagcagcctcaggagcgggctggccgtgcaggcggtgactcagcacacgcccagggcctcagtaggaaacagggaagggaacgaagtcgcacagaagttttctgtcatcaggccccagacaccaccgccccagacaccgtcctcatgcctcactcccgtctctccaggaacttctgacggcagaaggcaaggccacagaagcccttcccgtccccaccccgggggccacccgcactcctctccgctggctccacatcccatctcaggggaccgcgcccacttcagcaggcggttcctgaaacactcgccgcctgggccaagcttcctgaaccagaccccagcgggtgaagtggtggaagtcggagacagtgacgatgagcaggaggtggcctcccatcaggccaacagaagccccccactggacagtgaccccccaattccaattgacgactgctgctggcacatggagcccctctcgccaattcccattgaccactggaacctggagcggaccggccccctgagcaccagcagccccagccgcaggatgaacgaggccgccgacagccgtgactgtcgctccccgggactcctggacaccacccccatccgaggaagctgcactacccagaggaaattgcaagagaagtcctcgggcgcgggctccctggggaatagcaggccgagctttctgaattcggctctgtgggacgtttgggacggggaagagcagaggcctccagagacccctcctccggcccagatgccaagcgctggtggagctcagaagcccgaagggttagagacacccaaaggtgctaatcggaagaagaacttgccccccaaagtgcccataacgccgatgccacagtattccattatggagacgccggtgctgaagaaggaactggataggtttggagtccgccctctgcctaaacgccagatggttctgaagctgaaggagatattccagtacactcaccagaccctggactcagactccgaggacgagagccagtcctcacagccgctgttgcaggcgcctcactgccagaccctcgcctcccagacctacaagccttcaagggcaggggtccatgcccagcaggaggccaccacaggacctggggcccataggcccaagggacctgctaagaccaagggcccccgacatcaaaggaagcatcatgaaagcatcacacccccaagcaggtcgcccaccaaggaggcacctccaggcctcaatgatgacgcccagatcccagcctctcaagaatccgtggccacctctgtggatggcagtgacagctccttgagctcacagagttcttcctcctgtgagtttggagcggcatttgagtctgcaggtgaagaggagggcgagggggaggtcagtgcctcgcaggcagccgtgcaggcggcggacacagacgaggcgctgaggtgctacatccgctccaagccggccctgtaccagaaggtgctgctgtaccagccctttgagctgcgggagctgcaggcagagctgaggcagaacggcctccgtgtgtcctcgcgcaggctgttggacttcctggacacccactgtatcaccttcaccactgccgccacccgcagggagaagctccagggcaggaggcggcagcctcggggcaagaagaaggtggagcggaactgatggggccatcccgaccccaccccaacctgccatcagcagcccccacccccgccatttgcagggaggacctgggacacccagcgtgggtcaggcctccacaggcatttctgggcctggggaccacatcagctctgcgctgtgatgatgaccacagcccaatccagggcttcctcctctgggctctgctttctagggtggcatttggagcatgtcacccactggatttacagactccagccccttcctctgtccgtgctcacagtgtgtctccctttttggttttctttttttttttctttttgagacagtcgtgctgtgtcacctaggctggagtgcagtggcacaatctcggctcactgcaacctccgcctcccgggttcaagcaattctcctgcctcagcctcccagatagctgggactacaggcacacgctgccacgcccagctgattttttatattttagtagaaacggggtttcaccatgttgctcaggctggtcacaaactccagagctcaggcaatccgcctgctgcggcctcccaaagtgctgggatcacaggcgccagccactgcgcccggcccagtgtgtctcccttaacccaagagggccctcagctgtcccagggggcagtgggccatcaccagctggccagggcatggcctattctgccacatttgccaccctctgagcccaccagtcctgggcacagctgccctacatgtctgtcctgagatggacgtcaggtccagcctgccccggcagcccgggcccgtcctcctcagcactcaggccaaccccagccaccgccagcctgagaccaggtgtcctgaggctccctgcactgccacagcccagatgcagttctcctgacccagccgtgctacccggacacttgtcattgttaccagcagtctccaaactggacagtgcacaagggcccagaacaactctgatgccaccacaaaacaaacatgttcactagcggattccattctttgggttaaagctgcctccagcctcaggagcagtgtggaggaagatgagggccaggaaagaaggaaaccttggtttctccatccttgtgaatgtcctcgtctgtttcaaatacagtgcagtcagttttatatgatgtgcaataaaccaaaaaggctttattaaaa

SEQ ID NO: 182092 - DNA, 1966 bp, Homo sapiens
  Payload ID: 15863
  Gene Symbol: SMAD1
  Gene Name: SMAD family member 1
  Uniprot ID: Q15797
  ENST ID: ENST00000302085
  CDS Start-End: 424-1821
gggtattggcagctgaggagtggaggctgggcagctccgactccctgacgccagcgcgaccagatcaatccaggctccaggagaaagcaggcgggcgggcggagaaaggagaggccgagcggctcaacccgggccgaggctcggggagcggagagtggcgcagcgcccggccgtccggacccgggccgcgagaccccgctcgcccggccactcgtgctcccacacggacgggcgcgccgccaacccggtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaac

SEQ ID NO: 182093 - DNA, 1658 bp, Homo sapiens
  Payload ID: 15863
  Gene Symbol: SMAD1
  Gene Name: SMAD family member 1
  Uniprot ID: Q15797
  ENST ID: ENST00000394092
  CDS Start-End: 241-1638
cactgcatgtgtattcgtgagttcgcggttgaacaactgttcctttactctgctccctgtctttgtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcct

SEQ ID NO: 182094 - DNA, 421 bp, Homo sapiens
  Payload ID: 15863
  Gene Symbol: SMAD1
  Gene Name: SMAD family member 1
  ENST ID: ENST00000507367
  CDS Start-End: 392-421
gagtcgattgcctcactgcatgtgtattcgtgagttcgcggttgaacaactgttcctttactctgctccctgtctttgatcttggccccctcaagtcctgagtgccttggttcctctttgatgcctttaaaaagctgggcttttgtttgtttgttttctggcttgtttgtttggaaggaggttggtctgatacgtgctactccagtttagccagggtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttaca

SEQ ID NO: 182095 - DNA, 573 bp, Homo sapiens
  Payload ID: 15863
  Gene Symbol: SMAD1
  Gene Name: SMAD family member 1
  ENST ID: ENST00000503324
  CDS Start-End: 399-573
attgtgtcccccgcgccggcggggcgacccctgcgggagctggaggacgaccgctggcgctgctctccaaggcgcctggtggagcgggtctcgcgggcgggggaccccggcgccccgggcccctccacatcccgcacgggttttcttctcggccccagcaagcctctttggggtcgaggtcaaggaaagttcgcaccgagatcccctctaatttattcaaaggtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccag

SEQ ID NO: 182096 - DNA, 558 bp, Homo sapiens
  Payload ID: 15863
  Gene Symbol: SMAD1
  Gene Name: SMAD family member 1
  ENST ID: ENST00000507594
  CDS Start-End: 272-558
caattctgggtacgtacaacttctggggcctgcaaattattggagagtgagtgaggggcaacgaaagatagacataaaagggcgcgtctcgaaaggtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccga

SEQ ID NO: 182097 - DNA, 616 bp, Homo sapiens
  Payload ID: 15863
  Gene Symbol: SMAD1
  Gene Name: SMAD family member 1
  ENST ID: ENST00000514778
  CDS Start-End: 298-616
attatttggagcaacaaggttacctactcgaatcactggatcctgagttgacacaaaacgcatctgttgactcagggtttgtataaccacgtgcagtatttactaggctatccaattctgggtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactgg

SEQ ID NO: 182098 - DNA, 569 bp, Homo sapiens
  Payload ID: 15863
  Gene Symbol: SMAD1
  Gene Name: SMAD family member 1
  ENST ID: ENST00000514831
  CDS Start-End: 232-569
aatttggagaggatccctggtcgcgcggcagcggcggcggcgcgcgggtgagcgggtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttt

SEQ ID NO: 182099 - DNA, 2085 bp, Homo sapiens
  Payload ID: 15863
  Gene Symbol: SMAD1
  Gene Name: SMAD family member 1
  Uniprot ID: Q15797
  ENST ID: ENST00000515385
  CDS Start-End: 543-1940
atgtgtattcgtgagttcgcggttgaacaactgttcctttactctgctccctgtctttgttagtgtttctcggggttgtttctgtaggaaggtgggggtggtgggcgtgagagacagatgtgggcttgtttttctagttgctgaaactgtatgaaggctttaaagggagaacgttttcttgatgtgctttaggaggggaggaggaacaaatgcctgccagatctcacagctacagtagctgagcttttgtttattttgaagagcatgcaatttttaaatacacggtgcaagataaccagtaaaggcgcgttccttctgaaaattgaggccggtctcagaaccatctcctgagaaagcatccttttcgtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaac

SEQ ID NO: 182100 - DNA, 847 bp, Homo sapiens
  Payload ID: 15863
  Gene Symbol: SMAD1
  Gene Name: SMAD family member 1
  ENST ID: ENST00000512019
  CDS Start-End: 448-847
ggagaaagcaggcgggcgggcggagaaaggagaggccgagcggctcaacccgggccgaggctcggggagcggagagtggcgcagcgcccggccgtccggacccgggccgcgagaccccgctcgcccggccactcgtgctcccacacggacgggcgcgccgccaacccgcatgcaatttttaaatacacggtgcaagataaccagtaaaggcgcgttccttctgaaaattgaggccggtctcagaaccatctcctgagaaagcatccttttcgtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctg

SEQ ID NO: 182101 - DNA, 32767 bp, Homo sapiens
  Payload ID: 15864
  Gene Symbol: SMAD2
  Gene Name: SMAD family member 2
  Uniprot ID: Q15796
  ENST ID: ENST00000262160
  CDS Start-End: 253-1656
ccgcgcgcccgggccgccggccgggcccgggcctgggggcggggcgggaagacggcggccgggagtgttttcagttccgcctccaatcgcccattcccctcttcccctcccagccccctccatcccatcggaagaggaaggaacaaaaggtcccggaccccccggatctgacggggcgggacctggcgccaccttgcaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaagcacttgctctgaaatttggggactgagtacaccaaatacgatagatcagtgggatacaacaggcctttacagcttctctgaacaaaccaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatattccagaaacgccacctcctggatatatcagtgaagatggagaaacaagtgaccaacagttgaatcaaagtatggacacaggctctccagcagaactatctcctactactctttcccctgttaatcatagcttggatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccgaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtacctaatctgttattcccacttctctgttatttttgtgtgtcttttttaatatataatatatatcaagattttcaaattatttagaagcagattttcctgtagaaaaactaatttttctgccttttaccaaaaataaactcttgggggaagaaaagtggattaacttttgaaatccttgaccttaatgtgttcagtggggcttaaacagtcattctttttgtggttttttgtttttttttgtttttttttttaactgctaaatcttattataaggaaaccatactgaaaacctttccaagcctcttttttccattcccatttttgtcctcataatcaaaacagcataacatgacatcatcaccagtaatagttgcattgatactgctggcaccagttaattctgggatacagtaagaattcatatggagaaagtccctttgtcttatgcccaaatttcaacaggaataattggcttgtataatctagcagtctgttgatttatccttccacctcataaaaaatgcataggtggcagtataattattttcagggatatgctagaattacttccacatatttatccctttttaaaaaagctaatctataaataccgtttttccaaaggtattttacaatatttcaacagcagaccttctgctcttcgagtagtttgatttggtttagtaaccagattgcattatgaaatgggccttttgtaaatgtaattgtttctgcaaaatacctagaaaagtgatgctgaggtaggatcagcagatatgggccatctgtttttaaagtatgttgtattcagtttataaattgattgttattctacacataattatgaattcagaattttaaaaattgggggaaaagccatttatttagcaagttttttagcttataagttacctgcagtctgagctgttcttaactgatcctggttttgtgattgacaatatttcatgctctgtagtgagaggagatttccgaaactctgttgctagttcattctgcagcaaataattattatgtctgatgttgactcattgcagtttaaacatttcttcttgtttgcatcttagtagaaatggaaaataaccactcctggtcgtcttttcataaattttcatatttttgaagctgtctttggtacttgttctttgaaatcatatccacctgtctctataggtatcattttcaatactttcaacatttggtggttttctattgggtactccccattttcctatatttgtgtgtatatgtatgtgttcatgtaaatttggtatagtaattttttattcattcaacaaatatttattgttcacctgtttgtaccaggaacttttcttagtctttgggtaaaggtgaacaagacaactacagttcctgcctttgctgagacagcagttacactaacccttaattatcttacttgtctatgaaggagataaacagggtactgtactggagaataacagatgggatgcttcaggtaggacatcaaggaaagcctctaaggaaaggatgcatgagctaacacctgacattaaagaagcaagccaagtgaggagccaggggagataagcattcctggcaaagagaatagcatcaaatgcaaaaaggttcacactaaaggaaactcctgattaggtattaatgctttatacagaaacctctatacaaatccaaacttgaagatcagaatggttctacagttcataacattttgaaggtggccttattttgtgatagtctgcttcatgtgattctcactaacatatctccttcctcaacctttgctgtaaaaatttcatttgcaccacatcagtactacttaatttaacaagcttttgttgtgtaagctctcactgttttagtgccctgctgcttgcttccagactttgtgctgtccagtaattatgtcttccactacccatcttgtgagcagagtaaatgtcctaggtaataccactatcaggcctgtaggagatactcagtggagcctctgcccttctttttcttacttgagaacttgtaatggtgttagggaacagttgtaggggcagaaaacaactctgaaagtggtagaaggtcctgatcttggtggttactcttgcattactgtgttaggtcaagcagtgcctactatgctgtttcagtagtggagcgcatctctacagttctgatgcgatttttctgtacagtatgaaattgggactcaactctttgaaaacacctattgagcagttatacctgttgagcagtttacttcctggttgtaattacatttgtgtgaatgtgtttgatgctttttaacgagatgatgttttttgtattttatctactgtggcctgattttttttttgttttctgcccctccccccatttataggtgtggttttcatttttctaagtgatagaatcccctctttgttgaatttttgtctttatttaaattagcaacattacttaggatttattcttcacaatactgttaattttctaggaatgatgacctgagaaccgaatggccatgctttctatcacatttctaagatgagtaatattttttccagtaggttccacagagacaccttgggggctggcttaggggaggctgttggagttctcactgacttagtggcatatttattctgtactgaagaactgcatggggtttcttttggaaagagtttcattgctttaaaaagaagctcagaaagtctttataaccactggtcaacgattagaaaaatataactggatttaggcctaccttctggaataccgctgattgtgctctttttatcctactttaaagaagctttcatgattagatttgagctatatcagttataccgattataccttataatacacattcagttagtaaacatttattgatgcctgttgtttgcccagccactgtgatggatattgaataataaaaagatgactaggacggggccctgacccttgagctgtgcttggtcttgtagaggttgtgttttttttcctcaggacctgtcactttggcagaaggaaatctgcctaatttttcttgaaagctaaattttctttgtaagtttttacaaattgtttaatacctagttgtattttttaccttaagccacattgagttttgcttgatttgtctgtcttttaaacactgtcaaatgctttcccttttgttaaaattattttaatttcactttttttgtgcccttgtcaatttaagactaagactttgaaggtaaaacaaacaaacaaacatcagtcttagtctcttgctagttgaaatcaaataaaagaaaatatatacccagttggtttctctacctcttaaaagcttcccatatatacctttaagatccttctcttttttctttaactactaaataggttcagcatttattcagtgttagataccctcttcgtctgagggtggcgtaggtttatgttgggatataaagtaacacaagacaatcttcactgtacataaaatatgtcttcatgtacagtctttactttaaaagctgaacattccaatttgcgccttccctcccaagcccctgcccaccaagtatctctttagatatctagtctgtggacatgaacaatgaatacttttttcttactctgatcgaaggcattgatacttagacatatcaaacatttcttcctttcatatgctttactttgctaaatctattatattcattgcctgaattttattcttcctttctacctgacaacacacatccaggtggtacttgctggttatcctctttcttgttagccttgttttttgttttttttttttttttttgagagggagtctcgctctgttgcccaacctggagtgcagtggtgcgatcttggttcactgcaagctccgcctcccgggttcacgccatgcttctgcctcagcctcccaagtagctgggactacaggcgcccaccaccacactcggctaattttttgtatttttagtagagacggggtttcaccgtgttggccaggatggtctcgatctcctgacctcgtgatctgtccacctcggcttcccaaagtgctgggattacaggcatgagccaccgcgcccagcctagccatatttttatctgcatatatcagaatgtttctctcctttgaacttattaacaaaaaaggaacatgcttttcatacctagagtcctaatttcttcatcatgaaggttgctattcaaattgatcaatcattttaattttacaaatggctcaaaaattctgttcagtaaatgtctttgtgactggcaaatggcataaattatgtttaagattatgaacttttctgacagttgcagccaatgttttccctacgataccagatttccatcttggggcatattggattgttgtatttaagacagtcagaataatgatagtgtgtggtctccagaggtagtcagaatcctgctattgagttctttttatatcttccttttcaattttttattaccattttgtttgtttagactacactttgtagggattgaggggcaaattatctcttggagtggaattcctgtgttttgagccttacaaccaggaaatatgagctatactagatagcctcatgatagcatttacgataagaacttatctcgtgtgttcatgtaattttttgagtaggaactgttttatcttgaatattgtagctaactatatatagcagaactgcctcagtctttttaagaaggaaataaataatatatgtgtatgaatttatatatacatatacactcatagacaaacttaacagttggggtcattctaacagttaaaacaattgttccattgtttaaatctcagatcctggtaaaatgttcttaatttgtctgtgtacattttcctttcatggacagaccattggagtacattaattttcttaatctgccatttggcagttcatttaatataccattttttggcaacttggtaactaagaatcacagccaaaatttgttaacatcaaagaaagctctgccatataccccgttactaaattattatacatccagcagattctgggatgtactaacttagggttaactttgttgttgttgataatactagattgctccctctttaattcttcttctggtgcaaggttgctgcttaagttaccctgggaaatactactacaaggtcaaattttctagtatcttacagcctgattgaaggtgattcagatctttgctcaatataaatggattttccaagattctctgggccatccttgacccacaggtgatctcgctggagtatattaacttaacttcagtgccagttggtttggtgccatgagatccataatgaatccagaacttcaccattgcttagatataagagtcccttggaagaataatgccactgatgatgggggtcagaaggtgtattaactcaacatagagggcttttagatttttcttcaaaaaaatttcgagaaaagtattcttttaccctccaaacagttaacagctcttagtttctccaaatatgctctttgatttacttatttttaattaaagatggtaatttattgaacaatgaaatccgtaatatattgatttaaggacaaaagtgaagttttagaattataaaagtacttaaatattatatattttccatttcataattgttttcctttctctgtggctttaaagtttttgactattttacaatgttaatcactaggtaacttgccatatttctggttctatattaagttctatcctttataatgctgttattataaagctggtttttagcatttgtctgtagcaatagaaattttactaagtctctgttctcccagtaagttttttcttttctcagtaagtccctaagaaaacatttgtttgccactcttactattcccaatcttggattgttcgagctgaaaaaaaatttgatgagaaacaggaggatccttttctggtgaatataggttcctgctttaagaatgtggaaatccattgctttatataactaatatacacacagattaattaaaattgtgagaaataattcacacatgacaagtaggtaacatgcatgagttttgaatttttttaaaaacccaactgtttgacaaaatatagaacccaaattggtactttcttagaccagtgtaacctcacacctcagttttgcttttccaaccctgacttgaaaggcatatttgtatctttttattagtgatagtgaagctgtgacactaaccttttatacaaaagagtaaagaaagaaaaactacagcgattaagatgagaacagttctgcagttgttgaactagatcacagcattgtaggcagaataaaaaatgttcatatctgagaatattcctttcgccatcttttcccaaggccagacctcctggtggagcacagttaaaagtaacattctgggcctttgtaatcggagggctgtgtctccagctggcagcctttgttttaatatataatgcaggactgtggaaaacagttggcatagaatattttcacctaaaaaagaaagaaaagacatacaaaactggattaattgcaaaaagagaatacagtaaaataccatataactggacaaagctagaagaacctttagaagatttgtctgaaaacagatttcaagagtgagcttttatacactgctcactaatttgcttgattactaccaactcttcttaaagttaacacgtttaaggtatttctggacttcctagccttttagcaagcttagaggaactagccattagctagtgatgtaaaaatattttggggactgatgcccttaaaggttatgcccttgaaagttcttaccttttctctagtgatattaaggaacgagtgggtagtgttctcagggtgaccagctgccctaaagtgcctgggattgagggtttccctggatgcgggactttccctggatacaaaacttttagcagagttttgtatatatgtggatttttctgataagtagcacatcagaggccttaaccactgcccaaaagcgattctccattgagagtacatatcttgaacttaagaaattcatttgctctgatttttaatcttgtaaagtttttgctaaactcaaaacaagtcccaggcacaccagaaggagctgaccaccttaggtgttcttgtgatttatccttacttccctatgttgtcatagttgcttctaaactcagctgcactatggctgtcaacatttctgatacttattgggatatgtgccatccagtcatttagtactttgaatggaacatgagatttataacacaggtaatagctgaaggtaccagtatggtggtgagactcacacttagtgatccagctaaggtaactgatgttataatggaacagagaagaggccaactagatagctaagttcttctgaacctatgtgtatatgtaagtacaaatcatgcgtccttatggggttaaacttaatctgaaatttacatttttcatagtaaaaggaaaccaattgttgcagatttcttttcttgtgaggaaatacatggcctttgatgctctggcgtctactgcatttcccagtctgttctgctcgagaagccagaatgtgttgttaacatttttccgtgaatgttgtgttaaaatgattaaatgcatcagccaatggcaagtgaaggaattgggtgtcctgatgcagactgagcagtttctctcaattgtagcctcatactcataaggtgcttaccagctagaacattgagcacgtgaggtgagattttttttctctgatggcattaactttgtaatgcaatatgatggatgcagaccctgttcttgtttccctctggaagtccttagtggctgcatccttggtgcactgtgatggagatattaaatgtgttctttgtgagctttcgttctatgattgtcaaaagtacgatgtggttccttttttatttttattaaacaatgagctgaggctttattacagctggttttcaagttaaaattgttgaatactgatgtctttctcccacctacaccaaatattttagtctatttaaagtacaaaaaaagttctgcttaagaaaacattgcttacatgtcctgtgatttctggtcaatttttatatatatttgtgtgcatcatctgtatgtgctttcactttttaccttgtttgctcttacctgtgttaacagccctgtcaccgttgaaaggtggacagttttcctagcattaaaagaaagccatttgagttgtttaccatgttactatgggactaatttttaattgttttaatttttatttaaactgatctttttttatatgggattacattttggtgttcactccctaaattatatggaaaccaaaaaaagtgattgtatttcacatatggacatatgattttaagagtacatgtttttgtttttttaatttggtgttacataaaagattatcctatccccccgggagataaatttatactacttaatataaccccacaacaggcgcacaccacacactgcacagtgctatttatacatttttatttatttcagagtttgcctatgctacattagcgctctaatacataagatctatgctgtaaacaaaaacatcttcaaagttgaaatttgctgaaatatacttttaacaaaataacatttttaaggctccattgaaaaatactagataagatataatctcatataatcagtatgaataattttaaaaatgagaaatatttaggtcagccacacttcctttgtgccttgcaagaattcagttctgtggatgaatcagtactggttagcagactgttttctgcaaaccattttaaacatgctttagtatgcaacaaaaagggacctcaaatgctaaaatacactattttacgtggcattgaatagccttgggactggtgtagttttatcaacacttttttattaggaagaaacccaagaaaatttactgtaattgctaccacctgccactgtataaataatctaaaagggacttcccaacattgaacaacaacattgagggctgactcgagatccttctacattgtcacctcagcctggctttgcctgtcactgcttagcttgaagtagtgacactgttctgtatcaggagatttttataatggccctagcatccataattccacatgttcatcaaatggctgaagagtatgagagaagtattaaggtctatgtttgggctgtctccccacttggcatattctgtttttccctcttcaaaatagattgaaagcctcttagtgcaggaagcaggcatcagtatcaaactgatgtcatccaatgtaattattttaagctccaggtttgtctaagtttgggtgaagaatgttcaggaacatgtttgcaacatacagttatccagcttaccctttgacagattcacccttctcatcaaaatagtaagcccaacctaaaaattataagtttacaaataaaggaatagaaaaacccaaaaagctaatttacacataaaaattatcttttgctgcaataaataggtatggaaatatttgtagaattggtttaactgattttgtaaaacaaatgtcatgctattttgccatagtgagacatgcagtaattcttaaaatcacattaatagaaggcaagaacattgaatcagacttagcagataacagattcagtgataaatgaacaatagactaagcatacttaggaagctacatgagaacagaatgtattactgtgctcccgtccaaactgcatgactttattggttatagaataaatggaatttgagatggggatttgccagtttttacagtctgtcttcaatagttttgttggctgcctctgcacctttctaaatgttatgtgaaaataaaattatttaagttctaaagtagtttaggaaagagatgtgatgacaggaaaaagaagttaacttctgaacagtttggtccaggaagaagatgggcagaatacagtaagcccagggttgaagaatacattcaatttggagagatggagaagacctttgaagaaggtcaaaatgagatcttggaacagaactctcacctgtgtgtctggatatacatgaaaactggacggtgttattgagctactgcttatatggtgagcagaaaattgataaccacaagcctggtaggttctgctatgaagcccacatataatcacaaggcctagatagcttggagttaaaagccaaggatagctgtatagtttgggttccatagtttgcagtgagattgtgcttctgagcagtcatttgggggcagtggttctgagattacaagccataacccagccaagaacgggctacctgtggaatgaggatgaggaagttgctacatataaaccctagtgtgtgtgtgtgtattaagtgaaacttagttaacttttttgctcacagccaaagatgattcatctagagaagccattggaattttagcagagttttgtatatatgtggatttttctaataagtagcaaatcagaggccttaaccactgcccaacagcgattctccattgagagtacgtatcttgaacttaagaaattcatttgctctgattttaaatcttgtaaagtttttcttcatgagaggtcttgcctctaaactatattgtggcagtatttgatcaaactacataagtaccatgtaaataagattttaatacaaatgatgactcacttctaaatggtttgccatttagaaatgtgctgctgtgagaaaaacgaattttttttttttttttttggagacagagtcttgctctgttgcccaggctggggtgcagtggggcgatctcggctcactgcagcctcgcctcctgggttcaagtgattctcctgccttagcctcctgagtagctgggattacaggcacacaccaccacgcccaactactttttgtatttttagtggagacagggtttcaccatgtttgccaggctggtcttgaactcctgacctcagatgatttgcctgcctcggcctcccaaagtgctggaattacaggcgtgagccatcatgcctggctgaaaagtgaaaatttaagccagcttaccacctggaataaaaatgttttataggaatgtctaggttgctcttttatattgaaaaaaaacttattagtgtctgttttacccaagaaccacaagctacttcatttcaacttttaaatcatgaataataacgtgttatcaccacatttaaaaatgtacatcgtcaatcacaaacacatattctaaggaattgaattttatagagataattgaatgctttcatctgtaaaagaattagtggcctgcaaaccactgtggattcttgctatgctttgaagttgtcagtgggggaatttgctgctgcaagttacttagacttgtaggcaaagggaaattcaaatttttaattctaaaatgaaaaccactgacaaaattttatactctgaaagtttggttgttagcttagtcattattttcctgttctttatcatttcggaattcagatgcttaaatttaacatacaaattatttgttggtaaaacataaaacataaaaagctacatttggtaaactaaattttaggattcaaagtctctaacaatttctatgtgacatgtcatacggtgcagtttttatttgccaaagtgtctacttcatactgcctatgcactgcttcccgtttttaatctctctaccccaacccccctataattaaataaacccctagaaaactgccttcttttagaatacctaattgattactttaaatattttttcagaatcaaaattacaaaagggagagatacctaagaatctggcttgtttatattctttaaaagatcgcatttgattgaaggtgggtgcatattttttatatccactctttccccatttgtatgtgaccattgtaaaagtggatgtgcttttttttttttgctgaggtctagagacaatgttttagagatacagaatgaaacatttatgggtaaaatacaatgggtaagacttgcttcaaaatagtatgtgacagaggaagtagatggaggtatgaatgaataggacattgatggttgtttgttgggattgggtaagggagctttgttgtattctatttccttttagataagtttgaaattccttgtagtgaagaaattaaacgtctccatcaggtgcattgccacgtcttctctaggaagcctccttaacatcctctggtggctcctgaactttttctgttctcattcacagggaagctcatggggctgcctggagacttgaggttacatcttgcctagtattaccaaaattgtgatacttttctccaccccataatagcacagtctttggtctcaacttgaactaaagtctttttttttttttttttttttttttttagtatttattgatcattcttgggtgtttctcggagagggggatgtggcagggtcataggacaatagtggagggaaggtcagcagataaacatgtgaacaagggtctctggttttcctaggcagaggaccctgcggccttctgcagtgtttgtgtccctgggtacttgagattaaggagtggtgatgactcttaacgagcatgctgccttcaagcatctgtttaacaaagcacatcttgcaccgcccttaatccatttaaccctgagtggacacagcacatgtttcagagagcacggggttgggggtaaggttatagattaacagcatcccaaggcagaagaatttttcctagtacagaacaaaatggagtctcctatgtctacttctttctacacagacacagcaacaatctgatctctctttcctttccccacatttcccccttttctattcgacaaaaccgccatcgtcatcatggcccgctctcaatgagctgttgggtacacctcccagacagggtggcggccgggcagaggggctcctcacttcccagacggggcggctgggcagaggcgcccccccacctcccggacggggtggatgctggccgggggctgccccccacctcccgaacggggcagctggccgggcgggggttgccccccacctcccggacggggcggctggccgagcaggggctgccccccacctccctcccagacggggcggctgctgggcggagacgctccttacttcccggacggggtggttgctgggcggaggggctcctcacttctcagacggggcggccgggcagagacgctcctcacctcccagacggggtggcggtcgggcagagacactcctcacatcccagacggggcggcggggcagaggcgctccccacatctcagacgatgggcggccgggaagaggcgctcctcacttcccagactgggcggccgggctgaggggctcctcacatcccagacgatgggcagccaggcagagatgctcctcacttcccagacggggtggcggccgggcagaggctgcaatctccgcactttgggaggccaaggcaggcggctgggaggtggaggttgtagcgagccgagatcgtgccactgcactccagcctgggcaacattgagcactgagtgagcgagactccatctgcaatcccagcacctcgggaggcccaggcgggcagatcatgcgcggtcaggagctggagaccagcctggccaacacggcgaaaccccgtctccaccaaaaaatacaaaaaccagtcaggcgtggcggcgcgcgtctgcaatcccaggcactcggcaggctgaggcaggagaatcaggcagggaggttgcagtgagccgagatggcggcagtacagtccagccttggctcggcatcagagggagacggtggaaagtgggagaccgtagaaagtgggagacggggggagacgggagagggagagggatgtgctttttttctaaccgttattgccaccaagtaataatgtcttaattcacaatttacatagtgattggctggagagaggtattgagcataaatttttttttaagattcaactgggaaatggatgatttacatgattttagtctctttagttgtctgggtatttcttgactgggaatagcaatatcttaaaggccatttttaacaagaatgctaaggatggaacacttgaaggaagcagtcctgtacagtcaaatacttcagttaccttggataatagaatgaaaactcaattgcctactttgaacaaattttttttttggattttaatggctggacagaataacattctgctaattttaatccttggtcatttccgatgtaatggaaaatgcagtttgactcagaatcggaggcctggggtttggaccctgattgtgccaatttatgtgactttagataaatcttttcatcagtctaccttaaagttcttcatttcctccagttccctaaaatgaggaagttagtttttagggtggttatgagaactaaatgagagcacttgagagatcattcagcctgaagtgggtactcagtattagatggctaaatctgcacagtctagaataccaggcaaaggttactctgaaggtctttgctaataacaaatctttctctaagaaagtttgtaaatgtgatgttaaactcagaaatgtcacatagaacatattggagcaattattgccgcaaaagtaactcgtagcaaccacaaaaacccagtggtgtgcagcaataaacagtttatgaattagataagtgatttcggctagatgtctctggagcagttgtagtctttcctcgttcatgagggagttggcctcacctggaaggacttggcatttttccacatgcctcctatcctccattaaacaagcatgtttttgtggaggttgtagaaggcaacaacagccaagcccaatcccataactccctttcatgtctgcatgcttcatgctaactagcattcaccagaaacaagccacatggctaaacccagtgtggaaaggcactacagagttattagaccaagggagagaacataggaggggtgaagaattggagccttaaatgcagtcaatctaccacacccttgctttgtatttaacaggttactgtactggtttgccagcaaacaatggaaaatgtggagaagctgaagaatgctcaagctgggacttaatagagtggcctatttggtttgaaatgttttaacttacagagcattgagtagaagcctaatctaatatacataaggaagacaaaagcaaaggattgtgttttctatctaaaggttaatcattgtggttgctcctggccattatcacatgactggaagttaacactctccaaacgctgagcctatcctgtacagcactagaaagtagaaagaatcactcaattcagggaaaccgttttctcttaatgtgaacatttacattaatgccatttccaaaacctttctgggacttcttaaatgcaaagatgctatctgctttacttcatgctgcctgtttttaggagcttggagtgctttaggaagcttcccaatactggtttagcagtaatttggttgactgatcaaggcatgttttaactttgacactgaaattttaaaaagacaacagttatcttgcccggagagtcaagtttctgcttccaaggaggtcaggaattgttctctttggtgatgtggctgtgcttggtagcccttgaaagtggagtcgacagcagtcctcagcttttgtgtgcctgtcttagtctgttttgtgttactataacaggatagctgaggcagggtcacttatgaaggatgctcacagttctacaggctgggaagttcaagggcatggccctggcttttggcaagggctttgctgctgcttcatagcttgatggagaaggtcagaggggaagcagacgtgcaaacaacccacttgttcacaacaaccaaacaagtctctttttaacaacccactcctggggactaatctagtcttgagagagtgagaactcattgcaagagcagcaccaagccattcatgaagcatctgcctcagtgaaccaaacatctcccactaggccccagctctcaacaccaccacaatgaagataaaatctcatcatacatttgagggacagtttgggagacagaccatagcagtgctcagtatttctacccaaatgttcaggtaacttaatatatttttccttgaatatatgtttaaatgggcttcccttccccacgctcatcttgaatggtcccacaacaacttttgattatcacgttcctgtaaatacacaaaaatattttgtggtcttttactggcagcccagtggatgggactttaaaaaatcacccagattccaacaaccagagaaaacgactggtgtatattttttccagtctttatttgtatgtctgtgtatattcaatggaaaatgtttgaagcttcactcacagcacattccattagagaaagctactaaaatcataaggaaaatctaaaatgcagtaagccagtcagcaagccataatgggcatatgaaaacaaagttttttgccatgatttgtggaccacagaagatctgtgttattagtctatttaagtttggtgtttgaaattaaaaatgttcgacatactttttatgttttttttaaatatactgtctatatttaaaattgagtatactgtactttagtgtgtttggaagcagatatccccaaataaaagtatacagtagaaccaaagaattttattgatcagctagaatttagttttcaggtgtaataactgtcaacctaaataacagaggctttctaaaagaaaatgatgtttatttgggaatagggcattgtgaaggcaatatgcatgccatagtaaactgtgtgtattcaggaaggtaaaggaagacaggtttttaaaggacagataaagattatataattgtcttgaaataattattcttggctacaaggattaataacaaggatgctgccagttcgggtttggacaatcggcttctaggcagatgtcccaaaagtattttctgtgtaaggttgcgaatagtgtttgtgcaagctggcgtggtttcttctgggtctttgaggtagtgcgtaaaatccctctcttcatggacttccctggctccatttgtcagggcttttggaaacatgactcttgattctgacagctttcacctttccctctcttgatgaagatgtttttccgaaagtatctatgatgaatcatcttgtagttaggctttgattgtcccttggtgacagaatagacctttcccgggttattggtctggtcctgcatcctgcattggcaggagtgattggcaactaaaagtcagtgttaaaacccttttagccacctttgagggcagggaggctttaagggagtggcacttaggctaagtccacctggagtctattattaagtccaattttttttccttagtcctttgttgtcccctcaaagtgctgggctagcattattctgttaggaattgtacttctttctgcagaaaatttggcaaataacagatacaaagtttaaaaaggaaatacacaaaattaatagtaatgtgacaatcccagtttgcataatggttttgagccctgaacctaggcttacaggcaaccaattgaataaatcaaattgtaatacaattcttgctctgatgtcttaggaaaaatgtctacagcctgaaatcatcaactttttgtcctggtttgcagtttgaatgtctctagctatggcattggttggtatggtgaacttttgtgtgacccatacatcagcatgagacttgctcctttaaaaattaatcacatcttagcttataggcctcagagcatgggagtagttttttttcttagagagtcatagccaaatattgaaggaaattaggaggattcaggagcaaatccagtctgcaggtggataacaggagtttcaaaacggtacagagctgtgatctaataacaggtacatatagctttcttcagaaacttaaagttaccctgatttttaccaaagatgttcagaataaaacagatttgtaaactttatcagattttgtctgcaagaatagtagtatggtcacagtaatctcagatttaaaaacctccttgaggctaagaagctaagtcaaggtagactttagattttacctatagttttaaggttcctgggcctgccaggaaatgataatttttaattcagtgtaatgctgagaaccattgaagccaggcattctacacattctcaaatatgacattttaatcaaagccttggtaatacaaccagtgtttccaattgtatcctgttataacgagagccgatttttattgaacttaggcaaatcatattgccttaagagtactcacaaataggctgggcacagtggctcatgcctgtaatcccagctctttgggaggccaagacaggtggaacacctgaggtcaggagtttgaaaccagcctggccaacatagtgaaacctccccccggccaccgtctctactaaaaaatacaaaaattagctgggtgtggtggtgcatgcctgtagtcccagctacttgggaggctgagacagaattgcttgaaccctggaggcagaagttgcactgaaacaagatcgtgccactgcattccagctggggcaacagagcgagactccgtctcaaaaacaaaaacaaatgaatactcaaaatagtttccaaattggagggatcaagaagaaaggaaaagcaaatatttctacctttgttcacaaaagtattccaaattgctgtaaactatagatagcatgagagaatttctttaaatatggaaaacaaaacatttaagtaaaaaaacaataatgcttcaaataaaagtcacagacacatcttcagttacttagtctcatgtaactttttttgttgtggttgatcttaattagtagttacatggactcatcagtttcttgaagttctgaaaaaatatttagtccattggtattaaagtgattagtaacctgtatttaaaagtgtgttagcatcttttccatgaatctgattgcaaatgcttttagagaaaaagcaataactgggaattacaaaaacttagaataaccatgattaaaaatctgatgagagtttaccataaccagaaatagacaaagagttttggttatttttgtggcaaacagcataatcagaattatgactgatgacatatttctaacggcatcgtacaattttggaacactcatatcaataacatactcataaatgtaactgtgtctagtattacatcattagacaatgcttttcatacaatttaatacatcaaagaagcctaattagctaacatctctaccagatggcatacacatgctctgaggctttccagaggcccaagtggaaaactcaaaggtaattttaagtcaaaaacacttaatttagaacttgagcctagagaagcctgtcaaagatgtcaaaagttcgaaacaggatcacaggtcactataaaatatttaacaagaatgataatcaaaagacttaagaagcaatgcagaaagttacatacatttaaaaaccatcttttcaaagcttcatttttcccaagcaaaaaaaaaacttaaacacaagaatttatcttgatagaacataaaatttttcttaggccagttgccaaaatggtaaagaaaaatctcttgcagtgtgactgcctttacttatgggaagcctatttggatatactgaaagttgaatctgatgaaaaggtacttgaatttaatcagacacaggaagagtatttccaaggttatgagtgtacgccttatagaggaatgtaaataagaaagctagtatgttgaacagaatacatggctcttggaaaaattacgagaaatttcctgcttgcgtggaacaattcaaacatgagaagagccaagaattcagaatcaagttatactggaggaaaacattgcttttctaggccttctacagaacatttcagtatcaagttataacagcaagagttagaaccagaggaaaaaagttacaggagctaatgaaaaagttaagagttatcacccctgccaaacaaaaagatgtaccttcttaaggggagaaagagctaaaggcaatgatgtgtgacctacaaataaggtgcagcaagatacagcaaaggttgaacttgtgagatataaatcaggatcttcaagaagaaaactctacctcaagaaatgaaatgaccatcttaaatgaaaaaagacagcctttctaacctgaatctaggggaaattaaacggatctcagaaggaaatatggcagaaatttaaactgtggtttagaagatggctgattttagaattaaaaattaaaacctctttcaattttattaagaccagatccttaaaaagaaccttgttctaacattggggaccaaattttgtgtgtgtgtgtgtgtgtgtgtgtgtgtgtgtgtgtgtgtgtgtatagtgcatgtatagcatttacactatcgtgtatatacaaatatatagcatatgtatagaatatactgtattattgtacatatacatatgtacaagtatatatgtaagctcaatgtcttatgatttcattctgacctattgccaacttcattacacacaactcctttcataaatgtatccttcatgaacatttcatgatctgcacagaccttcagtgacatgcttaaactttctgctttgttttatacttccccttaaacaactggtcatcctgctttaggataaaaagttactatgcaagactcatacagaattattctgttaattttgtaaccttccttaccaaaggtacattctcacacccattaacttccttcatatttctctcctcctcctacttagtggttcctttctgtcttgtttccatatttgaaacaacctctaataaactctgaatttaaacaacttttttcccaataaaaagcaatttttatgccttataacttttctcatcaaaacatctttttttgggtacactttgtatatggaattgtgtattttcaaattttaacttattaaccttaatttttagtgaaaacctaggaagcaaaattttgaagtgttatatcagcattttataaatgagaaccatattataatttttagaaacatgtttccttataactttgtatattaataggcccaaatatatttagtctttctataatttaggaagccaagaacaaactaatattttcagcagtttattgtttttttttggaaatgatccagacatttactgaagattaatttataagatttcaaattacatgaaaagttcattaacatcctatttttaaaaacattcttttggtttattttttagagacaatgtcttgctgtgttacccaggctggagttcagtggctgttcacaggcacaattgtagcacactgcagcctcaaactccaactcacacaatcctcctgcctccgtttcctgagtagctggaactatagatgcatacctgcataccaccatgtctcacccttgcttatcccgtttataatccatccaattcttttttttttttttttttttgagacggagtctcgctctgtcacccaggctggagtgcagtggcgtgatctcggctcactgcaagctccgccttctgggttcatgccattctcctgcctcagcctcccgagtagctgggactacaggcgcccgccaccgcgcccagccaattttttgtatttttagtagagacgaggtttcaccgtgatctcgatctcctgacctcgtgatctgcccgccttggcctcccaaagtgctaggattacaggcgtgagccactgcacctggcccccaattcatttttaacaattattcctagattacttataaaaactgagatattagacatagctagtcatttcaagttattttcctgttaaccatttttattacctgtgagtatcatgtgttcaattaagaaccataaaaatgaaatatgtaggtattttgccagtaactcagaggacacagctgaagtcaataatacaaaattagttcaacttacagttatacaaagatcattctgtttttaagttgagtttatagttttatgaccttaaaaagtctaacagagacaaatataaaactgagtagtaaattcaggcaaaaattttaaagacacttatttttgatttaccaattattttaaaaccagcttatcagatgtttaagttatattaactaaaaggcacttgtgttaattactatatattttgtattagcactcatttatttgatgaatagaattccttaagggatttgtggccaactgccagattttaccacgtagacacaacatacaacatatatatacatatgtgtaaacacacctaaacatacacatacacaaacatagctttcattttagaattttagtcatacgatagtaatacaggcttgctggtttataaaagacagttattggattcaaattatatttctgagaaagtgggacctgctcagctgggtaaacatgcagaataggtaatcttatgaaagctgtgaaccaaaagttttggtaaatagcagtttggatttttaaaaaacctcttaccccacctccccaaccccttttttcccttttttcagtttcaaatgagtttaatgttaatatttaaatgcttacatttttagctaggactggctgaattgtataagaaaaaacaatctccaggtggccttgaatttttagtaacaaatcttttgtttgccattctggtttttttgactagtcagtgcaggcagggaagcattttagcagttgtggatgaggggtttttgttttgttcttttagcctttgcatagcaggcaagcaatttttatgctataccagagataccttatattattgccctgagctcaagattttgacctgtttgagagcctaatttttatacgtatttatctagttcttttaggctattaatcctttaattaactgttccatcaccctaagcagttattaggcaaacctaaatttacattaaaagggatacttcttaattctaggtgttggttgccagggaactattataatttataaagccattaatttaaggccctttaagacctttttttttctttttgttcttggctggaatgccgtaaggagtgagtttcatctcaacactggcagaaacagcagatttaaagtaggcagaaaaaaaattagagagcttagaagactctacatatcaactctatagctgcagtctcttggtactaagaataaaaaagcttggggagtttagacaaagcatagacaatctctatgatggtcattgatccaaaaacatgcatgaggaaaagccacatagctgacctgaagtcccagaaaagcaggcatgccttaatgtttgagaatttccattttgtttcttctcaatctcttaagagcaaagaaaattctgtaaatcctgacagataagtcaggtgtttggaccagtgttttaactggtggcgattgccctagtggctttaaaagagccatcctgtgcccaaaatttagaatgtttatttttgctcttgggagatgttcagaaacaggggaaaagagccaaatcatttacagatgcatgtaaccatatcgaaacgaaaccaaaatcagtgttcccaaaagtgttaacccagtcatgcagattaaaaaataatataaacacagaagaacccaaagtaaatttaccagaaaaggcatgcctcagaatccagagtactcagccaggcgcagtggcccatgcctgtaatcccagcactttgggaggccaaggcaggaggatcgcttgagcccatgagttcaagaccagcctcagcagtatagtgagacactgtctctaaaaaaaaattgtttttaaatccagagtactcaaaccagagggacacttgtctttatatcaaaaaggacttgccaggaaagacaaaaagtcttttgtcatcccaggagggatgtaaagtcctttattaaagtggtcttagaaccaagacaaatccaaagtcaagtcaaaaagcctctgccaaaagtgggaggctctgcctgagaaaagactcactggggcagaacagacaagctatgtaagcggagagcccaaagggctcctgtgagtactgcatactgattctgagatcaccacttctctctgaaatgtgtcctacttcaggttctactgctgaacaccatttatgtcaacacagagagaggctctctaaaagaaaactctatttgggaatacagcattgctgtagaaatacgcatgtcatgggccgtgcgcggtggcttatgcctgtaatcccagcactttgggaggctgaggtgggccgatcacgaggtcaggagtttgagaccagcctggccaacatagtgaaaccccctctctactaaaaatacaaaaaattagatgggtgtattggtgggtgcctatgatcccgctacttgggaggctgaggcagaagattggcttgaacctgagaagtggaggttgcagtgagcctagatgtgccactgcactccagcctgggcgacagtgcaaaactacgtctccaaaaaaaaaaaaaaaagacccatgtcatggtaaactacgtgtgtattcagggaagtaaaggaagacaaagattttaaagaaaaatgagggttgtataattgttttgaaataattgtcgttggttacaaagatcaatagcaagggtggtgccactctgaagttggacaggcagtggctaggcaaaagtattttgtgggtaacctttgtgaaaggttgcagtttttgtaacacaagctgctttattttcccaaaagctttcacagtacatagaaaatatattggacgtgtattaaatgtgccaaattagtcagcaatattacattaaaatatgtgttattacttgttaatgttcttaataagttgttcaggcagttataccagactatcttttctcattttccaatttataagtgtattatccaaaaatgttagttttagggtgaccactgtatattttggtattttttaaagctacccaattgtgtataatttataaaaatctttttttcataagacctaaaacttctgaacaatacataggtgcaaataaataaattcctttttatctcaaactcacttccactgccctccctgaagaaagccttttgttattgttgtcttgactaaatgtggcatgggagctaacattttcaagggaagctgatcttatctccgggctctagaagccaagacatgaggtatgtgtttaccgtctcttaggtgactctccagaactttcattctcaacctcctccctcactgccagttcctcctcagcttcttagccaagtggtagaggaaaaatggtattttatgtcaggactaagccatgtgctctgagccctgggtaagtctgcaaggcttctctagaactcatacataggtcaattattcctcctctgaaaacttaaactctggcaccactagctttttcctacagcatacatgggctcagtaaatcctctgttaagacaacaggaaaattaagacaatgtccttgcaagccccataactactttctatccctgctattcacagccaagtgtgtcgagaccagttcacacaaaccttgttgattttcggtttcaccccctccttactaaatcacccctccatttgctgcagttgcccttgcgtgctgtactcagacttggaggaagtgatgtcttattcaaggccagtttttgtactagtggttaaataaatggtttccaaattggagtcagaaggagagcttctaaaatgtaggttccctggcctcaattgtgagattctgctttagcaggtctggaattggagcactgggatctgcattttcagaaaacccaaaatgattatcagccaggacttaaacctctgctttagaccacattccctgtgggctttcagattttctatcaatgttcttccctcttcccagctcccacacattaaaactcagatcatgcagaaaagaagttacagttccttcatttcacatcaatttctcatgcatcccatctggttttgggaaggtgtgggacgaggtggatggccttaaacttgccaatcaaagataacgttctctttcgattcaaatagcctatctcaggcttaaaaccatctctttggataaatgctcagcttttcaaaggttcttcctagcttcttcctcatgatggcatctagtgggtgagaacagtcatctccaggtgacacaggaaagagtttctctaatgtatgtgctgaggtccttgacggtcctgctgctggtgctcatcctgccatctttgctggatgtcactgagtctactgggtaatgtaagtgggtccctggcttttgttcactgctgtcatgccctgctcctgaccacaactctgtcattgcctttggtctcaaggtctctaccttaatagcttccatgtcccaactatgggactgttaatctgctgggctttggagtgggtgggaagggatgatgttggaactttgggatgtactgaacatcttgctcaagctttgggaagccaacattttctcagactgactagacacctccttccaccaatgctgagctagtgctcctgtgccatactgggtaagcctctaagtcatgagtaggacttttttgagtggcttgcagtcttccccaggctatgccaggaaagtagttgactaaccctgctgctccaagactcgcatacccatcctgaagtttccgtttatttcccaacagggcaattgcaatctcaatcaatctctccctgccctgggagtcattccactcctgcctaatgaagagactcttctcacatcgtattctcagtttctcttatccatggttaggagtaaaactcatgttcagttgtccaagctttgcttttagtatgtgaatggagctcttagcatgtagaactcccttctcattctcagtaaagtctgactttgaagactacttatcatcttcctagagatgccaaagaataatcaagataataaaggcaggctctgagattcacagctgagtagcaactgtgctgttactctagtacacaccctctcctttcctgtgactgtcaggcttcagggcttacctttattggaaagacagcaggggggcatatatgaagaaaatggaatctttaatattgtcaaagtcttgacccaatagagacattcttgccccagactctcttgcttcagtgcctttgcctgttctggtcctaagtaccttgaatatccttctcttgatgccctgatataaaactctttattcctcaaagccaagttcaggttatcacctccaccacagacttttctttccctccccaaacttcattgcctcttctcatcactccctttgtaatttgtttatactggtaagagagcattcatcataattaggcctatctatgcctacctttcttgttaaattatgagctttgttctgccttggatatctctctggcttggatatctctctggcctttgctctgcacttccaaatgtatccattattcaagacccaggtttccagcctgatcaacatagcaagatcccatctctccaaaaaaaaaaaaaaaaaaaaattgtggggccgggtacagtggctcatgcctgtaatcccagcactttgggaggccgaggcaggtggatcatgaggtcacgagtttgagaccagtctggccaacatagtgaaaccccatctgtactaaaaatgcagaaaattagccgggtgtggtggtgtgtgcctgtaatcccagctactcgggaggctgaggcaggagaatcgcatgaacccgggaggcagaggttgcagtgagccgagattgcgccactgcactccagcctgggtgacattgcaagactccatctcaaaaaaaaaaaaaaaaaaaattagctgggcatggtggcaggcacctgtagtcccagctacttgagaggctgaggtgggaggattgcttgagcccaggaagtcgaggcttcatgagccatgtttgtgctactgcactctagcctggatgacaaagtgagatccttttctaaaaataaggacccagtttattttatttagttatttagttatttttgagaccaagtttcatcactcaggctggagtgcaatggcacagtcttgactcactgcaacctctgcctcctggattcaagcaattcttctgcctcagcctcttgagtagctgggattgcaggtgcccgccaccacacctggctaatttttgtatttttggtagagacagggtttcactatgttggccaggctggtctcaaactcctgacctcaggtgatccacctgccttggtctcccaaactgctgggattacaggtgtgagtcaccctgcctggccagaacccagtttaaattccatcctctctgcagagtcttccttaaccacccctattgaaagttacccctgcttcctacaagaagtggtacttggatgttcatgagatacctgtgcaaggctcctgtgggggtcctggggagacagtgacatggacactcatgaaaggaaccttggaatagcgagtgtgtgtgctataaaatgtgctttagatttgattaccaccacttaagttatgagctctgatatggtttgggtctccatccccacccaaatctcatcttgaattgtaatccctacatgttgagggaaggaagtaattgtattatgggggtggttctcccatgctgttctcatgatagtgaattctcacaggatctgatggttttataaatggtagtttttcctgtactttcacacactcacactctcttctgccaccttgtgaagaaggtgcctgcttccccttctgccataattgtaagtttcctgaggcctccccagctgtattagtctgatctcacgcggctaataaagagataccggagactgggtaatttataaaagaggtttaattgactcacagttttacatggctggggaggcctcacaattatggcagaaggtgaagggggagcaagacacatcttacatggcatcaggcgagagagcttgtgtaggggaactcccctttataaaaccatcagatctcgtgagacttattcactattacaagagcagcacgggaaagacccacccccatgattcagttacctctcactgggtccctcacataatatggggaattatgggagctccaattcaagatgagatttgggtggggacacagccaaactatatcaccagccatgtggaactgttgagtcaattaaacctctttcctttataaattacccagtctcaggtatttctttatagcagtgtgagaacagactaatacaagcaccttgaggtcagaggctaaaatcactttttcccaaacatttcctttttatatatgctacatctttgtgtctgcttcaacatttccagcagtgctttatatatggtaggcatgcaataaatgcttcttgatcgactgacaggtgctcagaagatctaggttggttgattctcttgtgatgccatcttttcctgagagctcattaatttttaagttgttttccttgaaatgcatggtatgtttcctccaccctgctctttgcctttcatagggttccattttgatcagctgctctcattgtctgttttgtgatcaaaggttctgatgaactttggaatatgtgtatgtttggagtgaggatggggtctggaggagatgcatggttgaggaccaattcacccaacccagcttacagaagtaaagcggccccttaggagcactgaagcattgctgtggatttcagaattaccttatttctttttcttttttttttttttttttttgagacgaggtctcgctctgtcgcccaggctggagtgcagtggcacaatctcagctcactgcaagctccgcctcctgggttcacaccattctcctccctcagcctccccagcagctgggactataggtgcacgccgccacgcctggctaatttttgtatttttagtggagacagggtttcaccgtgttagccaggatggtctcaatctcctgaccttgtgatccacccgcctcagcctcccaaagtgctgggattacaggcgtgagccaccgtgcccagccagcttctttcaaatcagagtaggccttccagtgtggcaggccataagatctgaagttttcaccctgttcctggaagccaagtggacagcaactaatttttactttctttattgcacatttggggcttgggggatagagtcagatgtgtgtcagttgaaactgtagctactgcattccactccttgggggatcgtagtgctcatgccaacagaaaacttcgaggctaataattactgtcttcagagtacaagacaggcacggaagttgttttggcataagaaaaccacgatttgcatcccacagtctaaggaagacgatgctgaattcagaagatggtgcaaaagtgtgacagttcagctgtggcggctgttgctgatgcatgggactattttatttacatttcctttcttcttttttaacagagacaggatcttgctgtgttgcccagcctggtcttaaactcctgggcccaag

SEQ ID NO: 182102 - DNA, 10445 bp, Homo sapiens
  Payload ID: 15864
  Gene Symbol: SMAD2
  Gene Name: SMAD family member 2
  Uniprot ID: Q15796
  ENST ID: ENST00000356825
  CDS Start-End: 401-1714
cggccgggaggcggggcgggccgtaggcaaagggaggtggggaggcggtggccggcgactccccgcgccccgctcgccccccggcccttcccgcggtgctcggcctcgttcctttcctcctccgctccctccgtcttccatacccgccccgcgcggctttcggccggcgtgcctcgcgccctaacgggcggctggaggcgccaatcagcgggcggcagggtgccagccccggggctgcgccggcgaatcggcggggcccgcggcccagggtggcaggcgggtctacccgcgcggccgcggcggcggagaagcagctcgccagccagcagcccgccagccgccgggaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatattccagaaacgccacctcctggatatatcagtgaagatggagaaacaagtgaccaacagttgaatcaaagtatggacacaggctctccagcagaactatctcctactactctttcccctgttaatcatagcttggatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccgaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtacctaatctgttattcccacttctctgttatttttgtgtgtcttttttaatatataatatatatcaagattttcaaattatttagaagcagattttcctgtagaaaaactaatttttctgccttttaccaaaaataaactcttgggggaagaaaagtggattaacttttgaaatccttgaccttaatgtgttcagtggggcttaaacagtcattctttttgtggttttttgtttttttttgtttttttttttaactgctaaatcttattataaggaaaccatactgaaaacctttccaagcctcttttttccattcccatttttgtcctcataatcaaaacagcataacatgacatcatcaccagtaatagttgcattgatactgctggcaccagttaattctgggatacagtaagaattcatatggagaaagtccctttgtcttatgcccaaatttcaacaggaataattggcttgtataatctagcagtctgttgatttatccttccacctcataaaaaatgcataggtggcagtataattattttcagggatatgctagaattacttccacatatttatccctttttaaaaaagctaatctataaataccgtttttccaaaggtattttacaatatttcaacagcagaccttctgctcttcgagtagtttgatttggtttagtaaccagattgcattatgaaatgggccttttgtaaatgtaattgtttctgcaaaatacctagaaaagtgatgctgaggtaggatcagcagatatgggccatctgtttttaaagtatgttgtattcagtttataaattgattgttattctacacataattatgaattcagaattttaaaaattgggggaaaagccatttatttagcaagttttttagcttataagttacctgcagtctgagctgttcttaactgatcctggttttgtgattgacaatatttcatgctctgtagtgagaggagatttccgaaactctgttgctagttcattctgcagcaaataattattatgtctgatgttgactcattgcagtttaaacatttcttcttgtttgcatcttagtagaaatggaaaataaccactcctggtcgtcttttcataaattttcatatttttgaagctgtctttggtacttgttctttgaaatcatatccacctgtctctataggtatcattttcaatactttcaacatttggtggttttctattgggtactccccattttcctatatttgtgtgtatatgtatgtgttcatgtaaatttggtatagtaattttttattcattcaacaaatatttattgttcacctgtttgtaccaggaacttttcttagtctttgggtaaaggtgaacaagacaactacagttcctgcctttgctgagacagcagttacactaacccttaattatcttacttgtctatgaaggagataaacagggtactgtactggagaataacagatgggatgcttcaggtaggacatcaaggaaagcctctaaggaaaggatgcatgagctaacacctgacattaaagaagcaagccaagtgaggagccaggggagataagcattcctggcaaagagaatagcatcaaatgcaaaaaggttcacactaaaggaaactcctgattaggtattaatgctttatacagaaacctctatacaaatccaaacttgaagatcagaatggttctacagttcataacattttgaaggtggccttattttgtgatagtctgcttcatgtgattctcactaacatatctccttcctcaacctttgctgtaaaaatttcatttgcaccacatcagtactacttaatttaacaagcttttgttgtgtaagctctcactgttttagtgccctgctgcttgcttccagactttgtgctgtccagtaattatgtcttccactacccatcttgtgagcagagtaaatgtcctaggtaataccactatcaggcctgtaggagatactcagtggagcctctgcccttctttttcttacttgagaacttgtaatggtgttagggaacagttgtaggggcagaaaacaactctgaaagtggtagaaggtcctgatcttggtggttactcttgcattactgtgttaggtcaagcagtgcctactatgctgtttcagtagtggagcgcatctctacagttctgatgcgatttttctgtacagtatgaaattgggactcaactctttgaaaacacctattgagcagttatacctgttgagcagtttacttcctggttgtaattacatttgtgtgaatgtgtttgatgctttttaacgagatgatgttttttgtattttatctactgtggcctgattttttttttgttttctgcccctccccccatttataggtgtggttttcatttttctaagtgatagaatcccctctttgttgaatttttgtctttatttaaattagcaacattacttaggatttattcttcacaatactgttaattttctaggaatgatgacctgagaaccgaatggccatgctttctatcacatttctaagatgagtaatattttttccagtaggttccacagagacaccttgggggctggcttaggggaggctgttggagttctcactgacttagtggcatatttattctgtactgaagaactgcatggggtttcttttggaaagagtttcattgctttaaaaagaagctcagaaagtctttataaccactggtcaacgattagaaaaatataactggatttaggcctaccttctggaataccgctgattgtgctctttttatcctactttaaagaagctttcatgattagatttgagctatatcagttataccgattataccttataatacacattcagttagtaaacatttattgatgcctgttgtttgcccagccactgtgatggatattgaataataaaaagatgactaggacggggccctgacccttgagctgtgcttggtcttgtagaggttgtgttttttttcctcaggacctgtcactttggcagaaggaaatctgcctaatttttcttgaaagctaaattttctttgtaagtttttacaaattgtttaatacctagttgtattttttaccttaagccacattgagttttgcttgatttgtctgtcttttaaacactgtcaaatgctttcccttttgttaaaattattttaatttcactttttttgtgcccttgtcaatttaagactaagactttgaaggtaaaacaaacaaacaaacatcagtcttagtctcttgctagttgaaatcaaataaaagaaaatatatacccagttggtttctctacctcttaaaagcttcccatatatacctttaagatccttctcttttttctttaactactaaataggttcagcatttattcagtgttagataccctcttcgtctgagggtggcgtaggtttatgttgggatataaagtaacacaagacaatcttcactgtacataaaatatgtcttcatgtacagtctttactttaaaagctgaacattccaatttgcgccttccctcccaagcccctgcccaccaagtatctctttagatatctagtctgtggacatgaacaatgaatacttttttcttactctgatcgaaggcattgatacttagacatatcaaacatttcttcctttcatatgctttactttgctaaatctattatattcattgcctgaattttattcttcctttctacctgacaacacacatccaggtggtacttgctggttatcctctttcttgttagccttgttttttgttttttttttttttttttgagagggagtctcgctctgttgcccaacctggagtgcagtggtgcgatcttggttcactgcaagctccgcctcccgggttcacgccatgcttctgcctcagcctcccaagtagctgggactacaggcgcccaccaccacactcggctaattttttgtatttttagtagagacggggtttcaccgtgttggccaggatggtctcgatctcctgacctcgtgatctgtccacctcggcttcccaaagtgctgggattacaggcatgagccaccgcgcccagcctagccatatttttatctgcatatatcagaatgtttctctcctttgaacttattaacaaaaaaggaacatgcttttcatacctagagtcctaatttcttcatcatgaaggttgctattcaaattgatcaatcattttaattttacaaatggctcaaaaattctgttcagtaaatgtctttgtgactggcaaatggcataaattatgtttaagattatgaacttttctgacagttgcagccaatgttttccctacgataccagatttccatcttggggcatattggattgttgtatttaagacagtcagaataatgatagtgtgtggtctccagaggtagtcagaatcctgctattgagttctttttatatcttccttttcaattttttattaccattttgtttgtttagactacactttgtagggattgaggggcaaattatctcttggagtggaattcctgtgttttgagccttacaaccaggaaatatgagctatactagatagcctcatgatagcatttacgataagaacttatctcgtgtgttcatgtaattttttgagtaggaactgttttatcttgaatattgtagctaactatatatagcagaactgcctcagtctttttaagaaggaaataaataatatatgtgtatgaatttatatatacatatacactcatagacaaacttaacagttggggtcattctaacagttaaaacaattgttccattgtttaaatctcagatcctggtaaaatgttcttaatttgtctgtgtacattttcctttcatggacagaccattggagtacattaattttcttaatctgccatttggcagttcatttaatataccattttttggcaacttggtaactaagaatcacagccaaaatttgttaacatcaaagaaagctctgccatataccccgttactaaattattatacatccagcagattctgggatgtactaacttagggttaactttgttgttgttgataatactagattgctccctctttaattcttcttctggtgcaaggttgctgcttaagttaccctgggaaatactactacaaggtcaaattttctagtatcttacagcctgattgaaggtgattcagatctttgctcaatataaatggattttccaagattctctgggccatccttgacccacaggtgatctcgctggagtatattaacttaacttcagtgccagttggtttggtgccatgagatccataatgaatccagaacttcaccattgcttagatataagagtcccttggaagaataatgccactgatgatgggggtcagaaggtgtattaactcaacatagagggcttttagatttttcttcaaaaaaatttcgagaaaagtattcttttaccctccaaacagttaacagctcttagtttctccaaatatgctctttgatttacttatttttaattaaagatggtaatttattgaacaatgaaatccgtaatatattgatttaaggacaaaagtgaagttttagaattataaaagtacttaaatattatatattttccatttcataattgttttcctttctctgtggctttaaagtttttgactattttacaatgttaatcactaggtaacttgccatatttctggttctatattaagttctatcctttataatgctgttattataaagctggtttttagcatttgtctgtagcaatagaaattttactaagtctctgttctcccagtaagttttttcttttctcagtaagtccctaagaaaacatttgtttgccactcttactattcccaatcttggattgttcgagctgaaaaaaaatttgatgagaaacaggaggatccttttctggtgaatataggttcctgctttaagaatgtggaaatccattgctttatataactaatatacacacagattaattaaaattgtgagaaataattcacacatgacaagtaggtaacatgcatgagttttgaatttttttaaaaacccaactgtttgacaaaatatagaacccaaattggtactttcttagaccagtgtaacctcacacctcagttttgcttttccaaccctgacttgaaaggcatatttgtatctttttattagtgatagtgaagctgtgacactaaccttttatacaaaagagtaaagaaagaaaaactacagcgattaagatgagaacagttctgcagttgttgaactagatcacagcattgtaggcagaataaaaaatgttcatatctgagaatattcctttcgccatcttttcccaaggccagacctcctggtggagcacagttaaaagtaacattctgggcctttgtaatcggagggctgtgtctccagctggcagcctttgttttaatatataatgcaggactgtggaaaacagttggcatagaatattttcacctaaaaaagaaagaaaagacatacaaaactggattaattgcaaaaagagaatacagtaaaataccatataactggacaaagctagaagaacctttagaagatttgtctgaaaacagatttcaagagtgagcttttatacactgctcactaatttgcttgattactaccaactcttcttaaagttaacacgtttaaggtatttctggacttcctagccttttagcaagcttagaggaactagccattagctagtgatgtaaaaatattttggggactgatgcccttaaaggttatgcccttgaaagttcttaccttttctctagtgatattaaggaacgagtgggtagtgttctcagggtgaccagctgccctaaagtgcctgggattgagggtttccctggatgcgggactttccctggatacaaaacttttagcagagttttgtatatatgtggatttttctgataagtagcacatcagaggccttaaccactgcccaaaagcgattctccattgagagtacatatcttgaacttaagaaattcatttgctctgatttttaatcttgtaaagtttttgctaaactcaaaacaagtcccaggcacaccagaaggagctgaccaccttaggtgttcttgtgatttatccttacttccctatgttgtcatagttgcttctaaactcagctgcactatggctgtcaacatttctgatacttattgggatatgtgccatccagtcatttagtactttgaatggaacatgagatttataacacaggtaatagctgaaggtaccagtatggtggtgagactcacacttagtgatccagctaaggtaactgatgttataatggaacagagaagaggccaactagatagctaagttcttctgaacctatgtgtatatgtaagtacaaatcatgcgtccttatggggttaaacttaatctgaaatttacatttttcatagtaaaaggaaaccaattgttgcagatttcttttcttgtgaggaaatacatggcctttgatgctctggcgtctactgcatttcccagtctgttctgctcgagaagccagaatgtgttgttaacatttttccgtgaatgttgtgttaaaatgattaaatgcatcagccaatggcaagtgaaggaattgggtgtcctgatgcagactgagcagtttctctcaattgtagcctcatactcataaggtgcttaccagctagaacattgagcacgtgaggtgagattttttttctctgatggcattaactttgtaatgcaatatgatggatgcagaccctgttcttgtttccctctggaagtccttagtggctgcatccttggtgcactgtgatggagatattaaatgtgttctttgtgagctttcgttctatgattgtcaaaagtacgatgtggttccttttttatttttattaaacaatgagctgaggctttattacagctggttttcaagttaaaattgttgaatactgatgtctttctcccacctacaccaaatattttagtctatttaaagtacaaaaaaagttctgcttaagaaaacattgcttacatgtcctgtgatttctggtcaatttttatatatatttgtgtgcatcatctgtatgtgctttcactttttaccttgtttgctcttacctgtgttaacagccctgtcaccgttgaaaggtggacagttttcctagcattaaaagaaagccatttgagttgtttaccatgtt

SEQ ID NO: 182103 - DNA, 12075 bp, Homo sapiens
  Payload ID: 15864
  Gene Symbol: SMAD2
  Gene Name: SMAD family member 2
  Uniprot ID: Q15796
  ENST ID: ENST00000402690
  CDS Start-End: 396-1799
gggaggcggggcgggccgtaggcaaagggaggtggggaggcggtggccggcgactccccgcgccccgctcgccccccggcccttcccgcggtgctcggcctcgttcctttcctcctccgctccctccgtcttccatacccgccccgcgcggctttcggccggcgtgcctcgcgccctaacgggcggctggaggcgccaatcagcgggcggcagggtgccagccccggggctgcgccggcgaatcggcggggcccgcggcccagggtggcaggcgggtctacccgcgcggccgcggcggcggagaagcagctcgccagccagcagcccgccagccgccgggaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaagcacttgctctgaaatttggggactgagtacaccaaatacgatagatcagtgggatacaacaggcctttacagcttctctgaacaaaccaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatattccagaaacgccacctcctggatatatcagtgaagatggagaaacaagtgaccaacagttgaatcaaagtatggacacaggctctccagcagaactatctcctactactctttcccctgttaatcatagcttggatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccgaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtacctaatctgttattcccacttctctgttatttttgtgtgtcttttttaatatataatatatatcaagattttcaaattatttagaagcagattttcctgtagaaaaactaatttttctgccttttaccaaaaataaactcttgggggaagaaaagtggattaacttttgaaatccttgaccttaatgtgttcagtggggcttaaacagtcattctttttgtggttttttgtttttttttgtttttttttttaactgctaaatcttattataaggaaaccatactgaaaacctttccaagcctcttttttccattcccatttttgtcctcataatcaaaacagcataacatgacatcatcaccagtaatagttgcattgatactgctggcaccagttaattctgggatacagtaagaattcatatggagaaagtccctttgtcttatgcccaaatttcaacaggaataattggcttgtataatctagcagtctgttgatttatccttccacctcataaaaaatgcataggtggcagtataattattttcagggatatgctagaattacttccacatatttatccctttttaaaaaagctaatctataaataccgtttttccaaaggtattttacaatatttcaacagcagaccttctgctcttcgagtagtttgatttggtttagtaaccagattgcattatgaaatgggccttttgtaaatgtaattgtttctgcaaaatacctagaaaagtgatgctgaggtaggatcagcagatatgggccatctgtttttaaagtatgttgtattcagtttataaattgattgttattctacacataattatgaattcagaattttaaaaattgggggaaaagccatttatttagcaagttttttagcttataagttacctgcagtctgagctgttcttaactgatcctggttttgtgattgacaatatttcatgctctgtagtgagaggagatttccgaaactctgttgctagttcattctgcagcaaataattattatgtctgatgttgactcattgcagtttaaacatttcttcttgtttgcatcttagtagaaatggaaaataaccactcctggtcgtcttttcataaattttcatatttttgaagctgtctttggtacttgttctttgaaatcatatccacctgtctctataggtatcattttcaatactttcaacatttggtggttttctattgggtactccccattttcctatatttgtgtgtatatgtatgtgttcatgtaaatttggtatagtaattttttattcattcaacaaatatttattgttcacctgtttgtaccaggaacttttcttagtctttgggtaaaggtgaacaagacaactacagttcctgcctttgctgagacagcagttacactaacccttaattatcttacttgtctatgaaggagataaacagggtactgtactggagaataacagatgggatgcttcaggtaggacatcaaggaaagcctctaaggaaaggatgcatgagctaacacctgacattaaagaagcaagccaagtgaggagccaggggagataagcattcctggcaaagagaatagcatcaaatgcaaaaaggttcacactaaaggaaactcctgattaggtattaatgctttatacagaaacctctatacaaatccaaacttgaagatcagaatggttctacagttcataacattttgaaggtggccttattttgtgatagtctgcttcatgtgattctcactaacatatctccttcctcaacctttgctgtaaaaatttcatttgcaccacatcagtactacttaatttaacaagcttttgttgtgtaagctctcactgttttagtgccctgctgcttgcttccagactttgtgctgtccagtaattatgtcttccactacccatcttgtgagcagagtaaatgtcctaggtaataccactatcaggcctgtaggagatactcagtggagcctctgcccttctttttcttacttgagaacttgtaatggtgttagggaacagttgtaggggcagaaaacaactctgaaagtggtagaaggtcctgatcttggtggttactcttgcattactgtgttaggtcaagcagtgcctactatgctgtttcagtagtggagcgcatctctacagttctgatgcgatttttctgtacagtatgaaattgggactcaactctttgaaaacacctattgagcagttatacctgttgagcagtttacttcctggttgtaattacatttgtgtgaatgtgtttgatgctttttaacgagatgatgttttttgtattttatctactgtggcctgattttttttttgttttctgcccctccccccatttataggtgtggttttcatttttctaagtgatagaatcccctctttgttgaatttttgtctttatttaaattagcaacattacttaggatttattcttcacaatactgttaattttctaggaatgatgacctgagaaccgaatggccatgctttctatcacatttctaagatgagtaatattttttccagtaggttccacagagacaccttgggggctggcttaggggaggctgttggagttctcactgacttagtggcatatttattctgtactgaagaactgcatggggtttcttttggaaagagtttcattgctttaaaaagaagctcagaaagtctttataaccactggtcaacgattagaaaaatataactggatttaggcctaccttctggaataccgctgattgtgctctttttatcctactttaaagaagctttcatgattagatttgagctatatcagttataccgattataccttataatacacattcagttagtaaacatttattgatgcctgttgtttgcccagccactgtgatggatattgaataataaaaagatgactaggacggggccctgacccttgagctgtgcttggtcttgtagaggttgtgttttttttcctcaggacctgtcactttggcagaaggaaatctgcctaatttttcttgaaagctaaattttctttgtaagtttttacaaattgtttaatacctagttgtattttttaccttaagccacattgagttttgcttgatttgtctgtcttttaaacactgtcaaatgctttcccttttgttaaaattattttaatttcactttttttgtgcccttgtcaatttaagactaagactttgaaggtaaaacaaacaaacaaacatcagtcttagtctcttgctagttgaaatcaaataaaagaaaatatatacccagttggtttctctacctcttaaaagcttcccatatatacctttaagatccttctcttttttctttaactactaaataggttcagcatttattcagtgttagataccctcttcgtctgagggtggcgtaggtttatgttgggatataaagtaacacaagacaatcttcactgtacataaaatatgtcttcatgtacagtctttactttaaaagctgaacattccaatttgcgccttccctcccaagcccctgcccaccaagtatctctttagatatctagtctgtggacatgaacaatgaatacttttttcttactctgatcgaaggcattgatacttagacatatcaaacatttcttcctttcatatgctttactttgctaaatctattatattcattgcctgaattttattcttcctttctacctgacaacacacatccaggtggtacttgctggttatcctctttcttgttagccttgttttttgttttttttttttttttttgagagggagtctcgctctgttgcccaacctggagtgcagtggtgcgatcttggttcactgcaagctccgcctcccgggttcacgccatgcttctgcctcagcctcccaagtagctgggactacaggcgcccaccaccacactcggctaattttttgtatttttagtagagacggggtttcaccgtgttggccaggatggtctcgatctcctgacctcgtgatctgtccacctcggcttcccaaagtgctgggattacaggcatgagccaccgcgcccagcctagccatatttttatctgcatatatcagaatgtttctctcctttgaacttattaacaaaaaaggaacatgcttttcatacctagagtcctaatttcttcatcatgaaggttgctattcaaattgatcaatcattttaattttacaaatggctcaaaaattctgttcagtaaatgtctttgtgactggcaaatggcataaattatgtttaagattatgaacttttctgacagttgcagccaatgttttccctacgataccagatttccatcttggggcatattggattgttgtatttaagacagtcagaataatgatagtgtgtggtctccagaggtagtcagaatcctgctattgagttctttttatatcttccttttcaattttttattaccattttgtttgtttagactacactttgtagggattgaggggcaaattatctcttggagtggaattcctgtgttttgagccttacaaccaggaaatatgagctatactagatagcctcatgatagcatttacgataagaacttatctcgtgtgttcatgtaattttttgagtaggaactgttttatcttgaatattgtagctaactatatatagcagaactgcctcagtctttttaagaaggaaataaataatatatgtgtatgaatttatatatacatatacactcatagacaaacttaacagttggggtcattctaacagttaaaacaattgttccattgtttaaatctcagatcctggtaaaatgttcttaatttgtctgtgtacattttcctttcatggacagaccattggagtacattaattttcttaatctgccatttggcagttcatttaatataccattttttggcaacttggtaactaagaatcacagccaaaatttgttaacatcaaagaaagctctgccatataccccgttactaaattattatacatccagcagattctgggatgtactaacttagggttaactttgttgttgttgataatactagattgctccctctttaattcttcttctggtgcaaggttgctgcttaagttaccctgggaaatactactacaaggtcaaattttctagtatcttacagcctgattgaaggtgattcagatctttgctcaatataaatggattttccaagattctctgggccatccttgacccacaggtgatctcgctggagtatattaacttaacttcagtgccagttggtttggtgccatgagatccataatgaatccagaacttcaccattgcttagatataagagtcccttggaagaataatgccactgatgatgggggtcagaaggtgtattaactcaacatagagggcttttagatttttcttcaaaaaaatttcgagaaaagtattcttttaccctccaaacagttaacagctcttagtttctccaaatatgctctttgatttacttatttttaattaaagatggtaatttattgaacaatgaaatccgtaatatattgatttaaggacaaaagtgaagttttagaattataaaagtacttaaatattatatattttccatttcataattgttttcctttctctgtggctttaaagtttttgactattttacaatgttaatcactaggtaacttgccatatttctggttctatattaagttctatcctttataatgctgttattataaagctggtttttagcatttgtctgtagcaatagaaattttactaagtctctgttctcccagtaagttttttcttttctcagtaagtccctaagaaaacatttgtttgccactcttactattcccaatcttggattgttcgagctgaaaaaaaatttgatgagaaacaggaggatccttttctggtgaatataggttcctgctttaagaatgtggaaatccattgctttatataactaatatacacacagattaattaaaattgtgagaaataattcacacatgacaagtaggtaacatgcatgagttttgaatttttttaaaaacccaactgtttgacaaaatatagaacccaaattggtactttcttagaccagtgtaacctcacacctcagttttgcttttccaaccctgacttgaaaggcatatttgtatctttttattagtgatagtgaagctgtgacactaaccttttatacaaaagagtaaagaaagaaaaactacagcgattaagatgagaacagttctgcagttgttgaactagatcacagcattgtaggcagaataaaaaatgttcatatctgagaatattcctttcgccatcttttcccaaggccagacctcctggtggagcacagttaaaagtaacattctgggcctttgtaatcggagggctgtgtctccagctggcagcctttgttttaatatataatgcaggactgtggaaaacagttggcatagaatattttcacctaaaaaagaaagaaaagacatacaaaactggattaattgcaaaaagagaatacagtaaaataccatataactggacaaagctagaagaacctttagaagatttgtctgaaaacagatttcaagagtgagcttttatacactgctcactaatttgcttgattactaccaactcttcttaaagttaacacgtttaaggtatttctggacttcctagccttttagcaagcttagaggaactagccattagctagtgatgtaaaaatattttggggactgatgcccttaaaggttatgcccttgaaagttcttaccttttctctagtgatattaaggaacgagtgggtagtgttctcagggtgaccagctgccctaaagtgcctgggattgagggtttccctggatgcgggactttccctggatacaaaacttttagcagagttttgtatatatgtggatttttctgataagtagcacatcagaggccttaaccactgcccaaaagcgattctccattgagagtacatatcttgaacttaagaaattcatttgctctgatttttaatcttgtaaagtttttgctaaactcaaaacaagtcccaggcacaccagaaggagctgaccaccttaggtgttcttgtgatttatccttacttccctatgttgtcatagttgcttctaaactcagctgcactatggctgtcaacatttctgatacttattgggatatgtgccatccagtcatttagtactttgaatggaacatgagatttataacacaggtaatagctgaaggtaccagtatggtggtgagactcacacttagtgatccagctaaggtaactgatgttataatggaacagagaagaggccaactagatagctaagttcttctgaacctatgtgtatatgtaagtacaaatcatgcgtccttatggggttaaacttaatctgaaatttacatttttcatagtaaaaggaaaccaattgttgcagatttcttttcttgtgaggaaatacatggcctttgatgctctggcgtctactgcatttcccagtctgttctgctcgagaagccagaatgtgttgttaacatttttccgtgaatgttgtgttaaaatgattaaatgcatcagccaatggcaagtgaaggaattgggtgtcctgatgcagactgagcagtttctctcaattgtagcctcatactcataaggtgcttaccagctagaacattgagcacgtgaggtgagattttttttctctgatggcattaactttgtaatgcaatatgatggatgcagaccctgttcttgtttccctctggaagtccttagtggctgcatccttggtgcactgtgatggagatattaaatgtgttctttgtgagctttcgttctatgattgtcaaaagtacgatgtggttccttttttatttttattaaacaatgagctgaggctttattacagctggttttcaagttaaaattgttgaatactgatgtctttctcccacctacaccaaatattttagtctatttaaagtacaaaaaaagttctgcttaagaaaacattgcttacatgtcctgtgatttctggtcaatttttatatatatttgtgtgcatcatctgtatgtgctttcactttttaccttgtttgctcttacctgtgttaacagccctgtcaccgttgaaaggtggacagttttcctagcattaaaagaaagccatttgagttgtttaccatgttactatgggactaatttttaattgttttaatttttatttaaactgatctttttttatatgggattacattttggtgttcactccctaaattatatggaaaccaaaaaaagtgattgtatttcacatatggacatatgattttaagagtacatgtttttgtttttttaatttggtgttacataaaagattatcctatccccccgggagataaatttatactacttaatataaccccacaacaggcgcacaccacacactgcacagtgctatttatacatttttatttatttcagagtttgcctatgctacattagcgctctaatacataagatctatgctgtaaacaaaaacatcttcaaagttgaaatttgctgaaatatacttttaacaaaataacatttttaaggctccattgaaaaatactagataagatataatctcatataatcagtatgaataattttaaaaatgagaaatatttaggtcagccacacttcctttgtgccttgcaagaattcagttctgtggatgaatcagtactggttagcagactgttttctgcaaaccattttaaacatgctttagtatgcaacaaaaagggacctcaaatgctaaaatacactattttacgtggcattgaatagccttgggactggtgtagttttatcaacacttttttattaggaagaaacccaagaaaatttactgtaattgctaccacctgccactgtataaataatctaaaagggacttcccaacattgaacaacaacattgagggctgactcgagatccttctacattgtcacctcagcctggctttgcctgtcactgcttagcttgaagtagtgacactgttctgtatcaggagatttttataatggccctagcatccataattccacatgttcatcaaatggctgaagagtatgagagaagtattaaggtctatgtttgggctgtctccccacttggcatattctgtttttccctcttcaaaatagattgaaagcctcttagtgcaggaagcaggcatcagtatcaaactgatgtcatccaatgtaattattttaagctccaggtttgtctaagtttgggtgaagaatgttcaggaacatgtttgcaacatacagttatccagcttaccctttgacagattcacccttctcatcaaaatagtaagcccaacctaaaaattataagtttacaaataaaggaatagaaaaacccaaaaagctaatttacacataaaaattatcttttgctgcaataaataggtatggaaatatttgtagaattggtttaactgattttgtaaaacaaatgtcatgctattttgccatagtgagacatgcagtaattcttaaaatcacattaatagaaggcaagaacattgaatcagacttagcagataacagattcagtgataaatgaacaatagactaagcatacttaggaagctacatgagaacagaatgtattactgtgctcccgtccaaactgcatgactttattggttatagaataaatggaatttgagatgggga

SEQ ID NO: 182104 - DNA, 828 bp, Homo sapiens
  Payload ID: 15864
  Gene Symbol: SMAD2
  Gene Name: SMAD family member 2
  ENST ID: ENST00000586514
  CDS Start-End: 178-828
agcagctcgccagccagcagcccgccagccgccgggagccccctccatcccatcggaagaggaaggaacaaaaggtcccggaccccccggatctgacggggcgggacctggcgccaccttgcaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaagcacttgctctgaaatttggggactgagtacaccaaatacgatagatcagtgggatacaacaggcctttacagcttctctgaacaaaccaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatatt

SEQ ID NO: 182105 - DNA, 527 bp, Homo sapiens
  Payload ID: 15864
  Gene Symbol: SMAD2
  Gene Name: SMAD family member 2
  ENST ID: ENST00000589877
  CDS Start-End: 200-527
cggccgcggcggcggagaagcagctcgccagccagcagcccgccagccgccgggaggtggccccctccatcccatcggaagaggaaggaacaaaaggtcccggaccccccggatctgacggggcgggacctggcgccaccttgcaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaagcacttgctctgaaatttggggactgagtacaccaaatacgatagatcagtgggatacaacaggcctttacagcttctctgaacaaaccaggt

SEQ ID NO: 182106 - DNA, 1971 bp, Homo sapiens
  Payload ID: 15864
  Gene Symbol: SMAD2
  Gene Name: SMAD family member 2
  Uniprot ID: Q15796
  ENST ID: ENST00000586040
  CDS Start-End: 56-1369
aggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatattccagaaacgccacctcctggatatatcagtgaagatggagaaacaagtgaccaacagttgaatcaaagtatggacacaggctctccagcagaactatctcctactactctttcccctgttaatcatagcttggatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccgaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtacctaatctgttattcccacttctctgttatttttgtgtgtcttttttaatatataatatatatcaagattttcaaattatttagaagcagattttcctgtagaaaaactaatttttctgccttttaccaaaaataaactcttgggggaagaaaagtggattaacttttgaaa

SEQ ID NO: 182107 - DNA, 1042 bp, Homo sapiens
  Payload ID: 15864
  Gene Symbol: SMAD2
  Gene Name: SMAD family member 2
  ENST ID: ENST00000587269
  CDS Start-End: 391-1042
ccctctcctcccctcccctcccctctcttcccctaccctcccgcgcgcccgggccgccggccgggcccgggcctgggggcggggcgggaagacggcggccgggagtgttttcagttccgcctccaatcgcccattcccctcttcccctcccagccccctccatcccatcggaagaggaaggaacaaaaggtcccggaccccccggatctgacggggcgggacctggcgccaccttgcagatacctgaaaaaagcggcagtctgcaacccagaagagggccttacttggaacctaaccatgctggtaccctgatctcggacttgcagcctccggaactgttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaagcacttgctctgaaatttggggactgagtacaccaaatacgatagatcagtgggatacaacaggcctttacagcttctctgaacaaaccaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatattc

SEQ ID NO: 182108 - DNA, 1714 bp, Homo sapiens
  Payload ID: 15864
  Gene Symbol: SMAD2
  Gene Name: SMAD family member 2
  ENST ID: ENST00000591214
  CDS Start-End: 97-1392
ggagaagcagctcgccagccagcagcccgccagccgccgggaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatattccagaaacgccacctcctggatatatcagtgaagatggagaaacaagtgaccaacagttgaatcaaagtatggacacaggctctccagcagaactatctcctactactctttcccctgttaatcatagcttggatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccggtatgaaatacatatttggttcttaaatttccacagtgtaattatgtttcattgcattcttgcatattctggagttcatttgtatctattttcaatgaggttatagagtcagctgatctttatgtaaaataaagttggaggcctccaaattcaaaactgttgcaaattactgagctgccattatggaagatattaaaacatgcacaggcgtgcattttaacgtaattcagagtgttaaatatcataaaaggggtgtatatgaagggttatgtcagtttatggaaggagagatgtttgcacacggtgctcaaggaaaacttgatggcacatgatctagttgtaaaaggtgcattggatttcaatagtcataaatggggtgggcagagttgggaagtgataatcttgacaatagcatagcaattcagttt

SEQ ID NO: 182109 - DNA, 575 bp, Homo sapiens
  Payload ID: 15864
  Gene Symbol: SMAD2
  Gene Name: SMAD family member 2
  ENST ID: ENST00000587421
  CDS Start-End: 165-575
aggtaaagcctgggcgcccgcgggcctccagctagggaagtgtttgcgtgcgtccgcggccggggcgatgggccgtgtcacatggccgctgcgggtgggggctggggtgtggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaagcacttgctctgaaatttggggactgagtacaccaaatacgatagatcagtgggatacaacaggcctttacagcttctctgaacaaaccaggtctcttgatggtcgtctccaggtatcccatcgaaaaggattgccacatgttatatattgccgattatggcgctggcctgatctt

SEQ ID NO: 182110 - DNA, 663 bp, Homo sapiens
  Payload ID: 15864
  Gene Symbol: SMAD2
  Gene Name: SMAD family member 2
  ENST ID: ENST00000585978
  CDS Start-End: 338-663
aggaagcctttgaagcacagctgaagaacagtaggtcttggagaaatttttgctgtagacctgctctatcttaacagtatgtttgaacatagattgctaaaaatctcggtctccacagaggattggttccgggactctcctgcaagcaccagaatatgagaacgctgaagtcccttgtataaaatgatacctgaaaaaagcggcagtctgcaacccagaagagggccttacttggaacctaaccatgctggtaccctgatctcggacttgcagcctccggaactgttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaagcacttgctctgaaatttggggactgagtacaccaaatacgatagatcagtgggatacaacaggcctttacagcttctctgaacaaaccag

SEQ ID NO: 182111 - DNA, 6247 bp, Homo sapiens
  Payload ID: 15865
  Gene Symbol: SMAD3
  Gene Name: SMAD family member 3
  Uniprot ID: P84022
  ENST ID: ENST00000327367
  CDS Start-End: 311-1588
acttggagtctcgcggccgccgcctccgccccgcgttcggggccttcccgaccctgcactgctgccgtccgcccgcccggccgctcttctcttcgccgtgggagccgctccgggcgcagggccgcgcgccgagccccgcaggctgcagcgccgcggcccggcccggcgccccggcaacttcgccgagagttgaggcgaagtttgggcgaccgcggcaggccccggccgagctcccctctgcgcccccggcgtcccgtcgagcccagccccgccgggggcgctcctcgccgcccgcgcgccctccccagccatgtcgtccatcctgcctttcactcccccgatcgtgaagcgcctgctgggctggaagaagggcgagcagaacgggcaggaggagaaatggtgcgagaaggcggtcaagagcctggtcaagaaactcaagaagacggggcagctggacgagctggagaaggccatcaccacgcagaacgtcaacaccaagtgcatcaccatccccaggtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcaggcttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgctttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagaggagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttttagatttttctaacttttatatcttaaaagcagagcacctgtttaagcattgtacccctattgttaaagatttgtgtcctctcattccctctcttcctcttgtaagtgcccttctaataaacttttcatggaaaagctcctgtgccaggagctcagtctga

SEQ ID NO: 182112 - DNA, 1530 bp, Homo sapiens
  Payload ID: 15865
  Gene Symbol: SMAD3
  Gene Name: SMAD family member 3
  Uniprot ID: P84022
  ENST ID: ENST00000439724
  CDS Start-End: 27-1172
ccctgtgacctcccaacttcacaaacatgtcttgcctgcaccctaggcaaacgtggaaaggcgcagctctggtacaccggaaagcatggtggatggggaggtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaaca

SEQ ID NO: 182113 - DNA, 1567 bp, Homo sapiens
  Payload ID: 15865
  Gene Symbol: SMAD3
  Gene Name: SMAD family member 3
  Uniprot ID: P84022
  ENST ID: ENST00000540846
  CDS Start-End: 379-1341
aaatatgagcttgtgcttgctggaggaggatgacagaggagcctgctgctgagttcactggtgctggggttaggtcactgctgggctgaagcgcactgaccataagagcaacatgtgggcaagagccgcggcactggggtaatttattgccgccgctcgcttcaccaggaaccccacacgctgggttcccacaggatgcgacattcccacaggatgggacaactgcatggaaacccacactcgggcctgtgttgagcaaccacgtttgagtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttg

SEQ ID NO: 182114 - DNA, 1147 bp, Homo sapiens
  Payload ID: 15865
  Gene Symbol: SMAD3
  Gene Name: SMAD family member 3
  Uniprot ID: P84022
  ENST ID: ENST00000537194
  CDS Start-End: 229-921
agtaatcctgctgcgttcctcttagagcattctaatttggacgtgacgttcatcctgggttagtttactgggctgagattggctacaggcctgtgtgcttgggtcagagtgttaaggaggagacccactgtccaaccttctcagatcctttgcgggtagccctggcgtcccgcggagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttg

SEQ ID NO: 182115 - DNA, 552 bp, Homo sapiens
  Payload ID: 15865
  Gene Symbol: SMAD3
  Gene Name: SMAD family member 3
  ENST ID: ENST00000558827
  CDS Start-End: 215-552
acacatttcagacttgggagttgatccggtcctgcgtgagcaaaggcagttatgatccaagcgggagtcagaggtggacaggggcgaggacaacagaaccaagagctggaacctctactccaagacctggagctcctacagccacggatgctagcatcatgagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcct

SEQ ID NO: 182116 - DNA, 568 bp, Homo sapiens
  Payload ID: 15865
  Gene Symbol: SMAD3
  Gene Name: SMAD family member 3
  ENST ID: ENST00000559460
  CDS Start-End: 292-568
aaataatccttgcagtgttacaacagtgtgcccgtgtagagaactgttttgcaaagagctcgatcaatgatgtcatctttgccttccgtgacccaggcagctgggtgcagtctcaagatcggagactgaggcttcaacaaagtattgggttcaaattccagctctgccacttggaaccctgagtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaacc

SEQ ID NO: 182117 - DNA, 586 bp, Homo sapiens
  Payload ID: 15865
  Gene Symbol: SMAD3
  Gene Name: SMAD family member 3
  ENST ID: ENST00000558739
  CDS Start-End: 398-586
aggatgtcaggaagcaactgtaggaaaccccctgtgtgggtgaagcagaggcgtcgctcagggccctctgcctggttctgggctctgggaccctgctcccctcccctgaaccccccctcccccggccccaggatggagcttgcttgccatcgcagtggatttgcggaagagggttccagagtgtggggagagcgtgctggggaggggagctatttgttcctttccagtcatcgctgtactgagcggttccctgggacagttgaacccaggggaactgaattcatctgtgtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgca

SEQ ID NO: 182118 - DNA, 584 bp, Homo sapiens
  Payload ID: 15865
  Gene Symbol: SMAD3
  Gene Name: SMAD family member 3
  ENST ID: ENST00000559092
  CDS Start-End: 293-583
agcacagaggcaaaccacagagtacatttgaggcccagatctgcttatttcgagggtggggccgcgtttttctcctgccacagtgagctaattaaagaaaacaagcttcgggagttgggagagaactgtccacaggacacttggggaggcttgctttggttgtggaggcctccacagcccccggaaggcaggtggaagtgggcatggagggtcctacgcatccccagcgggggtctgagggcccactgttgctcagctgggggatttggggacggtgggagggcatacatggatgggagggtggactccgttcctgagggggccagtgtggaggagggtcaggcagcccatggagatgggacagtgttctgaaatgcttcacaaatgtggacttttgccccaaactgtggacagagcgtatgtcctgagcgaggatcaactctgtccctggatggccggttgcaggtgtcccatcggaaggggctccctcatgtcatctactgccgcctgtggcgatggccagacctgcacagccaccacgagctacgggccatggagctgtgtgagttcgccttcaatatgaa

SEQ ID NO: 182119 - DNA, 554 bp, Homo sapiens
  Payload ID: 15865
  Gene Symbol: SMAD3
  Gene Name: SMAD family member 3
  ENST ID: ENST00000558428
  CDS Start-End: 302-554
acacatttcagacttgggagttgatccggtcctgcgtgagcaaaggcagttatgatccaagcgggagtcagaggtggacaggggcgaggacaacagaaccaagagctggaacctctactccaagacctggagctcctacagccacggatgctagcatcatggtgtgcatgtgtgatgtctttgcaaaaggtgtctcagagccaagctgtgaaggccttttaacagaccaccttccttctgattcccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacagga

SEQ ID NO: 182120 - DNA, 542 bp, Homo sapiens
  Payload ID: 15865
  Gene Symbol: SMAD3
  Gene Name: SMAD family member 3
  ENST ID: ENST00000560175
  CDS Start-End: 200-542
aaaacaagcttcgggagttgggagagaactgtccacaggacacttggggaggcttgctttggttgtggaggcctccacagcccccggaaggtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttgg

SEQ ID NO: 182121 - DNA, 775 bp, Homo sapiens
  Payload ID: 15865
  Gene Symbol: SMAD3
  Gene Name: SMAD family member 3
  ENST ID: ENST00000560424
  CDS Start-End: 1-470
gcctcagtgacagcgctatttttgtccagtctcccaactgtaaccagcgctatggctggcacccggccaccgtctgcaagatcccaccaggaaaggcccccctctccacaccatctccctatttttggaagccctctttgcagacttctccctgctctgggagtcggagcttgtgggccagccttccatctccccttgcaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctcccccca

SEQ ID NO: 182122 - DNA, 797 bp, Homo sapiens
  Payload ID: 15865
  Gene Symbol: SMAD3
  Gene Name: SMAD family member 3
  ENST ID: ENST00000558894
  CDS Start-End: 159-797
caagccttggccagacgtggatatggttatgcacggactccgttttgtggtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggatgcaacctgaagatcttcaacaaccaggagttcgctgccctcctggcccagtcggtcaaccagggctttgaggctgtctac

SEQ ID NO: 182123 - DNA, 8769 bp, Homo sapiens
  Payload ID: 15866
  Gene Symbol: SMAD4
  Gene Name: SMAD family member 4
  Uniprot ID: Q13485
  ENST ID: ENST00000342988
  CDS Start-End: 539-2197
atgctcagtggcttctcgacaagttggcagcaacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcccgggagctcgaggcggtccggcccgcgcgggcagcggcgcggcgctgaggaggggcggcctggccgggacgcctcggggcgggggccgaggagctctccgggccgccggggaaagctacgggcccggtgcgtccgcggaccagcagcgcgggagagcggactcccctcgccaccgcccgagcccaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacatacaaagttgaattctaggtttgatttttaagattttttttttcttttgcacttttgagtccaatctcagtgatgaggtaccttctactaaatgacaggcaacagccagttctattgggcagctttgtttttttccctcacactctaccgggacttccccatggacattgtgtatcatgtgtagagttggttttttttttttttaatttttattttactatagcagaaatagacctgattatctacaagatgataaatagattgtctacaggataaatagtatgaaataaaatcaaggattatctttcagatgtgtttacttttgcctggagaacttttagctatagaaacacttgtgtgatgatagtcctccttatatcacctggaatgaacacagcttctactgccttgctcagaaggtcttttaaatagaccatcctagaaaccactgagtttgcttatttctgtgatttaaacatagatcttgatccaagctacatgacttttgtctttaaataacttatctaccacctcatttgtactcttgattacttacaaattctttcagtaaacacctaattttcttctgtaaaagtttggtgatttaagttttattggcagttttataaaaagacatcttctctagaaattgctaactttaggtccattttactgtgaatgaggaataggagtgagttttagaataacagatttttaaaaatccagatgatttgattaaaaccttaatcatacattgacataattcattgcttcttttttttgagatatggagtcttgctgtgttgcccaggcaggagtgcagtggtatgatctcagctcactgcaacctctgcctcccgggttcaactgattctcctgcctcagcctccctggtagctaggattacaggtgcccgccaccatgcctggctaacttttgtagttttagtagagacggggttttgcctgttggccaggctggtcttgaactcctgacctcaagtgatccatccaccttggcctcccaaagtgctgggattacgggcgtgagccactgtccctggcctcattgttcccttttctactttaaggaaagttttcatgtttaatcatctggggaaagtatgtgaaaaatatttgttaagaagtatctctttggagccaagccacctgtcttggtttctttctactaagagccataaagtatagaaatacttctagttgttaagtgcttatatttgtacctagatttagtcacacgcttttgagaaaacatctagtatgttatgatcagctattcctgagagcttggttgttaatctatatttctatttcttagtggtagtcatctttgatgaataagactaaagattctcacaggtttaaaattttatgtctactttaagggtaaaattatgaggttatggttctgggtgggttttctctagctaattcatatctcaaagagtctcaaaatgttgaatttcagtgcaagctgaatgagagatgagccatgtacacccaccgtaagacctcattccatgtttgtccagtgcctttcagtgcattatcaaagggaatccttcatggtgttgcctttattttccggggagtagatcgtgggatatagtctatctcatttttaatagtttaccgcccctggtatacaaagataatgacaataaatcactgccatataaccttgctttttccagaaacatggctgttttgtattgctgtaaccactaaataggttgcctataccattcctcctgtgaacagtgcagatttacaggttgcatggtctggcttaaggagagccatacttgagacatgtgagtaaactgaactcatattagctgtgctgcatttcagacttaaaatccatttttgtggggcagggtgtggtgtgtaaaggggggtgtttgtaatacaagttgaaggcaaaataaaatgtcctgtctcccagatgatatacatcttattatttttaaagtttattgctaattgtaggaaggtgagttgcaggtatctttgactatggtcatctggggaaggaaaattttacattttactattaatgctccttaagtgtctatggaggttaaagaataaaatggtaaatgtttctgtgcctggtttgatggtaactggttaatagttactcaccattttatgcagagtcacattagttcacaccctttctgagagccttttgggagaagcagttttattctctgagtggaacagagttctttttgttgataatttctagtttgctcccttcgttattgccaactttactggcattttatttaatgatagcagattgggaaaatggcaaatttaggttacggaggtaaatgagtatatgaaagcaattacctctaaagccagttaacaattattttgtaggtggggtacactcagcttaaagtaatgcatttttttttcccgtaaaggcagaatccatcttgttgcagatagctatctaaataatctcatatcctcttttgcaaagactacagagaataggctatgacaatcttgttcaagcctttccatttttttccctgataactaagtaatttctttgaacataccaagaagtatgtaaaaagtccatggccttattcatccacaaagtggcatcctaggcccagccttatccctagcagttgtcccagtgctgctaggttgcttatcttgtttatctggaatcactgtggagtgaaattttccacatcatccagaattgccttatttaagaagtaaaacgttttaatttttagcctttttttggtggagttatttaatatgtatatcagaggatatactagatggtaacatttctttctgtgcttggctatctttgtggacttcaggggcttctaaaacagacaggactgtgttgcctttactaaatggtctgagacagctatggttttgaatttttagttttttttttttaacccacttcccctcctggtctcttccctctctgataattaccattcatatgtgagtgttagtgtgcctccttttagcattttcttcttctctttctgattcttcatttctgactgcctaggcaaggaaaccagataaccaaacttactagaacgttctttaaaacacaagtacaaactctgggacaggacccaagacactttcctgtgaagtgctgaaaaagacctcattgtattggcatttgatatcagtttgatgtagcttagagtgcttcctgattcttgctgagtttcaggtagttgagatagagagaagtgagtcatattcatattttcccccttagaataatattttgaaaggtttcattgcttccacttgaatgctgctcttacaaaaactggggttacaagggttactaaattagcatcagtagccagaggcaataccgttgtctggaggacaccagcaaacaacacacaacaaagcaaaacaaaccttgggaaactaaggccatttgttttgttttggtgtcccctttgaagccctgccttctggccttactcctgtacagatatttttgacctataggtgcctttatgagaattgagggtctgacatcctgccccaaggagtagctaaagtaattgctagtgttttcagggattttaacatcagactggaatgaatgaatgaaactttttgtcctttttttttctgtttttttttttctaatgtagtaaggactaaggaaaacctttggtgaagacaatcatttctctctgttgatgtggatacttttcacaccgtttatttaaatgctttctcaataggtccagagccagtgttcttgttcaacctgaaagtaatggctctgggttgggccagacagttgcactctctagtttgccctctgccacaaatttgatgtgtgacctttgggcaagtcatttatcttctctgggccttagttgcctcatctgtaaaatgagggagttggagtagattaattattccagctctgaaattctaagtgaccttggctaccttgcagcagttttggatttcttccttatctttgttctgctgtttgagggggctttttacttatttccatgttattcaaaggagactaggcttgatattttattactgttcttttatggacaaaaggttacatagtatgcccttaagacttaattttaaccaaaggcctagcaccaccttaggggctgcaataaacacttaacgcgcgtgcgcacgcgcgcgcgcacacacacacacacacacacacacacacacaggtcagagtttaaggctttcgagtcatgacattctagcttttgaattgcgtgcacacacacacgcacgcacacactctggtcagagtttattaaggctttcgagtcatgacattatagcttttgagttggtgtgtgtgacaccaccctcctaagtggtgtgtgcttgtaattttttttttcagtgaaaatggattgaaaacctgttgttaatgcttagtgatattatgctcaaaacaaggaaattcccttgaaccgtgtcaattaaactggtttatatgactcaagaaaacaataccagtagatgattattaactttattcttggctctttttaggtccattttgattaagtgacttttggctggatcattcagagctctcttctagcctacccttggatgagtacaattaatgaaattcatattttcaaggacctgggagccttccttggggctgggttgagggtggggggttggggagtcctggtagaggccagctttgtggtagctggagaggaagggatgaaaccagctgctgttgcaaaggctgcttgtcattgatagaaggactcacgggcttggattgattaagactaaacatggagttggcaaactttcttcaagtattgagttctgttcaatgcattggacatgtgatttaagggaaaagtgtgaatgcttatagatgatgaaaacctggtgggctgcagagcccagtttagaagaagtgagttgggggttggggacagatttggtggtggtatttcccaactgtttcctcccctaaattcagaggaatgcagctatgccagaagccagagaagagccactcgtagcttctgctttggggacaactggtcagttgaaagtcccaggagttcctttgtggctttctgtatacttttgcctggttaaagtctgtggctaaaaaatagtcgaacctttcttgagaactctgtaacaaagtatgtttttgattaaaagagaaagccaact

SEQ ID NO: 182124 - DNA, 8495 bp, Homo sapiens
  Payload ID: 15866
  Gene Symbol: SMAD4
  Gene Name: SMAD family member 4
  Uniprot ID: Q13485
  ENST ID: ENST00000398417
  CDS Start-End: 259-1917
aacaaaatccactcacacttgcaacgcctggcaaggctcttcaatatgtgattccttgactgtcctgtgcgtctctcgagtgtaaacacctctggggctcgtgattcggggctgccagaaagagaaggaaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacatacaaagttgaattctaggtttgatttttaagattttttttttcttttgcacttttgagtccaatctcagtgatgaggtaccttctactaaatgacaggcaacagccagttctattgggcagctttgtttttttccctcacactctaccgggacttccccatggacattgtgtatcatgtgtagagttggttttttttttttttaatttttattttactatagcagaaatagacctgattatctacaagatgataaatagattgtctacaggataaatagtatgaaataaaatcaaggattatctttcagatgtgtttacttttgcctggagaacttttagctatagaaacacttgtgtgatgatagtcctccttatatcacctggaatgaacacagcttctactgccttgctcagaaggtcttttaaatagaccatcctagaaaccactgagtttgcttatttctgtgatttaaacatagatcttgatccaagctacatgacttttgtctttaaataacttatctaccacctcatttgtactcttgattacttacaaattctttcagtaaacacctaattttcttctgtaaaagtttggtgatttaagttttattggcagttttataaaaagacatcttctctagaaattgctaactttaggtccattttactgtgaatgaggaataggagtgagttttagaataacagatttttaaaaatccagatgatttgattaaaaccttaatcatacattgacataattcattgcttcttttttttgagatatggagtcttgctgtgttgcccaggcaggagtgcagtggtatgatctcagctcactgcaacctctgcctcccgggttcaactgattctcctgcctcagcctccctggtagctaggattacaggtgcccgccaccatgcctggctaacttttgtagttttagtagagacggggttttgcctgttggccaggctggtcttgaactcctgacctcaagtgatccatccaccttggcctcccaaagtgctgggattacgggcgtgagccactgtccctggcctcattgttcccttttctactttaaggaaagttttcatgtttaatcatctggggaaagtatgtgaaaaatatttgttaagaagtatctctttggagccaagccacctgtcttggtttctttctactaagagccataaagtatagaaatacttctagttgttaagtgcttatatttgtacctagatttagtcacacgcttttgagaaaacatctagtatgttatgatcagctattcctgagagcttggttgttaatctatatttctatttcttagtggtagtcatctttgatgaataagactaaagattctcacaggtttaaaattttatgtctactttaagggtaaaattatgaggttatggttctgggtgggttttctctagctaattcatatctcaaagagtctcaaaatgttgaatttcagtgcaagctgaatgagagatgagccatgtacacccaccgtaagacctcattccatgtttgtccagtgcctttcagtgcattatcaaagggaatccttcatggtgttgcctttattttccggggagtagatcgtgggatatagtctatctcatttttaatagtttaccgcccctggtatacaaagataatgacaataaatcactgccatataaccttgctttttccagaaacatggctgttttgtattgctgtaaccactaaataggttgcctataccattcctcctgtgaacagtgcagatttacaggttgcatggtctggcttaaggagagccatacttgagacatgtgagtaaactgaactcatattagctgtgctgcatttcagacttaaaatccatttttgtggggcagggtgtggtgtgtaaaggggggtgtttgtaatacaagttgaaggcaaaataaaatgtcctgtctcccagatgatatacatcttattatttttaaagtttattgctaattgtaggaaggtgagttgcaggtatctttgactatggtcatctggggaaggaaaattttacattttactattaatgctccttaagtgtctatggaggttaaagaataaaatggtaaatgtttctgtgcctggtttgatggtaactggttaatagttactcaccattttatgcagagtcacattagttcacaccctttctgagagccttttgggagaagcagttttattctctgagtggaacagagttctttttgttgataatttctagtttgctcccttcgttattgccaactttactggcattttatttaatgatagcagattgggaaaatggcaaatttaggttacggaggtaaatgagtatatgaaagcaattacctctaaagccagttaacaattattttgtaggtggggtacactcagcttaaagtaatgcatttttttttcccgtaaaggcagaatccatcttgttgcagatagctatctaaataatctcatatcctcttttgcaaagactacagagaataggctatgacaatcttgttcaagcctttccatttttttccctgataactaagtaatttctttgaacataccaagaagtatgtaaaaagtccatggccttattcatccacaaagtggcatcctaggcccagccttatccctagcagttgtcccagtgctgctaggttgcttatcttgtttatctggaatcactgtggagtgaaattttccacatcatccagaattgccttatttaagaagtaaaacgttttaatttttagcctttttttggtggagttatttaatatgtatatcagaggatatactagatggtaacatttctttctgtgcttggctatctttgtggacttcaggggcttctaaaacagacaggactgtgttgcctttactaaatggtctgagacagctatggttttgaatttttagttttttttttttaacccacttcccctcctggtctcttccctctctgataattaccattcatatgtgagtgttagtgtgcctccttttagcattttcttcttctctttctgattcttcatttctgactgcctaggcaaggaaaccagataaccaaacttactagaacgttctttaaaacacaagtacaaactctgggacaggacccaagacactttcctgtgaagtgctgaaaaagacctcattgtattggcatttgatatcagtttgatgtagcttagagtgcttcctgattcttgctgagtttcaggtagttgagatagagagaagtgagtcatattcatattttcccccttagaataatattttgaaaggtttcattgcttccacttgaatgctgctcttacaaaaactggggttacaagggttactaaattagcatcagtagccagaggcaataccgttgtctggaggacaccagcaaacaacacacaacaaagcaaaacaaaccttgggaaactaaggccatttgttttgttttggtgtcccctttgaagccctgccttctggccttactcctgtacagatatttttgacctataggtgcctttatgagaattgagggtctgacatcctgccccaaggagtagctaaagtaattgctagtgttttcagggattttaacatcagactggaatgaatgaatgaaactttttgtcctttttttttctgtttttttttttctaatgtagtaaggactaaggaaaacctttggtgaagacaatcatttctctctgttgatgtggatacttttcacaccgtttatttaaatgctttctcaataggtccagagccagtgttcttgttcaacctgaaagtaatggctctgggttgggccagacagttgcactctctagtttgccctctgccacaaatttgatgtgtgacctttgggcaagtcatttatcttctctgggccttagttgcctcatctgtaaaatgagggagttggagtagattaattattccagctctgaaattctaagtgaccttggctaccttgcagcagttttggatttcttccttatctttgttctgctgtttgagggggctttttacttatttccatgttattcaaaggagactaggcttgatattttattactgttcttttatggacaaaaggttacatagtatgcccttaagacttaattttaaccaaaggcctagcaccaccttaggggctgcaataaacacttaacgcgcgtgcgcacgcgcgcgcgcacacacacacacacacacacacacacacacaggtcagagtttaaggctttcgagtcatgacattctagcttttgaattgcgtgcacacacacacgcacgcacacactctggtcagagtttattaaggctttcgagtcatgacattatagcttttgagttggtgtgtgtgacaccaccctcctaagtggtgtgtgcttgtaattttttttttcagtgaaaatggattgaaaacctgttgttaatgcttagtgatattatgctcaaaacaaggaaattcccttgaaccgtgtcaattaaactggtttatatgactcaagaaaacaataccagtagatgattattaactttattcttggctctttttaggtccattttgattaagtgacttttggctggatcattcagagctctcttctagcctacccttggatgagtacaattaatgaaattcatattttcaaggacctgggagccttccttggggctgggttgagggtggggggttggggagtcctggtagaggccagctttgtggtagctggagaggaagggatgaaaccagctgctgttgcaaaggctgcttgtcattgatagaaggactcacgggcttggattgattaagactaaacatggagttggcaaactttcttcaagtattgagttctgttcaatgcattggacatgtgatttaagggaaaagtgtgaatgcttatagatgatgaaaacctggtgggctgcagagcccagtttagaagaagtgagttgggggttggggacagatttggtggtggtatttcccaactgtttcctcccctaaattcagaggaatgcagctatgccagaagccagagaagagccactcgtagcttctgctttggggacaactggtcagttgaaagtcccaggagttcctttgtggctttctgtatacttttgcctggttaaagtctgtggctaaaaaatagtcgaacctttcttgagaactctgtaacaaagtatgtttttgattaaaagagaaagccaactaaatca

SEQ ID NO: 182125 - DNA, 544 bp, Homo sapiens
  Payload ID: 15866
  Gene Symbol: SMAD4
  Gene Name: SMAD family member 4
  ENST ID: ENST00000590061
  CDS Start-End: 124-544
atgctcagtggcttctcgacaagttggcagcaacaacacggccctggtcgtcgtcgccgctgcggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaa

SEQ ID NO: 182126 - DNA, 1371 bp, Homo sapiens
  Payload ID: 15866
  Gene Symbol: SMAD4
  Gene Name: SMAD family member 4
  ENST ID: ENST00000588745
  CDS Start-End: 1-1371
atggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaactcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactga

SEQ ID NO: 182127 - DNA, 582 bp, Homo sapiens
  Payload ID: 15866
  Gene Symbol: SMAD4
  Gene Name: SMAD family member 4
  ENST ID: ENST00000589941
  CDS Start-End: 221-582
aaaaactgcttctctgcatggggtttatgagttgagacagacatttatgtgaaagagataacaacagagggaggagcaagtcttcaatatcaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgactt

SEQ ID NO: 182128 - DNA, 779 bp, Homo sapiens
  Payload ID: 15866
  Gene Symbol: SMAD4
  Gene Name: SMAD family member 4
  ENST ID: ENST00000588860
  CDS Start-End: 400-779
aaaccagtgtcttgctgagactcttcccgttgctggcttcgaagaggcaagctgccatattgttagcttccctatggagagcaccacatggcaaggaacagagggggtctccagccaacagcctgcaaaggactaaggccctcagtcctgtagcctgcaaggaactgaatggtgccaacaaccacatgaacttggaagcagatcctttgttccagcctcactttgtagaggacccagctaagccatgcctggaatcctgactcagagaatctgttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctg

SEQ ID NO: 182129 - DNA, 568 bp, Homo sapiens
  Payload ID: 15866
  Gene Symbol: SMAD4
  Gene Name: SMAD family member 4
  ENST ID: ENST00000593223
  CDS Start-End: 1-249
tactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtaagtatgcttttcattcttttttaaaggtataatagttgatatttttatcttgatttactcagttgattagtttctttgagcagtaatagaaattaaagtttttttttactgggatgatgacatttttgaattggtaaaatctgttcttctgtaatagttgctttttgcctatgaccctgtttgcattctttttgtatcaaaaatggagtatgggatgaaggagaaaggggatgattattatattatactgttctatctcctccttttttgttgatgcttattataattctgcctcaccagccagggtgggttgtaatcactgaagtgcttggctttattctagtaaggaaa

SEQ ID NO: 182130 - DNA, 576 bp, Homo sapiens
  Payload ID: 15866
  Gene Symbol: SMAD4
  Gene Name: SMAD family member 4
  ENST ID: ENST00000589076
  CDS Start-End: 305-576
gagcgaccctccccgtcactcggagcgggaggcgggggcagccgggagaaaggaaagctgcgggggaaaagggccaaaccctgaaattacccggatgtggtccccgcgcgcgcatgctcagtggcttctcgacaagttggcagcaacaacacggccctggtcgtcgtcgccgctgcggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcc

SEQ ID NO: 182131 - DNA, 992 bp, Homo sapiens
  Payload ID: 15866
  Gene Symbol: SMAD4
  Gene Name: SMAD family member 4
  ENST ID: ENST00000591914
  CDS Start-End: 539-992
atgctcagtggcttctcgacaagttggcagcaacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcccgggagctcgaggcggtccggcccgcgcgggcagcggcgcggcgctgaggaggggcggcctggccgggacgcctcggggcgggggccgaggagctctccgggccgccggggaaagctacgggcccggtgcgtccgcggaccagcagcgcgggagagcggactcccctcgccaccgcccgagcccaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatg

SEQ ID NO: 182132 - DNA, 1306 bp, Homo sapiens
  Payload ID: 15866
  Gene Symbol: SMAD4
  Gene Name: SMAD family member 4
  ENST ID: ENST00000592186
  CDS Start-End: 1-963
atggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactga

SEQ ID NO: 182133 - DNA, 1648 bp, Homo sapiens
  Payload ID: 15866
  Gene Symbol: SMAD4
  Gene Name: SMAD family member 4
  ENST ID: ENST00000611848
  CDS Start-End: 1-661
ctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcaagttaaactcctgactatagacttttatgatggaaacacgtggcacccatcttccacgtctgaaggcataactagtgattcattcaacccctgttcttaacctcttcagtgtggtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattac

SEQ ID NO: 182134 - DNA, 548 bp, Homo sapiens
  Payload ID: 15867
  Gene Symbol: SMAD5
  Gene Name: SMAD family member 5
  ENST ID: ENST00000506223
  CDS Start-End: 307-548
agtagccaaaacagatttttggttgcagaactcgggcgaggatacttggggtatttggacgtttgccggcttcccaacagaatgttccggttctggtggtgatggcattggagaatggggcttaggcaagcctgtaggacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatgacgtcaatggccagcttgttttcttttactagtccagcagtaaagcgattgttgggctggaaacaaggtgatgaggaggagaaatgggcagaaaaggcagttgatgctttggtgaagaaactaaaaaagaaaaagggtgccatggaggaactggagaaagccttgagcagtccaggacagccgagtaaatgtgtcactattcccagatctttagatggacgcctgcaggtttctcacag

SEQ ID NO: 182135 - DNA, 847 bp, Homo sapiens
  Payload ID: 15867
  Gene Symbol: SMAD5
  Gene Name: SMAD family member 5
  ENST ID: ENST00000511116
  CDS Start-End: 445-847
ccgggtcctgggcgagcgggcgccgtgcgcgtgtcccgcggccgagctgctaataaagttgcagcgaggagaagcgcagcgacggcgtcgggagagcgcgcctagccggctcgcgaaaaggaagctgttgaagttattgaagtacctgttgctatattctaagaaattaaaatgtccagaaatctgcctctaaatgggatctcactatgttgctcagactggacgtgattgaactcctgggctcaagtgagtctcccgaataactgggattacaggacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatgacgtcaatggccagcttgttttcttttactagtccagcagtaaagcgattgttgggctggaaacaaggtgatgaggaggagaaatgggcagaaaaggcagttgatgctttggtgaagaaactaaaaaagaaaaagggtgccatggaggaactggagaaagccttgagcagtccaggacagccgagtaaatgtgtcactattcccagatctttagatggacgcctgcaggtttctcacagaaaaggcttaccccatgttatatattgtcgtgtttggcgctggccggatttgcagagtcatcatgagctaaagccgttggatatttgtgaatttccttttggatctaagcaaaaagaagtttgtatcaacccataccactataagagagtggagagtccag

SEQ ID NO: 182136 - DNA, 669 bp, Homo sapiens
  Payload ID: 15867
  Gene Symbol: SMAD5
  Gene Name: SMAD family member 5
  ENST ID: ENST00000507118
  CDS Start-End: 286-669
ccgggtcctgggcgagcgggcgccgtgcgcgtgtcccgcggccgagctgctaataaagttgcagcgaggagaagcgcagcgacggcgtcgggagagcgcgcctagccggctcgcgagacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatgacgtcaatggccagcttgttttcttttactagtccagcagtaaagcgattgttgggctggaaacaaggtgatgaggaggagaaatgggcagaaaaggcagttgatgctttggtgaagaaactaaaaaagaaaaagggtgccatggaggaactggagaaagccttgagcagtccaggacagccgagtaaatgtgtcactattcccagatctttagatggacgcctgcaggtttctcacagaaaaggcttaccccatgttatatattgtcgtgtttggcgctggccggatttgcagagtcatcatgagctaaagccgttggatatttgtgaatttccttttggatctaagcaaaaagaagtttgtatcaacccataccactat

SEQ ID NO: 182137 - DNA, 854 bp, Homo sapiens
  Payload ID: 15867
  Gene Symbol: SMAD5
  Gene Name: SMAD family member 5
  ENST ID: ENST00000509297
  CDS Start-End: 59-61
tgataggactgcggtgctcggccgggcagcctgggctgctgcactgcgaagctgtccaatggcttgatgaatccgtgccgccgtcgctttgtgtttcaaagataaggatccgcgcttatcggtgggaattacactctgggcagttgtgaccggctactgcaatcagctggtagttagacctggtttctgccacttgccatgtcagttttcaccactgcaaggatttcttctacttcatgtaaacttctctgtgctgcaaagagaatgccaaagcagcgtctttttgccttcaccatattcagccgctggccgggtcctatacttcaatatcagggctcaaattaatattccagtctcttcccctccccttttcccctctcctcctttcagctgctgttactacgtggagtttggagcctaagctttgaaaactcccatgtggcgcgcccgtcttaagtctgagcatgctcagtagccaaaacagatttttggttgcagaactcgggcgaggatacttggggtatttggacgtttgccggcttcccaacagaatgttccggttctggtggtgatggcattggagaatggggcttaggcaagcctgtagaaaggaagctgttgaagttattgaagtacctgttgctatattctaagaaattaaaatgtccagaaatctgcctctgacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatg

SEQ ID NO: 182138 - DNA, 368 bp, Homo sapiens
  Payload ID: 15867
  Gene Symbol: SMAD5
  Gene Name: SMAD family member 5
  ENST ID: ENST00000515005
  CDS Start-End: 59-61
tgataggactgcggtgctcggccgggcagcctgggctgctgcactgcgaagctgtccaatggcttgatgaatccgtgccgccgtcgctttgtgtttcaaagataaggatccgcgcttatcgaaaggaagctgttgaagttattgaagtacctgttgctatattctaagaaattaaaatgtccagaaatctgcctctgacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatg

SEQ ID NO: 182139 - DNA, 638 bp, Homo sapiens
  Payload ID: 15867
  Gene Symbol: SMAD5
  Gene Name: SMAD family member 5
  ENST ID: ENST00000507637
  CDS Start-End: 1-523
ccagcccaacaacactccttttcccttatctccaaacagcccttatcccccttctcctgctagcagcacatatcccaactccccagcaagttctggaccaggaagtccatttcagctcccagctgatacgcctcctcctgcctatatgccacctgatgatcagatgggtcaagataattcccagcctatggatacaagcaataatatgattcctcagattatgcccagtatatccagcagggatgttcagcctgttgcctatgaagagcctaaacattggtgttcaatagtctactatgaattaaacaatcgtgttggagaagcttttcatgcatcttctactagtgtgttagtagatggattcacagatccttcaaataacaaaagtagattctgcttgggtttgttgtcaaatgttaatcgtaattcgacaattgaaaacactaggcgacatattggaaaaggtaatcttgtcattttcctacatttaatcgaattcaatcatttgttgtacttgccatgaaccatgcattgtgaaaggtgctagaaacatacaaagaagtttgacacgtggcctctgccttaagttgccgatattgaagaatgtattaatcaaataaagacatgatgttccctca

SEQ ID NO: 182140 - DNA, 523 bp, Homo sapiens
  Payload ID: 15867
  Gene Symbol: SMAD5
  Gene Name: SMAD family member 5
  ENST ID: ENST00000513418
  CDS Start-End: 1-182
atggctttcatcccaccactgtctgtaagattcccagcagctgcagcctcaaaatttttaacaatcaggagtttgctcagcttctggctcaatctgtcaaccatgggtttgaggcagtatatgagctcaccaaaatgtgtaccattcggatgagttttgtcaagtctctgcaggagatatagtaataactgaagtgttacacaggtggagacgggaaacgttagttgctaagaactttggattaccaccgctaggaaaccagccacttggaagaccaatcaataaaggagtgttcaactcaatatttcacctgatacaagatgatgaaacgggctatcagaaatacagaaataacgatgaaggcatggagtggatgatcaagctcaggtcattggctccagaactcagactcttggtcaccactatgctacctctccttgactcctagcatctgcagctacctccccaccgtgatctccagcctctcccccaacccccaccaacaaaaatgcgttaacctcaa

SEQ ID NO: 182141 - DNA, 7012 bp, Homo sapiens
  Payload ID: 15867
  Gene Symbol: SMAD5
  Gene Name: SMAD family member 5
  Uniprot ID: Q99717
  ENST ID: ENST00000545279
  CDS Start-End: 363-1760
atccgggtcctgggcgagcgggcgccgtgcgcgtgtcccgcggccgagctgctaataaagttgcagcgaggagaagcgcagcgacggcgtcgggagagcgcgcctagccggctcgcgaaaaggaagctgttgaagttattgaagtacctgttgctatattctaagaaattaaaatgtccagaaatctgcctctgacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatgacgtcaatggccagcttgttttcttttactagtccagcagtaaagcgattgttgggctggaaacaaggtgatgaggaggagaaatgggcagaaaaggcagttgatgctttggtgaagaaactaaaaaagaaaaagggtgccatggaggaactggagaaagccttgagcagtccaggacagccgagtaaatgtgtcactattcccagatctttagatggacgcctgcaggtttctcacagaaaaggcttaccccatgttatatattgtcgtgtttggcgctggccggatttgcagagtcatcatgagctaaagccgttggatatttgtgaatttccttttggatctaagcaaaaagaagtttgtatcaacccataccactataagagagtggagagtccagtcttacctccagtattagtgcctcgtcataatgaattcaatccacaacacagccttctggttcagtttaggaacctgagccacaatgaaccacacatgccacaaaatgccacgtttccagattctttccaccagcccaacaacactccttttcccttatctccaaacagcccttatcccccttctcctgctagcagcacatatcccaactccccagcaagttctggaccaggaagtccatttcagctcccagctgatacgcctcctcctgcctatatgccacctgatgatcagatgggtcaagataattcccagcctatggatacaagcaataatatgattcctcagattatgcccagtatatccagcagggatgttcagcctgttgcctatgaagagcctaaacattggtgttcaatagtctactatgaattaaacaatcgtgttggagaagcttttcatgcatcttctactagtgtgttagtagatggattcacagatccttcaaataacaaaagtagattctgcttgggtttgttgtcaaatgttaatcgtaattcgacaattgaaaacactaggcgacatattggaaaaggtgttcatctgtactatgttggtggagaggtgtatgcggaatgcctcagtgacagcagcatatttgtacagagtaggaactgcaactttcatcatggctttcatcccaccactgtctgtaagattcccagcagctgcagcctcaaaatttttaacaatcaggagtttgctcagcttctggctcaatctgtcaaccatgggtttgaggcagtatatgagctcaccaaaatgtgtaccattcggatgagttttgtcaagggttggggagcagaatatcaccggcaggatgtaaccagcaccccatgttggattgagattcatcttcatgggcctcttcagtggctggataaagtccttactcagatgggctcccctctgaaccccatatcttctgtttcataatgcagaagtattcttttcaattatattgttagtggacttgttttaattttagagaaactttgagtacagatactgtgagcttacattgaaaacagatattacagcttatttttttctacataattgtgaccaatacatttgtattttgtgatgaatctacatttgtttgtattcatgttcatgtgattaactcttagaagtgttgtaaaagatgcagagtaagtattatgccccagttcagaaatttggcattgatcttaaactggaacatgcttttactttattgccctaacaattttttattaaatttatttgaaaatgcatcacatgatgaaaaattatagtagcttataagagggcatatacagtgaagagtaagttttccctcctactctcgatcttccagaagctgtacttttaccagtttctttgtcccaccaacttaaaaaaaaaaagtacaattcattgttttgcaaaagtgtatggtaggggcttaaaagaaactataaagttttatttgaatgaacactatgcactgctgtaactggtagtgttcagtaaaagcaaaatgatagttttctagatgacataaaatttacatttaatacagataagtgttcttcagtgtaatgtgacttcatgctatatatcttttgtaagacatttccttttttaaaaaaatttttgcaaataactgatctcaagtatatgtcatttactcaaaatctgtcataagcattactttatagctagtgacagtgcatgcacagccttgttcaactatgtttgctgcttttggacaatgttgcaagaactctatttttgacatgcattaatcttttattttgcacttttatgggtgacagtttttagcataacctttgataaaatacactcaagtgacttggacttagatgcttatccttacgtccttggtaccttttttgtattaacaaacactgcaatttatagattacatttgtaggaagttatgcttttttctggtttttgttttactttcaacctaggttataagactgttattctatagctccaacttaaggtgcctttttaattccctacagttttatgggtgttatcagtgctggagaatcatgtagttaatcccattgctcttacaagtgtcagcttacttgtatcagcctccctacgcaaggacctatgcactggagccgtaggaggctcttcagttgggccccaaggataaggctactgatttgatactaaatgaatcagcagtggatgtagggatagctgattttaaaacactcggctgggcacagtggctcacacctgtaatcccagcactttgggaggctgaggcaggcagatcatgatgtcaggagtttgagaccagcctggccaatatggtgaaaccctgtctctacaaaaaatacaaaaattagctgggcatggtggtgcgtgcctgaagtcccagctactcgggaagctgaggcagaagaatcacttgaacctgggaggcggaggttgtggtgagccgagatcgcaccactgcactccagcctgggcgacagagcgagactctgcctcaaaaaacaaaacaaaacaaaacactcacccatcaacgaatatagactcttctctcatttatcgatgatcctctttttccattttttaagtacttatgtggaagctagtctcccaaaacacaatctttagagagaaaagacatgaacgaactccaaaatatccatttaatcaatcatgtttttggctttggataaagaactttgaaccagtttttttctcaggagctgtcaaatggacacttaattatgacatgagaatgaagaaattattttggaaaaaaaaaatgacctaatttacctatcagtgaaagctttattttctggtgccttttgaaagtatatggagtcatatcattcttctgtttaaaatgttagtttggtttgactttccactttgtcctttctgctcttgtgaagaaaaaaaaaagcattttcgaggaaagaattatgcaatttcttttgttttctgtgtcattatttattgctttttcaatgtgcagccagtggatggttttagttctttcagatgaactgccatttgtgtttcagctcacagttctttgctgggtaaaagaaatactttctgacagtcacctgagccttaaatgtaagtattacatgacatgcattctgtttcttccagagttctgtctgccacacgaaagagaatatttgcttacttgatagaactttggcattttcatcattcttttacttaaccaggcttatggcatgatctctggaacaaatttgtaggaaaaaattactccaattgaatgactgatgtatgtaatcaacttcattgggctgcagtaaactagtggaaattagagagttgttttattggtgttttctactgtgagttaattaaaaattgtttttatttggggtcattatgtcacagtcttgagttaacaagatcttacgtgattggccttttctttgttttctcttaggagttgtgtctcatgaatgacagtactaaagctattaacaactaagagtttgacagagaactataagcctgttgtatctcctaaaagttgtcaactccccacccttggactttaaatgaaaattttattcagtccagctattcttacagtccctaaggattttcatatatctatgtataggagataaaatttgctagtaagatttttaaaaactggctagtgaaaggaaagtacctctgaaagaaaccattttagcaaattatggttatatgttttaatttaatctacagaatgttttatagtaaaattctagcaccactagaataatcacatagcatgtacaatatatttatgctggctgaaaagacagaatctgggaataataaaattgcaaccagtttggtaatgcaaacagcagaatagaatgaaatctcagtaatgaattaaagcaacaaaaagatattgattggcaaaaagcaagatataagagattcatttgcttaacatttctacataatatttatggtctggtcagtattggtctggtcagtattgcctggctgacgtgaaatgtaaactagtaggcgtgttattgatctgctaaaactaaccctctttttaagaggagatttaaggaagacgtcaatcaaaatgtcaaatatgtgtgtcagaatataaataatttttcacattgtattgttgctatataaaaaaaataatagaattggttgggtttctgaggtgaaatccagagtaagagtactagacagttcaacaagccacatctaatggcacagatagaggatgtagctattttatacctttcataacatttgagagtaagatatccttcaggatgtgaagtgattattaagtactcatacctgaaatctgttgtcaagattagaactggggttcatgttaaaaaccttccatattacctgagggtacctgtggggaacagttccttcccctgtgtggtagtattttgttggaagagaatgtttatacaaaaaatgaaattcttccaacagcagagaaactctaaaaagtttgatagtacctatcaaagtgctgtacttctgtgatagagaacatctgatgtaccaatttagatctatttctttatactttttctaatcaattgcttaatagtactttggatgattatcacctttgccacttaaaatatataaatatcctttttacttcatgaggaaggaagaattttttgataattactgagttcagccttttgtgatgacttatattttggacttacattttaactttaaagaatgtcagatcccttctttgtcttactagttaaatcctcacctaatctcttgggtatgaatataaatgtgtgtcatcgttatattgttcagctagatgagcaagtatcttagggtagtaggtagcctggtggttttagaagtgtttggtgatttttatggagagagttttcctaagtggtggtttataggtggtatcagatattattagggcagctttttggggagtaatctcaggtctcccagagcagcagcatttttctcattgatataagtaagattcttaggagcttttcttatcacacaagatgcctgaatcgaatgtgagaattgaaggcatttcttctgcataaacaaagaattctacctgctggacagaaacctggaaagttctttggaattcgctgaattacagtttagtatgtcctgattacagagtgacaatatttatcaagcctttgttatattggattatcttctctcttaaaatacaactgtattataattgaaatgacagcccaaaattggatggtttaccaaaaccaatgaaagggatttcacacatcaatttttatttctgttttgaagagcacatgctatataataattgctagtagcaactgcagtaaaacaggtgataagttattttctctgaaaagatccagtcctagagcaggattcttcgatcattcatggcagagtgaaaaaggtttgtatggttcttgtccaaataactcagttcttaaaattcttaaaatgatcgtaaaccattatcctttaaaggtttatttgaagatgctgttaaagtacagaattttgtgtacaggtagatttttccgtccctcattaatagtgccttcttaattaatacagactggtgttagctataacaaaactccagtaaggccaaagaatcccaagttctttgtggaaaaaaaaaaaaaatcttttagggtcagattttcccttctaatatcattgaagatgatgttgcattgatttattcataaagtattttaactataggaactctagaagataatggttaggcaagtgattttttttttaaatatggttggcgtaagttgtattttgaaattcacttattttaaaatcgaagaggattgtaatcatggaaatagaatgtttgtatctacctgcccacattttcttaaaaagatatttcatatacagataatgaagaccaagctagtggctgcactgtaggtctgctgcttatttgtatttgttgtgcttctgtttatgttgtagaagctgaaattctagcaacatgcttcaattctgttattttgatacttatgaaaatgtattaggttttactatattgtgcttttgaaagccataactcttaagaactttgtttttgcatattgtttgctaattctttactttaataaacctcaaaacct

SEQ ID NO: 182142 - DNA, 6937 bp, Homo sapiens
  Payload ID: 15867
  Gene Symbol: SMAD5
  Gene Name: SMAD family member 5
  Uniprot ID: Q99717
  ENST ID: ENST00000545620
  CDS Start-End: 286-1683
ccgggtcctgggcgagcgggcgccgtgcgcgtgtcccgcggccgagctgctaataaagttgcagcgaggagaagcgcagcgacggcgtcgggagagcgcgcctagccggctcgcgagacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatgacgtcaatggccagcttgttttcttttactagtccagcagtaaagcgattgttgggctggaaacaaggtgatgaggaggagaaatgggcagaaaaggcagttgatgctttggtgaagaaactaaaaaagaaaaagggtgccatggaggaactggagaaagccttgagcagtccaggacagccgagtaaatgtgtcactattcccagatctttagatggacgcctgcaggtttctcacagaaaaggcttaccccatgttatatattgtcgtgtttggcgctggccggatttgcagagtcatcatgagctaaagccgttggatatttgtgaatttccttttggatctaagcaaaaagaagtttgtatcaacccataccactataagagagtggagagtccagtcttacctccagtattagtgcctcgtcataatgaattcaatccacaacacagccttctggttcagtttaggaacctgagccacaatgaaccacacatgccacaaaatgccacgtttccagattctttccaccagcccaacaacactccttttcccttatctccaaacagcccttatcccccttctcctgctagcagcacatatcccaactccccagcaagttctggaccaggaagtccatttcagctcccagctgatacgcctcctcctgcctatatgccacctgatgatcagatgggtcaagataattcccagcctatggatacaagcaataatatgattcctcagattatgcccagtatatccagcagggatgttcagcctgttgcctatgaagagcctaaacattggtgttcaatagtctactatgaattaaacaatcgtgttggagaagcttttcatgcatcttctactagtgtgttagtagatggattcacagatccttcaaataacaaaagtagattctgcttgggtttgttgtcaaatgttaatcgtaattcgacaattgaaaacactaggcgacatattggaaaaggtgttcatctgtactatgttggtggagaggtgtatgcggaatgcctcagtgacagcagcatatttgtacagagtaggaactgcaactttcatcatggctttcatcccaccactgtctgtaagattcccagcagctgcagcctcaaaatttttaacaatcaggagtttgctcagcttctggctcaatctgtcaaccatgggtttgaggcagtatatgagctcaccaaaatgtgtaccattcggatgagttttgtcaagggttggggagcagaatatcaccggcaggatgtaaccagcaccccatgttggattgagattcatcttcatgggcctcttcagtggctggataaagtccttactcagatgggctcccctctgaaccccatatcttctgtttcataatgcagaagtattcttttcaattatattgttagtggacttgttttaattttagagaaactttgagtacagatactgtgagcttacattgaaaacagatattacagcttatttttttctacataattgtgaccaatacatttgtattttgtgatgaatctacatttgtttgtattcatgttcatgtgattaactcttagaagtgttgtaaaagatgcagagtaagtattatgccccagttcagaaatttggcattgatcttaaactggaacatgcttttactttattgccctaacaattttttattaaatttatttgaaaatgcatcacatgatgaaaaattatagtagcttataagagggcatatacagtgaagagtaagttttccctcctactctcgatcttccagaagctgtacttttaccagtttctttgtcccaccaacttaaaaaaaaaaagtacaattcattgttttgcaaaagtgtatggtaggggcttaaaagaaactataaagttttatttgaatgaacactatgcactgctgtaactggtagtgttcagtaaaagcaaaatgatagttttctagatgacataaaatttacatttaatacagataagtgttcttcagtgtaatgtgacttcatgctatatatcttttgtaagacatttccttttttaaaaaaatttttgcaaataactgatctcaagtatatgtcatttactcaaaatctgtcataagcattactttatagctagtgacagtgcatgcacagccttgttcaactatgtttgctgcttttggacaatgttgcaagaactctatttttgacatgcattaatcttttattttgcacttttatgggtgacagtttttagcataacctttgataaaatacactcaagtgacttggacttagatgcttatccttacgtccttggtaccttttttgtattaacaaacactgcaatttatagattacatttgtaggaagttatgcttttttctggtttttgttttactttcaacctaggttataagactgttattctatagctccaacttaaggtgcctttttaattccctacagttttatgggtgttatcagtgctggagaatcatgtagttaatcccattgctcttacaagtgtcagcttacttgtatcagcctccctacgcaaggacctatgcactggagccgtaggaggctcttcagttgggccccaaggataaggctactgatttgatactaaatgaatcagcagtggatgtagggatagctgattttaaaacactcggctgggcacagtggctcacacctgtaatcccagcactttgggaggctgaggcaggcagatcatgatgtcaggagtttgagaccagcctggccaatatggtgaaaccctgtctctacaaaaaatacaaaaattagctgggcatggtggtgcgtgcctgaagtcccagctactcgggaagctgaggcagaagaatcacttgaacctgggaggcggaggttgtggtgagccgagatcgcaccactgcactccagcctgggcgacagagcgagactctgcctcaaaaaacaaaacaaaacaaaacactcacccatcaacgaatatagactcttctctcatttatcgatgatcctctttttccattttttaagtacttatgtggaagctagtctcccaaaacacaatctttagagagaaaagacatgaacgaactccaaaatatccatttaatcaatcatgtttttggctttggataaagaactttgaaccagtttttttctcaggagctgtcaaatggacacttaattatgacatgagaatgaagaaattattttggaaaaaaaaaatgacctaatttacctatcagtgaaagctttattttctggtgccttttgaaagtatatggagtcatatcattcttctgtttaaaatgttagtttggtttgactttccactttgtcctttctgctcttgtgaagaaaaaaaaaagcattttcgaggaaagaattatgcaatttcttttgttttctgtgtcattatttattgctttttcaatgtgcagccagtggatggttttagttctttcagatgaactgccatttgtgtttcagctcacagttctttgctgggtaaaagaaatactttctgacagtcacctgagccttaaatgtaagtattacatgacatgcattctgtttcttccagagttctgtctgccacacgaaagagaatatttgcttacttgatagaactttggcattttcatcattcttttacttaaccaggcttatggcatgatctctggaacaaatttgtaggaaaaaattactccaattgaatgactgatgtatgtaatcaacttcattgggctgcagtaaactagtggaaattagagagttgttttattggtgttttctactgtgagttaattaaaaattgtttttatttggggtcattatgtcacagtcttgagttaacaagatcttacgtgattggccttttctttgttttctcttaggagttgtgtctcatgaatgacagtactaaagctattaacaactaagagtttgacagagaactataagcctgttgtatctcctaaaagttgtcaactccccacccttggactttaaatgaaaattttattcagtccagctattcttacagtccctaaggattttcatatatctatgtataggagataaaatttgctagtaagatttttaaaaactggctagtgaaaggaaagtacctctgaaagaaaccattttagcaaattatggttatatgttttaatttaatctacagaatgttttatagtaaaattctagcaccactagaataatcacatagcatgtacaatatatttatgctggctgaaaagacagaatctgggaataataaaattgcaaccagtttggtaatgcaaacagcagaatagaatgaaatctcagtaatgaattaaagcaacaaaaagatattgattggcaaaaagcaagatataagagattcatttgcttaacatttctacataatatttatggtctggtcagtattggtctggtcagtattgcctggctgacgtgaaatgtaaactagtaggcgtgttattgatctgctaaaactaaccctctttttaagaggagatttaaggaagacgtcaatcaaaatgtcaaatatgtgtgtcagaatataaataatttttcacattgtattgttgctatataaaaaaaataatagaattggttgggtttctgaggtgaaatccagagtaagagtactagacagttcaacaagccacatctaatggcacagatagaggatgtagctattttatacctttcataacatttgagagtaagatatccttcaggatgtgaagtgattattaagtactcatacctgaaatctgttgtcaagattagaactggggttcatgttaaaaaccttccatattacctgagggtacctgtggggaacagttccttcccctgtgtggtagtattttgttggaagagaatgtttatacaaaaaatgaaattcttccaacagcagagaaactctaaaaagtttgatagtacctatcaaagtgctgtacttctgtgatagagaacatctgatgtaccaatttagatctatttctttatactttttctaatcaattgcttaatagtactttggatgattatcacctttgccacttaaaatatataaatatcctttttacttcatgaggaaggaagaattttttgataattactgagttcagccttttgtgatgacttatattttggacttacattttaactttaaagaatgtcagatcccttctttgtcttactagttaaatcctcacctaatctcttgggtatgaatataaatgtgtgtcatcgttatattgttcagctagatgagcaagtatcttagggtagtaggtagcctggtggttttagaagtgtttggtgatttttatggagagagttttcctaagtggtggtttataggtggtatcagatattattagggcagctttttggggagtaatctcaggtctcccagagcagcagcatttttctcattgatataagtaagattcttaggagcttttcttatcacacaagatgcctgaatcgaatgtgagaattgaaggcatttcttctgcataaacaaagaattctacctgctggacagaaacctggaaagttctttggaattcgctgaattacagtttagtatgtcctgattacagagtgacaatatttatcaagcctttgttatattggattatcttctctcttaaaatacaactgtattataattgaaatgacagcccaaaattggatggtttaccaaaaccaatgaaagggatttcacacatcaatttttatttctgttttgaagagcacatgctatataataattgctagtagcaactgcagtaaaacaggtgataagttattttctctgaaaagatccagtcctagagcaggattcttcgatcattcatggcagagtgaaaaaggtttgtatggttcttgtccaaataactcagttcttaaaattcttaaaatgatcgtaaaccattatcctttaaaggtttatttgaagatgctgttaaagtacagaattttgtgtacaggtagatttttccgtccctcattaatagtgccttcttaattaatacagactggtgttagctataacaaaactccagtaaggccaaagaatcccaagttctttgtggaaaaaaaaaaaaaatcttttagggtcagattttcccttctaatatcattgaagatgatgttgcattgatttattcataaagtattttaactataggaactctagaagataatggttaggcaagtgattttttttttaaatatggttggcgtaagttgtattttgaaattcacttattttaaaatcgaagaggattgtaatcatggaaatagaatgtttgtatctacctgcccacattttcttaaaaagatatttcatatacagataatgaagaccaagctagtggctgcactgtaggtctgctgcttatttgtatttgttgtgcttctgtttatgttgtagaagctgaaattctagcaacatgcttcaattctgttattttgatacttatgaaaatgtattaggttttactatattgtgcttttgaaagccataactcttaagaactttgtttttgcatattgtttgctaattctttactttaataaacctcaaaacctgc

SEQ ID NO: 182143 - DNA, 3835 bp, Homo sapiens
  Payload ID: 15868
  Gene Symbol: SMAD6
  Gene Name: SMAD family member 6
  Uniprot ID: O43541
  ENST ID: ENST00000288840
  CDS Start-End: 1032-2522
agactggcatatgatgggaggcagccaatgactccgcggcgctcctccgggggccctcagtgtgcgtttgaggagaacaaaaaagagagagagagccgagcgggggagcgatcgagggagctgagccgagagaaagagccgccgggcgctgcctcgccagacctcgctgggaccccggggccaccgggaggcacttttgtggaggggggagggggggcgacctcggcagcctcggcgcacgaagcgtccgagggcagcgtggggcgggctgcgacctctgcatcggtggactgcatttttaattaaggattcccagcagctctttgggatttttacagcttccactcatgtgttgacacccgcgtccaggagaaactcgctccaagtgcatctagcgcctgggacctgagacggcgttggcctttcgtgcatgcaaatccagggatttaggttttgtttgggatttccttttctttctttccttttttttttctttttgcagggagtaagaagggagctgggggtatcaacaagcctgcctttcggatcctgcgggaaaagcccatgtagttaagcgctttggtttaaaaaaaaggcaaggtaaaggcagggctttccagacacatttaggggttcgcgcgagcgctttgtgctcatggaccagccgcacaacttttgaaggctcgccggcccatgtggggtctttctggcggcgcgccgcctgcagcccccctaaagcgcgggggctggagttgttgagcagccccgccgctgtggtccatgtagccgctggccgcgcgcggactgcggctcggcgtgcgcgtgttcccggccgtcccgcctcggcgagctccctcatgttgtcgccctgcggcgccccttcgacgacaggctgtgcgcggtctgcacggcgctccgcggcggagcttcatgtggggctgcgacccgcgcagccggcgcctcgctgagggaacggacccccggtaaccggagaccgcctcccccccacccctggcgccaaaggatatcgtatgttcaggtccaaacgctcggggctggtgcggcgactttggcgaagtcgtgtggtccccgaccgggaggaaggcggcagcggcggcggcggtggcggcgacgaggatgggagcttgggcagccgagctgagccggccccgcgggcaagagagggcggaggctgcggccgctccgaagtccgcccggtagccccgcggcggccccgggacgcagtgggacagcgaggcgcccagggcgcggggaggcgccggcgcgcagggggccccccgaggcccatgtcggagccaggggccggcgctgggagctccctgctggacgtggcggagccgggaggcccgggctggctgcccgagagtgactgcgagacggtgacctgctgtctcttttcggagcgggacgccgccggcgcgccccgggacgccagcgaccccctggccggggcggccctggagccggcgggcggcgggcggagtcgcgaagcgcgctcgcggctgctgctgctggagcaggaactcaaaaccgtcacgtactcgctgctgaagcggctcaaggagcgctcgctggacacgctgctggaggcggtggagtcccgcggcggcgtgccgggcggctgcgtgctggtgccgcgcgccgacctccgcctgggcggccagcccgcgccgccgcagctgctgctcggccgcctctttcgctggcccgacctgcagcacgccgtggagctgaagcccctgtgcggctgccacagcttcgccgccgccgccgacggccctaccgtgtgctgcaacccctaccacttcagccggctctgcgggcccgaatctccgccacctccctactctcggctgtctcctcgcgacgagtacaagccactggatctgtccgattccacattgtcttacactgaaacggaggctaccaactccctcatcactgctccgggtgaattctcagacgccagcatgtctccggacgccaccaagccgagccactggtgcagcgtggcgtactgggagcaccggacgcgcgtgggccgcctctatgcggtgtacgaccaggccgtcagcatcttctacgacctacctcagggcagcggcttctgcctgggccagctcaacctggagcagcgcagcgagtcggtgcggcgaacgcgcagcaagatcggcttcggcatcctgctcagcaaggagcccgacggcgtgtgggcctacaaccgcggcgagcaccccatcttcgtcaactccccgacgctggacgcgcccggcggccgcgccctggtcgtgcgcaaggtgccccccggctactccatcaaggtgttcgacttcgagcgctcgggcctgcagcacgcgcccgagcccgacgccgccgacggcccctacgaccccaacagcgtccgcatcagcttcgccaagggctgggggccctgctactcccggcagttcatcacctcctgcccctgctggctggagatcctcctcaacaaccccagatagtggcggccccggcgggaggggcgggtgggaggccgcggccaccgccacctgccggcctcgagaggggccgatgcccagagacacagcccccacggacaaaaccccccagatatcatctacctagatttaatataaagttttatatattatatggaaatatatattatacttgtaattatggagtcatttttacaatgtaattatttatgtatggtgcaatgtgtgtatatggacaaaacaagaaagacgcactttggcttataattctttcaatacagatatattttctttctcttcctccttcctcttccttactttttatatatatatataaagaaaatgatacagcagagctaggtggaaaagcctgggtttggtgtatggtttttgagatattaatgcccagacaaaaagctaataccagtcactcgataataaagtattcgcattatagttttttttaaactgtcttctttttacaaagaggggcaggtagggcttcagcggatttctgacccatcatgtaccttgaaacttgacctcagttttcaagttttacttttattggataaagacagaacaaattgaaaagggaggaaagtcacatttactcttaagtaaaccagagaaagttctgttgttccttcctgcccatggctatggggtgtccagtggatagggatggcggtggggaaaagaatacactggccatttatcctggacaagctcttccagtctgatggaggaggttcatgccctagcctagaaaggcccaggtccatgccccccatctttgagttatgagcaagctaaaagaagacactatttctcaccattttgtggaaatggcctggggaacaaagactgaaatgggccttgagcccacctgctaccttgcagagaaccatctcgagccccgtagatctttttaggacctccacaggctatttcccaccccccagccaaaaatagctcagaatctgcccatccagggctgtattaatgatttatgtaaaggcagatggtttatttctactttgtgaaagggaaaagttgaggttctggaaggttaaatgatttgctcatgagacaaaatcaaggttagaagttacatggaattgtaggaccagagccatatcattagatcagctttctgaagaatattctcaaaaaaagaaagtctccttggccagataactaagaggaatgtttcattgtatatcttttttcttggagatttatattaacatattaagtgctctgagaagtcctgtgtattatctcttgctgcataataaattatccccaaactt

SEQ ID NO: 182144 - DNA, 632 bp, Homo sapiens
  Payload ID: 15868
  Gene Symbol: SMAD6
  Gene Name: SMAD family member 6
  ENST ID: ENST00000558937
  CDS Start-End: 1-168
tctcctcgcgacgagtacaagccactggatctgtccgattccacattgtcttacactgaaacggaggctaccaactccctcatcactgctccgggtgaattctcagcagatgctgggataggaagccgagggaaccgtggtttggagtcctctgtcccctgcagttagaagctggtcatagggacccctacatccggaggaatacctgaatcaaactttccttgagaaatgagaggttggtgttggactggggacatcgagggccaggaccaaggtctgtggggccctttgggagcatggctggtggcatggtggcctggtggcatgctggctgggactgacagcccctcaggctggggctgcataccttgtgggcatgtctggatggctgtgtgtctccatctgagacattcttccctcaccccacatccatgccatggtagcagtcgccaaaatcatagccatttattgagtgtatgctatggccggcactccacttggccgctttatatgcattctcttgggacagccatgggctgtttgtctccagggtttgtgctcttcatcactgttttgtcccccacttttctgcaagggccaaatgtaccttcaataaatgtatttcccctaaa

SEQ ID NO: 182145 - DNA, 1401 bp, Homo sapiens
  Payload ID: 15868
  Gene Symbol: SMAD6
  Gene Name: SMAD family member 6
  Uniprot ID: O43541
  ENST ID: ENST00000557916
  CDS Start-End: 1-1017
atgttcaggtccaaacgctcggggctggtgcggcgactttggcgaagtcgtgtggtccccgaccgggaggaaggcggcagcggcggcggcggtggcggcgacgaggatgggagcttgggcagccgagctgagccggccccgcgggcaagagagggcggaggctgcggccgctccgaagtccgcccggtagccccgcggcggccccgggacgcagtgggacagcgaggcgcccagggcgcggggaggcgccggcgcgcagggggccccccgaggcccatgtcggagccaggggccggcgctgggagctccctgctggacgtggcggagccgggaggcccgggctggctgcccgagagtgactgcgagacggtgacctgctgtctcttttcggagcgggacgccgccggcgcgccccgggacgccagcgaccccctggccggggcggccctggagccggcgggcggcgggcggagtcgcgaagcgcgctcgcggctgctgctgctggagcaggaactcaaaaccgtcacgtactcgctgctgaagcggctcaaggagcgctcgctggacacgctgctggaggcggtggagtcccgcggcggcgtgccgggcggctgcgtgctggtgccgcgcgccgacctccgcctgggcggccagcccgcgccgccgcagctgctgctcggccgcctctttcgctggcccgacctgcagcacgccgtggagctgaagcccctgtgcggctgccacagcttcgccgccgccgccgacggccctaccgtgtgctgcaacccctaccacttcagccggctctgcgggcccgaatctccgccacctccctactctcggctgtctcctcgcgacgagtacaagccactggatctgtccgattccacattgtcttacactgaaacggaggctaccaactccctcatcactgctccgggtgaattctcagcagcagatgctgggataggaagccgagggaaccgtggtttggagtcctctgtcccctgcagttagaagctggtcatagggacccctacatccggaggaatacctgaatcaaactttccttgagaaatgagagacgccagcatgtctccggacgccaccaagccgagccactggtgcagcgtggcgtactgggagcaccggacgcgcgtgggccgcctctatgcggtgtacgaccaggccgtcagcatcttctacgacctacctcagggcagcggcttctgcctgggccagctcaacctggagcagcgcagcgagtcggtgcggcgaacgcgcagcaagatcggcttcggcatcctgctcagcaaggagcccgacggcgtgtgggcctacaaccgcggcgagcaccccatcttcgtcaactccccgacgctggacgcgcccggcggccgc

SEQ ID NO: 182146 - DNA, 573 bp, Homo sapiens
  Payload ID: 15868
  Gene Symbol: SMAD6
  Gene Name: SMAD family member 6
  ENST ID: ENST00000559931
  CDS Start-End: 1-189
ccacctccctactctcggctgtctcctcgcgacgagtacaagccactggatctgtccgattccacattgtcttacactgaaacggaggctaccaactccctcatcactgctccgggtgaattctcagcagatgctgggataggaagccgagggaaccgtggtttggagtcctctgtcccctgcagttagaagctggtcatagggacccctacatccggaggaatacctgaatcaaactttccttgagaaatgagagacgccagcatgtctccggacgccaccaagccgagccactggtgcagcgtggcgtactgggagcaccggacgcgcgtgggccgcctctatgcggtgtacgaccaggccgtcagcatcttctacgacctacctcagggcagcggcttctgcctgggccagctcaacctggagcagcgcagcgagtcggtgcggcgaacgcgcagcaagatcggcttcggcatcctgctcagcaaggagcccgacggcgtgtgggcctacaaccgcggcgagcaccccatcttcgtcaactccccgacgctggacgcgcccggcggccgc

SEQ ID NO: 182147 - DNA, 3087 bp, Homo sapiens
  Payload ID: 15869
  Gene Symbol: SMAD7
  Gene Name: SMAD family member 7
  Uniprot ID: O15105
  ENST ID: ENST00000262158
  CDS Start-End: 288-1568
cggagagccgcgcagggcgcgggccgcgcggggtggggcagccggagcgcaggcccccgatccccggcgggcgcccccgggcccccgcgcgcgccccggcctccgggagactggcgcatgccacggagcgcccctcgggccgccgccgctcctgcccgggcccctgctgctgctgctgtcgcctgcgcctgctgccccaactcggcgcccgacttcttcatggtgtgcggaggtcatgttcgctccttagcaggcaaacgacttttctcctcgcctcctcgccccgcatgttcaggaccaaacgatctgcgctcgtccggcgtctctggaggagccgtgcgcccggcggcgaggacgaggaggagggcgcagggggaggtggaggaggaggcgagctgcggggagaaggggcgacggacagccgagcgcatggggccggtggcggcggcccgggcagggctggatgctgcctgggcaaggcggtgcgaggtgccaaaggtcaccaccatccccacccgccagccgcgggcgccggcgcggccgggggcgccgaggcggatctgaaggcgctcacgcactcggtgctcaagaaactgaaggagcggcagctggagctgctgctccaggccgtggagtcccgcggcgggacgcgcaccgcgtgcctcctgctgcccggccgcctggactgcaggctgggcccgggggcgcccgccggcgcgcagcctgcgcagccgccctcgtcctactcgctccccctcctgctgtgcaaagtgttcaggtggccggatctcaggcattcctcggaagtcaagaggctgtgttgctgtgaatcttacgggaagatcaaccccgagctggtgtgctgcaacccccatcaccttagccgactctgcgaactagagtctcccccccctccttactccagatacccgatggattttctcaaaccaactgcagactgtccagatgctgtgccttcctccgctgaaacagggggaacgaattatctggcccctggggggctttcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtttttttggaagaaggggcaggtatgatcggcaggacaccctgataggaagaggggaagcagaaatccaagcaccaccaaacacagtgtatgaaggggggcggtcatcatttcacttgtcaggagtgtgtgtgagtgtgagtgtgcggctgtgtgtgcacgcgtgtgcaggagcggcagatggggagacaacgtgctctttgttttgtgtctcttatggatgtccccagcagagaggtttgcagtcccaagcggtgtctctcctgccccttggacacgctcagtggggcagaggcagtacctgggcaagctggcggctggggtcccagcagctgccaggagcacggctctgtccccagcctgggaaagcccctgcccctcctctccctcatcaaggacacgggcctgtccacaggcttctgagcagcgagcctgctagtggccgaaccagaaccaattattttcatccttgtcttattcccttcctgccagcccctgccattgtagcgtctttcttttttggccatctgctcctggatctccctgagatgggcttcccaagggctgccggggcagccccctcacagtattgctcacccagtgccctctcccctcagcctctcccctgcctgccctggtgacatcaggtttttcccggacttagaaaaccagctcagcactgcctgctcccatcctgtgtgttaagctctgctattaggccagcaagcggggatgtccctgggagggacatgcttagcagtccccttccctccaagaaggatttggtccgtcataacccaaggtaccatcctaggctgacacctaactcttctttcatttcttctacaactcatacactcgtatgatacttcgacactgttcttagctcaatgagcatgtttagactttaacataagctatttttctaactacaaaggtttaaatgaacaagagaagcattctcattggaaatttagcattgtagtgctttgagagagaaaggactcctgaaaaaaaacctgagatttattaaagaaaaaaatgtattttatgttatatataaatatattattacttgtaaatataaagacgttttataagcatcattatttatgtattgtgcaatgtgtataaacaagaaaaataaagaaaagatgcactttgctttaatataaatgcaaataacaaatgccaaattaaaaaagataaacacaagattggtgtttttttctatgggtgttatcacctagctgaatgtttttctaaaggagtttatgttccattaaacgatttttaaaatgtacacttga

SEQ ID NO: 182148 - DNA, 574 bp, Homo sapiens
  Payload ID: 15869
  Gene Symbol: SMAD7
  Gene Name: SMAD family member 7
  ENST ID: ENST00000586093
  CDS Start-End: 101-574
gttatcataagtttctatctctcttctcatggctgggcctttattttctcttgcttttttaatttcagagtctcccccccctccttactccagatacccgatggattttctcaaaccaactgcagactgtccagatgctgtgccttcctccgctgaaacagggggaacgaattatctggcccctggggggctttcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaag

SEQ ID NO: 182149 - DNA, 1152 bp, Homo sapiens
  Payload ID: 15869
  Gene Symbol: SMAD7
  Gene Name: SMAD family member 7
  Uniprot ID: O15105
  ENST ID: ENST00000591805
  CDS Start-End: 138-773
agtaaatacggagaatcacgtcgaacaccagtggcccagatactgtcgtggccgcgcacctttggagttttggggcaaagagagttggatggaaggccgaactggagtctcccccccctccttactccagatacccgatggattttctcaaaccaactgcagactgtccagatgctgtgccttcctccgctgaaacagggggaacgaattatctggcccctggggggctttcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtttttttggaagaaggggcaggtatgatcggcaggacaccctgataggaagaggggaagcagaaatccaagcaccaccaaacacagtgtatgaaggggggcggtcatcatttcacttgtcaggagtgtgtgtgagtgtgagtgtgcggctgtgtgtgcacgcgtgtgca

SEQ ID NO: 182150 - DNA, 1278 bp, Homo sapiens
  Payload ID: 15869
  Gene Symbol: SMAD7
  Gene Name: SMAD family member 7
  Uniprot ID: O15105
  ENST ID: ENST00000589634
  CDS Start-End: 1-1278
atgttcaggaccaaacgatctgcgctcgtccggcgtctctggaggagccgtgcgcccggcggcgaggacgaggaggagggcgcagggggaggtggaggaggaggcgagctgcggggagaaggggcgacggacagccgagcgcatggggccggtggcggcggcccgggcagggctggatgctgcctgggcaaggcggtgcgaggtgccaaaggtcaccaccatccccacccgccagccgcgggcgccggcgcggccgggggcgccgaggcggatctgaaggcgctcacgcactcggtgctcaagaaactgaaggagcggcagctggagctgctgctccaggccgtggagtcccgcggcgggacgcgcaccgcgtgcctcctgctgcccggccgcctggactgcaggctgggcccgggggcgcccgccggcgcgcagcctgcgcagccgccctcgtcctactcgctccccctcctgctgtgcaaagtgttcaggtggccggatctcaggcattcctcggaagtcaagaggctgtgttgctgtgaatcttacgggaagatcaaccccgagctggtgtgctgcaacccccatcaccttagccgactctgcgaactagagtctcccccccctccttactccagatacccgatggattttctcaaaccaactgactgtccagatgctgtgccttcctccgctgaaacagggggaacgaattatctggcccctggggggctttcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtag

SEQ ID NO: 182151 - DNA, 5447 bp, Homo sapiens
  Payload ID: 15870
  Gene Symbol: SMAD9
  Gene Name: SMAD family member 9
  Uniprot ID: O15198
  ENST ID: ENST00000350148
  CDS Start-End: 310-1602
agtctgactgacgccggctggggccgccgccgccgccgccgccgccgccgctgctgcagccgctgtctcggtccccgccgccgccgccgggccctgcaggcgctgggcgcgcgcagccaggcaagttggccaccctgttcaagggcttaggagaaagtcaacacacttcgcaacttgaattggtcccagctgctcccagaagaacgggcgggttggtccctatgccacccctggagagctactcgccgcccactttgccgtgaagggctgtgcggttcccgtgcgcgccggagcctgctgtggcctcttatgcactccaccacccccatcagctccctcttctccttcaccagccccgcagtgaagagactgctaggctggaagcaaggagatgaagaggaaaagtgggcagagaaggcagtggactctctagtgaagaagttaaagaagaagaagggagccatggacgagctggagagggctctcagctgcccggggcagcccagcaaatgcgtcacgattccccgctccctggacgggcggctgcaggtgtcccaccgcaagggcctgccccatgtgatttactgtcgcgtgtggcgctggccggatctgcagtcccaccacgagctgaagccgctggagtgctgtgagttcccatttggctccaagcagaaagaagtgtgcattaacccttaccactaccgccgggtggagactccagtactgcctcctgtgctcgtgccaagacacagtgaatataacccccagctcagcctcctggccaagttccgcagcgcctccctgcacagtgagccactcatgccacacaacgccacctatcctgactctttccagcagcctccgtgctctgcactccctccctcacccagccacgcgttctcccagtccccgtgcacggccagctaccctcactccccaggaagtccttctgagccagagagtccctatcaacactcagactttcgaccagtttgttacgaggagccccagcactggtgctcggtcgcctactatgaactgaacaaccgagttggggagacattccaggcttcctcccgaagtgtgctcatagatgggttcaccgacccttcaaataacaggaacagattctgtcttggacttctttctaatgtaaacagaaactcaacgatagaaaataccaggagacatataggaaagggtgtgcacttgtactacgtcgggggagaggtgtatgccgagtgcgtgagtgacagcagcatctttgtgcagagccggaactgcaactatcaacacggcttccacccagctaccgtctgcaagatccccagcggctgcagcctcaaggtcttcaacaaccagctcttcgctcagctcctggcccagtcagttcaccacggctttgaagtcgtgtatgaactgaccaagatgtgtactatccggatgagttttgttaagggttggggtgctgagtatcatcgccaggatgtcaccagcaccccctgctggattgagattcatcttcatgggccactgcagtggctggacaaagttctgactcagatgggctctccacataaccccatttcttcagtgtcttaacagtcatgtcttaagctgcatttccataggatagaggctattgcagggagtggcttgtatcatttcagatttgcaactgaagtttctaaaaacatgtgtaaatacatagaatgtatactgttcttattttttttaatcaccgtttgttttgtgctttctagttaacctgatgccagtacagtgcaattggaaaagcaggactttggtgcctgtgctataagcagcagattttgtgggaggaaacacttgagaggcgatattgtcaacagtatttgaagggtgttagcagaataaaagacagctttagtcagccgtgtcattataaagcatgttgtgtggcctcacagaaacattgaaactgtttatacagcaaaagtcaggtattagcagcactaaagcaaatatcactcagatgaaacaaagcagtgaaacccctacagtttaaatgatgtcacttttagtgctgttggcaagaaaaaaaaaacaacaaacttgtacaatgaattaatgagataggccatagaaactttatttctaaggttgacatacctatagctgggctcctgtgctcatattcagtggtacattttaaacaaactgtgatcggaaaagaaaaaaaactgtgaagccaaaagtcatgttccctcagtctaccactgtaaaaacagagtctaatatgggaaaataaatatgaaaatagcatgaaatgctgtttcccagattgcaagataagaccagaacttggtccaagagccagccacccagggagactcctgctttccacagaggagaccaggttcctgtcgtgctggttgttcgtgtcaggcagtcctgcaaactttgagtctgcgcagcgtgccagaatagcttgtgtttcagtcctgtgtcaagaagcaggtgaaaccaaaggttggagaaaagcatcacacgtcgacttacactttctcatttcccacgttccagtctcctgggaagggcactctttcgccacgttttcctgcctcttggcaaatattaactctttgcagatcactaaagcaacagtaaagactttgagaaaatctagacacattattggatcaatgagttatttaacctagtgtctagtgattatctaacctggaaataaattcccaaggaaagtgataataatttcataatcatctgcaatttctggggaacagtggtactgaataataagacatcttttaaaaatatacacaatattaaaaacctgttcttattttactttagatgagggaggaaaatcccccaaatttctaggtactttcatatatatacttgccatgcactaaacactgcattgcttggaaaaatatttcacaccctctttaaaaatgtacaatttaagatggcagttatgcttgtaacagacagcacttcagtaatccaagaagtttcttcatttatacattttatctcaactctttctagcattagtgcacatggtagtttttctaattaaattgtattcaaggtagaaatgatcatgtgagaaagatatatgattgagctactactgtcacctcttacagttactagtgttagctaatagaaactttcatatatacacatagaaaagaattattacattttacattgaaaaatgtaatatatggcccatgtagtgtatagaaaaatctgtagtttattggttcatcaactatgtattgtgcacctacctatgggtgtcaggtacaatgttaggtactgtagaatcaaatgtaaataagagacagtcccagccctcagggagccgagaacctaatagtgaatctgtttgtacagacatcttcatgtttcagaacttttaaaacaaaacaaaataatgtaatctatcatcttttgcttgaaagaatgtgattgatttcttatctctgttttgaaattatttccttactcttctgcaaagtcaggtaatggattccttgtataaatgctacttttcttccatgtctcaaagttgttttttttcctcccctttcttccctgttttccaataattctccatgtccccttttcttagaaaaggcattaatatggtgaatcttgtatgggaaccattccatgggagaacttcaacacagtttttgctccagagatcaaacatagctttcgtgatctctctaccagctatctaacttatcctctggtaatctttttttttttttttttttttttgagatggagtctcgctgtgtcaccaggccagagtgcagtggcgtgatcttggctcactgcaacctctgcctcccgggttcgagtgattctcctgcctcagcctcccaagtagttgggactacaggctaccacgcccagctaatttttatatttttagtagagacggggtttcaccatggtagccagaatggtctctatctcttgaccttgtgatccgcccgcctcagcctcccaaagtgctgggattacaggcgtgagccactgcgcccggcttcctctggtaatcttacacctttacagaattaatctaaactggtggctcataaatgacattaaaaacaaaaaaaaaatctggatgcagtggctcattcctatagtcccagcactttgggaggccaaggcgggaggatcatctgagcccaggagtttggggctgtagtgaactatgatcatacaacttcattctagcctgggtgacaaagtgacaccctgtctctaaacaaaaatcaagaaacaaaaaacttgtatttccctgcagctttgggaagccagaacacaatattgcagtgaatctgaattttctgtgacaaataaattattaaattggcacatatgatcatcaccagtcatgtctcatcaaaagcctttattatgatgcttgtacattttgaagaatttagaattaatgagaagttaaccctttagtcattgtaacacaatcatattttaatcagctttttcttttgctaccaagagtttcaaaaaataaatgcagtatttgatttcaggctgctaaatgggctcatttagcattcattccttgatgtagacattaaaaaaaaaactgaatagcattctttccaggataactaataaagcagacatgctaagcctataaatacatcagcactgcagcacacgtttaaggttgccacggacaaggatcacacaatagagaacactgtagtaacatttcggtctgctcacaagacccagaacattgatcagtttttgttgttggtttattatttttctgttaaaaaattgtgaaaagtttgttttagctagatgatattttaatagctgcgagtgctttggaactataaagatgtcactacttaacacatataccttatgttttgttttgttttgttttacactcagtataaatcaggagaagttagccaaccatctagcatttagaatcctcttttttattgtcttctaaggatatggatgttcccataacagcaacaaaacagcaacaaaaacatttcataaatatcacttgatagactgtaagcacctgcttaactttgtgtcccaaatatttagtgtgtatatatatatatatatatacacacacacacacatatatattcaacaaataaagcaaaatataacatgcatttcacattttgtctttccctgttacgattttaatagcagaactgtatgacaagtttaggtgatcctagcatatgttaaattcaaattaatgtaaaacagattaacaacaacaaagaaactgtctatttgagtgaagtcatgctttctattataataacttggcttcggttatccatcaaatgcacacttatactgttatctgattgtttataataaagaatactgtacttata

SEQ ID NO: 182152 - DNA, 5592 bp, Homo sapiens
  Payload ID: 15870
  Gene Symbol: SMAD9
  Gene Name: SMAD family member 9
  Uniprot ID: O15198
  ENST ID: ENST00000379826
  CDS Start-End: 344-1747
cgcactaatacgggcgatgaggcttcgcggctccagtctgactgacgccggctggggccgccgccgccgccgccgccgccgccgctgctgcagccgctgtctcggtccccgccgccgccgccgggccctgcaggcgctgggcgcgcgcagccaggcaagttggccaccctgttcaagggcttaggagaaagtcaacacacttcgcaacttgaattggtcccagctgctcccagaagaacgggcgggttggtccctatgccacccctggagagctactcgccgcccactttgccgtgaagggctgtgcggttcccgtgcgcgccggagcctgctgtggcctcttatgcactccaccacccccatcagctccctcttctccttcaccagccccgcagtgaagagactgctaggctggaagcaaggagatgaagaggaaaagtgggcagagaaggcagtggactctctagtgaagaagttaaagaagaagaagggagccatggacgagctggagagggctctcagctgcccggggcagcccagcaaatgcgtcacgattccccgctccctggacgggcggctgcaggtgtcccaccgcaagggcctgccccatgtgatttactgtcgcgtgtggcgctggccggatctgcagtcccaccacgagctgaagccgctggagtgctgtgagttcccatttggctccaagcagaaagaagtgtgcattaacccttaccactaccgccgggtggagactccagtactgcctcctgtgctcgtgccaagacacagtgaatataacccccagctcagcctcctggccaagttccgcagcgcctccctgcacagtgagccactcatgccacacaacgccacctatcctgactctttccagcagcctccgtgctctgcactccctccctcacccagccacgcgttctcccagtccccgtgcacggccagctaccctcactccccaggaagtccttctgagccagagagtccctatcaacactcagttgacacaccacccctgccttatcatgccacagaagcctctgagacccagagtggccaacctgtagatgccacagctgatagacatgtagtgctatcgataccaaatggagactttcgaccagtttgttacgaggagccccagcactggtgctcggtcgcctactatgaactgaacaaccgagttggggagacattccaggcttcctcccgaagtgtgctcatagatgggttcaccgacccttcaaataacaggaacagattctgtcttggacttctttctaatgtaaacagaaactcaacgatagaaaataccaggagacatataggaaagggtgtgcacttgtactacgtcgggggagaggtgtatgccgagtgcgtgagtgacagcagcatctttgtgcagagccggaactgcaactatcaacacggcttccacccagctaccgtctgcaagatccccagcggctgcagcctcaaggtcttcaacaaccagctcttcgctcagctcctggcccagtcagttcaccacggctttgaagtcgtgtatgaactgaccaagatgtgtactatccggatgagttttgttaagggttggggtgctgagtatcatcgccaggatgtcaccagcaccccctgctggattgagattcatcttcatgggccactgcagtggctggacaaagttctgactcagatgggctctccacataaccccatttcttcagtgtcttaacagtcatgtcttaagctgcatttccataggatagaggctattgcagggagtggcttgtatcatttcagatttgcaactgaagtttctaaaaacatgtgtaaatacatagaatgtatactgttcttattttttttaatcaccgtttgttttgtgctttctagttaacctgatgccagtacagtgcaattggaaaagcaggactttggtgcctgtgctataagcagcagattttgtgggaggaaacacttgagaggcgatattgtcaacagtatttgaagggtgttagcagaataaaagacagctttagtcagccgtgtcattataaagcatgttgtgtggcctcacagaaacattgaaactgtttatacagcaaaagtcaggtattagcagcactaaagcaaatatcactcagatgaaacaaagcagtgaaacccctacagtttaaatgatgtcacttttagtgctgttggcaagaaaaaaaaaacaacaaacttgtacaatgaattaatgagataggccatagaaactttatttctaaggttgacatacctatagctgggctcctgtgctcatattcagtggtacattttaaacaaactgtgatcggaaaagaaaaaaaactgtgaagccaaaagtcatgttccctcagtctaccactgtaaaaacagagtctaatatgggaaaataaatatgaaaatagcatgaaatgctgtttcccagattgcaagataagaccagaacttggtccaagagccagccacccagggagactcctgctttccacagaggagaccaggttcctgtcgtgctggttgttcgtgtcaggcagtcctgcaaactttgagtctgcgcagcgtgccagaatagcttgtgtttcagtcctgtgtcaagaagcaggtgaaaccaaaggttggagaaaagcatcacacgtcgacttacactttctcatttcccacgttccagtctcctgggaagggcactctttcgccacgttttcctgcctcttggcaaatattaactctttgcagatcactaaagcaacagtaaagactttgagaaaatctagacacattattggatcaatgagttatttaacctagtgtctagtgattatctaacctggaaataaattcccaaggaaagtgataataatttcataatcatctgcaatttctggggaacagtggtactgaataataagacatcttttaaaaatatacacaatattaaaaacctgttcttattttactttagatgagggaggaaaatcccccaaatttctaggtactttcatatatatacttgccatgcactaaacactgcattgcttggaaaaatatttcacaccctctttaaaaatgtacaatttaagatggcagttatgcttgtaacagacagcacttcagtaatccaagaagtttcttcatttatacattttatctcaactctttctagcattagtgcacatggtagtttttctaattaaattgtattcaaggtagaaatgatcatgtgagaaagatatatgattgagctactactgtcacctcttacagttactagtgttagctaatagaaactttcatatatacacatagaaaagaattattacattttacattgaaaaatgtaatatatggcccatgtagtgtatagaaaaatctgtagtttattggttcatcaactatgtattgtgcacctacctatgggtgtcaggtacaatgttaggtactgtagaatcaaatgtaaataagagacagtcccagccctcagggagccgagaacctaatagtgaatctgtttgtacagacatcttcatgtttcagaacttttaaaacaaaacaaaataatgtaatctatcatcttttgcttgaaagaatgtgattgatttcttatctctgttttgaaattatttccttactcttctgcaaagtcaggtaatggattccttgtataaatgctacttttcttccatgtctcaaagttgttttttttcctcccctttcttccctgttttccaataattctccatgtccccttttcttagaaaaggcattaatatggtgaatcttgtatgggaaccattccatgggagaacttcaacacagtttttgctccagagatcaaacatagctttcgtgatctctctaccagctatctaacttatcctctggtaatctttttttttttttttttttttttgagatggagtctcgctgtgtcaccaggccagagtgcagtggcgtgatcttggctcactgcaacctctgcctcccgggttcgagtgattctcctgcctcagcctcccaagtagttgggactacaggctaccacgcccagctaatttttatatttttagtagagacggggtttcaccatggtagccagaatggtctctatctcttgaccttgtgatccgcccgcctcagcctcccaaagtgctgggattacaggcgtgagccactgcgcccggcttcctctggtaatcttacacctttacagaattaatctaaactggtggctcataaatgacattaaaaacaaaaaaaaaatctggatgcagtggctcattcctatagtcccagcactttgggaggccaaggcgggaggatcatctgagcccaggagtttggggctgtagtgaactatgatcatacaacttcattctagcctgggtgacaaagtgacaccctgtctctaaacaaaaatcaagaaacaaaaaacttgtatttccctgcagctttgggaagccagaacacaatattgcagtgaatctgaattttctgtgacaaataaattattaaattggcacatatgatcatcaccagtcatgtctcatcaaaagcctttattatgatgcttgtacattttgaagaatttagaattaatgagaagttaaccctttagtcattgtaacacaatcatattttaatcagctttttcttttgctaccaagagtttcaaaaaataaatgcagtatttgatttcaggctgctaaatgggctcatttagcattcattccttgatgtagacattaaaaaaaaaactgaatagcattctttccaggataactaataaagcagacatgctaagcctataaatacatcagcactgcagcacacgtttaaggttgccacggacaaggatcacacaatagagaacactgtagtaacatttcggtctgctcacaagacccagaacattgatcagtttttgttgttggtttattatttttctgttaaaaaattgtgaaaagtttgttttagctagatgatattttaatagctgcgagtgctttggaactataaagatgtcactacttaacacatataccttatgttttgttttgttttgttttacactcagtataaatcaggagaagttagccaaccatctagcatttagaatcctcttttttattgtcttctaaggatatggatgttcccataacagcaacaaaacagcaacaaaaacatttcataaatatcacttgatagactgtaagcacctgcttaactttgtgtcccaaatatttagtgtgtatatatatatatatatatacacacacacacacatatatattcaacaaataaagcaaaatataacatgcatttcacattttgtctttccctgttacgattttaatagcagaactgtatgacaagtttaggtgatcctagcatatgttaaattcaaattaatgtaaaacagattaacaacaacaaagaaactgtctatttgagtgaagtcatgctttctattataataacttggcttcggttatccatcaaatgcacacttatactgttatctgattgtttataataaagaatactgtacttata

SEQ ID NO: 182153 - DNA, 5389 bp, Homo sapiens
  Payload ID: 15870
  Gene Symbol: SMAD9
  Gene Name: SMAD family member 9
  Uniprot ID: O15198
  ENST ID: ENST00000399275
  CDS Start-End: 141-1544
gcaacttgaattggtcccagctgctcccagaagaacgggcgggttggtccctatgccacccctggagagctactcgccgcccactttgccgtgaagggctgtgcggttcccgtgcgcgccggagcctgctgtggcctcttatgcactccaccacccccatcagctccctcttctccttcaccagccccgcagtgaagagactgctaggctggaagcaaggagatgaagaggaaaagtgggcagagaaggcagtggactctctagtgaagaagttaaagaagaagaagggagccatggacgagctggagagggctctcagctgcccggggcagcccagcaaatgcgtcacgattccccgctccctggacgggcggctgcaggtgtcccaccgcaagggcctgccccatgtgatttactgtcgcgtgtggcgctggccggatctgcagtcccaccacgagctgaagccgctggagtgctgtgagttcccatttggctccaagcagaaagaagtgtgcattaacccttaccactaccgccgggtggagactccagtactgcctcctgtgctcgtgccaagacacagtgaatataacccccagctcagcctcctggccaagttccgcagcgcctccctgcacagtgagccactcatgccacacaacgccacctatcctgactctttccagcagcctccgtgctctgcactccctccctcacccagccacgcgttctcccagtccccgtgcacggccagctaccctcactccccaggaagtccttctgagccagagagtccctatcaacactcagttgacacaccacccctgccttatcatgccacagaagcctctgagacccagagtggccaacctgtagatgccacagctgatagacatgtagtgctatcgataccaaatggagactttcgaccagtttgttacgaggagccccagcactggtgctcggtcgcctactatgaactgaacaaccgagttggggagacattccaggcttcctcccgaagtgtgctcatagatgggttcaccgacccttcaaataacaggaacagattctgtcttggacttctttctaatgtaaacagaaactcaacgatagaaaataccaggagacatataggaaagggtgtgcacttgtactacgtcgggggagaggtgtatgccgagtgcgtgagtgacagcagcatctttgtgcagagccggaactgcaactatcaacacggcttccacccagctaccgtctgcaagatccccagcggctgcagcctcaaggtcttcaacaaccagctcttcgctcagctcctggcccagtcagttcaccacggctttgaagtcgtgtatgaactgaccaagatgtgtactatccggatgagttttgttaagggttggggtgctgagtatcatcgccaggatgtcaccagcaccccctgctggattgagattcatcttcatgggccactgcagtggctggacaaagttctgactcagatgggctctccacataaccccatttcttcagtgtcttaacagtcatgtcttaagctgcatttccataggatagaggctattgcagggagtggcttgtatcatttcagatttgcaactgaagtttctaaaaacatgtgtaaatacatagaatgtatactgttcttattttttttaatcaccgtttgttttgtgctttctagttaacctgatgccagtacagtgcaattggaaaagcaggactttggtgcctgtgctataagcagcagattttgtgggaggaaacacttgagaggcgatattgtcaacagtatttgaagggtgttagcagaataaaagacagctttagtcagccgtgtcattataaagcatgttgtgtggcctcacagaaacattgaaactgtttatacagcaaaagtcaggtattagcagcactaaagcaaatatcactcagatgaaacaaagcagtgaaacccctacagtttaaatgatgtcacttttagtgctgttggcaagaaaaaaaaaacaacaaacttgtacaatgaattaatgagataggccatagaaactttatttctaaggttgacatacctatagctgggctcctgtgctcatattcagtggtacattttaaacaaactgtgatcggaaaagaaaaaaaactgtgaagccaaaagtcatgttccctcagtctaccactgtaaaaacagagtctaatatgggaaaataaatatgaaaatagcatgaaatgctgtttcccagattgcaagataagaccagaacttggtccaagagccagccacccagggagactcctgctttccacagaggagaccaggttcctgtcgtgctggttgttcgtgtcaggcagtcctgcaaactttgagtctgcgcagcgtgccagaatagcttgtgtttcagtcctgtgtcaagaagcaggtgaaaccaaaggttggagaaaagcatcacacgtcgacttacactttctcatttcccacgttccagtctcctgggaagggcactctttcgccacgttttcctgcctcttggcaaatattaactctttgcagatcactaaagcaacagtaaagactttgagaaaatctagacacattattggatcaatgagttatttaacctagtgtctagtgattatctaacctggaaataaattcccaaggaaagtgataataatttcataatcatctgcaatttctggggaacagtggtactgaataataagacatcttttaaaaatatacacaatattaaaaacctgttcttattttactttagatgagggaggaaaatcccccaaatttctaggtactttcatatatatacttgccatgcactaaacactgcattgcttggaaaaatatttcacaccctctttaaaaatgtacaatttaagatggcagttatgcttgtaacagacagcacttcagtaatccaagaagtttcttcatttatacattttatctcaactctttctagcattagtgcacatggtagtttttctaattaaattgtattcaaggtagaaatgatcatgtgagaaagatatatgattgagctactactgtcacctcttacagttactagtgttagctaatagaaactttcatatatacacatagaaaagaattattacattttacattgaaaaatgtaatatatggcccatgtagtgtatagaaaaatctgtagtttattggttcatcaactatgtattgtgcacctacctatgggtgtcaggtacaatgttaggtactgtagaatcaaatgtaaataagagacagtcccagccctcagggagccgagaacctaatagtgaatctgtttgtacagacatcttcatgtttcagaacttttaaaacaaaacaaaataatgtaatctatcatcttttgcttgaaagaatgtgattgatttcttatctctgttttgaaattatttccttactcttctgcaaagtcaggtaatggattccttgtataaatgctacttttcttccatgtctcaaagttgttttttttcctcccctttcttccctgttttccaataattctccatgtccccttttcttagaaaaggcattaatatggtgaatcttgtatgggaaccattccatgggagaacttcaacacagtttttgctccagagatcaaacatagctttcgtgatctctctaccagctatctaacttatcctctggtaatctttttttttttttttttttttttgagatggagtctcgctgtgtcaccaggccagagtgcagtggcgtgatcttggctcactgcaacctctgcctcccgggttcgagtgattctcctgcctcagcctcccaagtagttgggactacaggctaccacgcccagctaatttttatatttttagtagagacggggtttcaccatggtagccagaatggtctctatctcttgaccttgtgatccgcccgcctcagcctcccaaagtgctgggattacaggcgtgagccactgcgcccggcttcctctggtaatcttacacctttacagaattaatctaaactggtggctcataaatgacattaaaaacaaaaaaaaaatctggatgcagtggctcattcctatagtcccagcactttgggaggccaaggcgggaggatcatctgagcccaggagtttggggctgtagtgaactatgatcatacaacttcattctagcctgggtgacaaagtgacaccctgtctctaaacaaaaatcaagaaacaaaaaacttgtatttccctgcagctttgggaagccagaacacaatattgcagtgaatctgaattttctgtgacaaataaattattaaattggcacatatgatcatcaccagtcatgtctcatcaaaagcctttattatgatgcttgtacattttgaagaatttagaattaatgagaagttaaccctttagtcattgtaacacaatcatattttaatcagctttttcttttgctaccaagagtttcaaaaaataaatgcagtatttgatttcaggctgctaaatgggctcatttagcattcattccttgatgtagacattaaaaaaaaaactgaatagcattctttccaggataactaataaagcagacatgctaagcctataaatacatcagcactgcagcacacgtttaaggttgccacggacaaggatcacacaatagagaacactgtagtaacatttcggtctgctcacaagacccagaacattgatcagtttttgttgttggtttattatttttctgttaaaaaattgtgaaaagtttgttttagctagatgatattttaatagctgcgagtgctttggaactataaagatgtcactacttaacacatataccttatgttttgttttgttttgttttacactcagtataaatcaggagaagttagccaaccatctagcatttagaatcctcttttttattgtcttctaaggatatggatgttcccataacagcaacaaaacagcaacaaaaacatttcataaatatcacttgatagactgtaagcacctgcttaactttgtgtcccaaatatttagtgtgtatatatatatatatatatacacacacacacacatatatattcaacaaataaagcaaaatataacatgcatttcacattttgtctttccctgttacgattttaatagcagaactgtatgacaagtttaggtgatcctagcatatgttaaattcaaattaatgtaaaacagattaacaacaacaaagaaactgtctatttgagtgaagtcatgctttctattataataacttggcttcggttatccatcaaatgcacacttatactgttatctgattgtttataataaagaatactgtacttata

SEQ ID NO: 182154 - DNA, 4563 bp, Homo sapiens
  Payload ID: 15871
  Gene Symbol: SNIP1
  Gene Name: Smad nuclear interacting protein 1
  Uniprot ID: Q8TAD8
  ENST ID: ENST00000296215
  CDS Start-End: 74-1264
gttaaactcgtcatttcctccagctagaggagctcaactgatctgttttctttcgcccagccaaaatcacagaatgaaggcggtgaagagcgaacgggagcgagggagccggcgaagacaccgggacggggacgtggtgctgccggcgggggtggtggtgaagcaggagcgtctcagcccagaagtcgcacctcccgcccaccgccgtccggaccactccggtggtagcccgtctccgccgaccagcgagccggcccgctcgggccaccgcgggaaccgagcccgaggagttagccggtccccacccaaaaagaaaaacaaggcctcagggagaagaagcaagtctcctcgcagtaagagaaaccgaagtcctcaccactcaacagtcaaagtgaagcaggagcgtgaggatcatccccggagaggacgggaggatcggcagcacagggaaccatcagaacaggaacacaggagagctaggaacagtgaccgggacagacaccggggccattcccaccaaaggagaacgtctaacgagaggcctgggagtgggcagggtcagggacgggatcgagacactcagaacctgcaggctcaggaagaagagcgggagttttataatgccaggcgacgggagcatcgccagaggaatgacgttggtggtggcggcagtgagtctcaggagttggttcctcggcctggtggcaacaacaaagaaaaagaggtgcccgctaaagaaaaaccaagctttgaactttctggggcacttcttgaggacaccaacactttccggggtgtagtcattaaatatagtgagcccccagaagcacgtatccccaaaaaacggtggcgtctctacccatttaaaaatgatgaggtgcttccagtcatgtacatacatcgacagagtgcgtacctactgggtcgacaccgccgcattgcagacattccaattgatcacccgtcttgttcaaagcagcatgcggtctttcaatatcggcttgtggaatatacccgtgctgatggcacagttggccgaagagtgaagccctacatcattgaccttggctcaggcaatggaaccttcttaaacaacaaacgtattgagccacagagatactatgaactaaaagaaaaggatgtactcaaatttggattcagtagcagagaatacgtcttgctccatgagtcgtcggacacttctgaaatagacaggaaagatgacgaggatgaggaggaggaggaagaagtgtctgacagctagcaaactaagaacccaaactattgatacacggtttccttcttggaagtctttgattgactcagagagcactatggtggtgggtccagcactatggtgctctctgtaatgcctcttactgccttaagtctttcctctgttgctgaccagattgtgttaccatttgaatacactgactaatgtttgttaaactttttctgtggcaccttggccacatgcctgcaggcatttgttttcagaacagtctcaccaattacaacacaccgtgttttagtagaagtgttgtggttttagttggtgctttcagaactgctgcctaggaaactataaacccttggttaaggggaaatcatggcttgttctctttgtacagttactttatttatataggtgttaagctttgtggaccaggtgtttttcttttggggcgaacccctgagcagagaatcttactaggctttggttatcaccaaaacaacctccagtatataccaaagctttgacttgtttgagctcttgagcttagaagttgattttgcacttatttttttggggggtgggaatgtactgcagtcagtaaacattattgactgtttaacttaaacagatgctttatggcacctgctcaagcccgtgactgtacagaaggatcctggttgctaccagtgggtgctgattcagcatcacaagtgactgaaattggctgtggatctgttctttgtgaaagaattcctgatttctccatggagcatgtacacaacaattttgatcatattaactgtacttcagttttgcatttttattcaaatgttatctctttttttctttgagaaataaactgtcactgatgtgacagcgttctttctttattctaataacatgtatagatctaaagcaggttgtgttgtttacatgtttctacacatttcatcctttaaaaagttgttgagagaggttgtatttaccttcccaaggttggaaagcaggggaatttcccagtgtcctagttttccaccagaggaatatgtgtaagtagcaaagtatttgctgcttacatatagtgtgtatgtatgtatatatgtaaattgtgtgttaaagagctgatactgattttcatatgacaatgttaggcaaaggcctccctgcatttgaagagcaggttttcatttatatgtatttttgggataaaaaaataaaatttgtaaatatagccccatttcaaagagtaatgctttcctagcgtagaggaccttgtgttcataggtctgtttgctgctaatggagccttctgtcagtacttttgagataaaagtaggtagctgttttagagtgttgtggggcaggttatatcgttggcctccaagtcagtggaatagcagatggtgacatggaggtgggttgtggggaaaggtggtgaagcagctcaatcagtgttactactaattgttcctcttgggttgagacttaggatactattaaatttgattgttttccattgtttttatacccatgtgtgctcagggctaaagattggctagtgggaggggcagctgactaatgttcattcagaagaagttaaaagatcctttgaaaagtgaacacttaataaggtcattagatgaaacgtaagttgggccgggcatgggcacagtggctcatgcctgtaatcccaacactttcggaggctgaggtgggcagatcatctgaggtcaggagttcaagaccaacctggccaacatggtgaaaccccatctctactaaaaatacaaaaattagctgggcgtggtggcacatgcctgttttaatcccagctactcgggaggctgaggcaggagaatcgcttgaacccgggaggtggaggttgcagcgagctgagattgtgccactgcactccagcctgggtgacagcgagactctgtctcagaaaaaaaaaaaaaaggtaagttgaagaatgtgttctacattggccactgtaactgctattttcttcattttggtatgtgccatagatcatatatatgtgcttgtctgaaaagtaggtttgtttggatgaacttttctcttgatccagactgacggttttctcttgagggtttaagcactaatctggtatcttactctaggatctccttgttcagtctgtgctgcagtagcactactttgtggtagccttgagttttgctacaaacttcatcctggtgggcactgtgatagatgaccactttgcctacatttttcagtaagaagtcctaattgtttagtcagtttttattttagtagaggaataacgtcctggattaagaaattctttatgccacatatctgagaaggtgggtttttttgttggtttgtttgttttgagatggcgtctcactctgtcgcccaggctggagtgcagtggcaccatcttggctcactgcaacctccgcctcccagtttcaagcgattctcctgcctcagcctcccaagtagctgggactacaggcacctgtcaccaagcctggctaatttatatatataatttttattttttatttttttttagtagagatggggtttcaccatattggccaggctggtctcgaactcctgaccttgtgatccgcccctctcagcctcccaaagtgctgggattacaggtgttagccaccaggcctggcctgagaaggtgtttttttttttttttggtcttgttttcccttacccctttctttgaagaaagggtgtcaaaagacattacctgcctctaaagccagatatcaccagcagacttcttaaagtggacataatcctagagctttcattctgtttagaagttcatgttcatcttagccatttggaacttcttcattctctatcttttctccacggtggctgggcttgtctgcaaatcattgtgtcaaaatcaaactattttcaaaacagccctttgcttctgagcccctcccctaagtcctctgtgggggtccatgattctgcagaggtatgggacagaatcttcagattttaccccttgagtctcttcctagtcatatcctggttccctcattctaatattgacaaaggatgactcattaagtgcaactggttatgtaactttcaaatactttcattgtgtatgtcaggatctgaggaacaaaatgatgtcatttaatcggaatctaaacgtgacacaaacaacgtgccagcaatacctgcttgtgaaataatgttctgagcccacagtgttcctgggtatgtgagtttatatcaagtgaaaaggctgcttaattgacattaaagttttggaatgtaaagcttca

SEQ ID NO: 182155 - DNA, 5737 bp, Homo sapiens
  Payload ID: 15872
  Gene Symbol: SMURF1
  Gene Name: SMAD specific E3 ubiquitin protein ligase 1
  Uniprot ID: Q9HCE7
  ENST ID: ENST00000361125
  CDS Start-End: 321-2594
ggcagcggcggaagcggcgagggcggcgggcgtccggctctgaggtggtggaggcggcggaggcggcggcggaggcggcggcggctcgggactgggctcggctggaagcagcgagggtcagagcgccgcagcaagcgccgatctcccggctcgaccatccgcctgccgcccggacgcctgggccgcggagtttgtgtcccggctcggaccccggcgcccagcccggagccgtaaccttgaggcggcggcggcggggccgggccgggccgggctggggggcggtggcgctggatccgcggctgcccgatcgttggcgggagatgtcgaaccccgggacacgcaggaacggctccagcatcaagatccgtctgacagtgttatgtgccaagaaccttgcaaagaaagacttcttcaggctccctgacccttttgcaaagattgtcgtggatgggtctgggcagtgccactcaaccgacactgtgaaaaacacattggacccaaagtggaaccagcactatgatctatatgttgggaaaacggattcgataaccattagcgtgtggaaccataagaaaattcacaagaaacagggagctggcttcctgggctgtgtgcggctgctctccaatgccatcagcagattaaaagataccggataccagcgtttggatctatgcaaactaaacccctcagatactgatgcagttcgtggccagatagtggtcagtttacagacacgagacagaataggaaccggcggctcggtggtggactgcagaggactgttagaaaatgaaggaacggtgtatgaagactccgggcctgggaggccgctcagctgcttcatggaggaaccagccccttacacagatagcaccggtgctgctgctggaggagggaattgcaggttcgtggagtccccaagtcaagatcaaagacttcaggcacagcggcttcgaaaccctgatgtgcgaggttcactacagacgccccagaaccgaccacacggccaccagtccccggaactgcccgaaggctacgaacaaagaacaacagtccagggccaagtttactttttgcatacacagactggagttagcacgtggcacgaccccaggataccaagtccctcggggaccattcctgggggagatgcagcttttctatacgaattccttctacaaggccatacatctgagcccagagaccttaacagtgtgaactgtgatgaacttggaccactgccgccaggctgggaagtcagaagtacagtttctgggaggatatattttgtagatcataataaccgaacaacccagtttacagacccaaggttacaccacatcatgaatcaccagtgccaactcaaggagcccagccagccgctgccactgcccagtgagggctctctggaggacgaggagcttcctgcccagagatacgaaagagatctagtccagaagctgaaagtcctcagacacgaactgtcgcttcagcagccccaagctggtcattgccgcatcgaagtgtccagagaagaaatctttgaggagtcttaccgccagataatgaagatgcgaccgaaagacttgaaaaaacggctgatggtgaaattccgtggggaagaaggtttggattacggtggtgtggccagggagtggctttacttgctgtgccatgaaatgctgaatccttattacgggctcttccagtattctacggacaatatttacatgttgcaaataaatccggattcttcaatcaaccccgaccacttgtcttatttccactttgtggggcggatcatggggctggctgtgttccatggacactacatcaacgggggcttcacagtgcccttctacaagcagctgctggggaagcccatccagctctcagatctggaatctgtggacccagagctgcataagagcttggtgtggatcctagagaacgacatcacgcctgtactggaccacaccttctgcgtggaacacaacgccttcgggcggatcctgcagcatgaactgaaacccaatggcagaaatgtgccagtcacagaggagaataagaaagaatacgtccggttgtatgtaaactggaggtttatgagaggaatcgaagcccagttcttagctctgcagaaggggttcaatgagctcatccctcaacatctgctgaagccttttgaccagaaggaactggagctgatcataggcggcctggataaaatagacttgaacgactggaagtcgaacacgcggctgaagcactgtgtggccgacagcaacatcgtgcggtggttctggcaagcggtggagacgttcgatgaagaaaggagggccaggctcctgcagtttgtgactgggtccacgcgagtcccgctccaaggcttcaaggctttgcaaggttctacaggcgcggcagggccccggctgttcaccatccacctgatagacgcgaacacagacaaccttccgaaggcccatacctgctttaaccggatcgacattccaccatatgagtcctatgagaagctctacgagaagctgctgacagccgtggaggagacctgcgggtttgctgtggagtgaaaagcaaccaaaggcaacagagtctagctcatggccaccagaccaaaagcatccagcttctgtgcacctcctgcaaagctggcagaggccctggaattccagatcacctgaggggaaagggttgtctctctcctttctgttgggggagggggatgggggacttttgttggtggctcccacccatatatccctcctttaccatagtactcccacccacttccatcacccatccaataaaatgcagccaggtttagcctttggctttggtcacacaggatattctgctgtgttgcaacccatgtggtgataaggctcacagccctgagctctttacgggagcatcaactcacagttaggggactgggcgtggctgattgagggtttggaactggtggctatgccagctattccatctcaaaacagccttgaggccccttttcaatttgagcagctgctagatatcttatcagagctcagattccagatttcacatcccagcagccggttctgggtagcagatcaatttccaactggaaaataactatataatgtatgcttattggaattctgccacagcaggaagcttgagtcaaaatgtgtttcccctttgaaaggagaaggaattggagcagcttttcctggaggcccaggatatttcttttctgggtatcttggctgaaaattttgttttacatagagaaaaacgatcttttaagggtcccttttgctgcattatctgtccagtttgacttttttttcagtgaaaacaccatgtcatggagtgtaggaaagagcagaccaaaatcagccctagagccaaccagtcagtcccaaagctgtgacctctgtgccactgttgtccatagaagagcatcgactgtgtcacttaaaatattagtaaaccatgatgcagcaactgctaagagctaaactaacaaaattgtgtcatcatagctgctggcttggtgtgaactcgcttaaaagcaatggtgaaaggataacctcgatgatgtaaatccacccaaagatactgttctacaaaaagtagggtgtggacgcaaacctgtgacagcagagggggacgacttcacactcactgcctcatgtggcccctttcccagtggcagctggtgacactaacgattgctactcggttcacttgcccagatgtcttcatatgatgagcaaggccagaagcaaggctagattcgaagtttctgacaccatttccagtttgcacaaaagtcagtattttatcttaaagtggcttgatttccaatagctgaacttgggcagaaaacagcaggccaatgttcctatgtggtttctttgttgttgtttttgtttggggtgggggcaagtacagggtaattcatgagcaagacatttcactgctgtcgaagtctctgggatcccgctgtgggtctgagatggcctgggaaggaccttgtggacaatggttttatctgttctttttgtcactgttaatttctgggctgctgaggttctagaatagaagggctgccaaatgaggtttgctgcaggaggaaagtttaatcccccattccaaaagtccaggccaaatggtgggcttagcctctttgaaaagttctgccttgcccccacaggtgggcacatcctgtgtctcattcaccatgatgcttcctgagggtgttctagaagcccgttccccagtggctgtatccagcctttccttgcatcatcttcctcttgaaggtgaggaagtgaaaactacagacctcccccggacagcccactctctatcacgagcctaacccgcgggaggcggaagagacatccattcgagaactgaagcggcctccgggatgaggtcagaggccccacctgattttcctggtggtggtatccaaaatcttcagtaactaggaaggaaaccagggtctcatggtttaaaagactttgaagcaggaatgttgcatttgacgcctttaaaactacctttttgctgttgggaggagtcgggggcgagccttagcagctgcaccgccatccccatgctggttggtgctgccctgcctctcgtgccgggtgttgcttcagcccagagccagagggctgggtcccgggtcctccacaggtgaccccggtggacacacgcgttcccatcctggcctccgtctctgcttttccacttctacctgcgtgtgggtttgccgccttgtcatcggttgtgtgagtgtcgcagacctttccagagctccggttcactctttccaaacaggcctccctgtcggtggcactgcactcctagaaccttcagtttctacgatggtttgtttggtccttttgaaccaccccaaagaactcaacatggcaaagcaaatggtaaaagcttcccgactgttctactttgggtccgcgcgaagcccactcacgtgtgatctgtgttgcccctctcggtggtcccaggcgatccagccatgccccctgcccctctgcccagatgcttcaggggcccggcttttcaggcttgccctcaccagcggccgtcagccgacactcagggatgtagctaacaccactccgccagtgctttcagtaggaagagctgaggctgcctgggaggcccggggcgaccggaaaagggctctctcaagttctgaaaagagaatctgccaccagatcgaatttcgacccctgagcttgttcggacgtatggtccaaattcagattaaggtggtcacccaacccgagatgtcaggaaaggccttctgcagagaaaatgtccccccacccgccatctgcagccaggtgtgtgccacacggcagccttcccgaaacatagtatggattttaaaaatgtgtttatttttgtttctcaaccactttataacgtattttttaatttattttgtaatgtcttgttttgaagtattgctgctatccttgttatccttcccactgtttttatcactgatttattttgtgaaagttgtacactaatgttctatgtcaaaatcaaaagtatttaatgaaatactagttctatttaatgtggttatggaaccagctggaaacacaaaacaaacagtgattgtacagcaggctgggcccaggaggtcaggttcattttgttacatatgcaataaactcacgacttt

SEQ ID NO: 182156 - DNA, 5581 bp, Homo sapiens
  Payload ID: 15872
  Gene Symbol: SMURF1
  Gene Name: SMAD specific E3 ubiquitin protein ligase 1
  Uniprot ID: Q9HCE7
  ENST ID: ENST00000361368
  CDS Start-End: 240-2435
cggctcgggactgggctcggctggaagcagcgagggtcagagcgccgcagcaagcgccgatctcccggctcgaccatccgcctgccgcccggacgcctgggccgcggagtttgtgtcccggctcggaccccggcgcccagcccggagccgtaaccttgaggcggcggcggcggggccgggccgggccgggctggggggcggtggcgctggatccgcggctgcccgatcgttggcgggagatgtcgaaccccgggacacgcaggaacggctccagcatcaagatccgtctgacagtgttatgtgccaagaaccttgcaaagaaagacttcttcaggctccctgacccttttgcaaagattgtcgtggatgggtctgggcagtgccactcaaccgacactgtgaaaaacacattggacccaaagtggaaccagcactatgatctatatgttgggaaaacggattcgataaccattagcgtgtggaaccataagaaaattcacaagaaacagggagctggcttcctgggctgtgtgcggctgctctccaatgccatcagcagattaaaagataccggataccagcgtttggatctatgcaaactaaacccctcagatactgatgcagttcgtggccagatagtggtcagtttacagacacgagacagaataggaaccggcggctcggtggtggactgcagaggactgttagaaaatgaaggaacggtgtatgaagactccgggcctgggaggccgctcagctgcttcatggaggaaccagccccttacacagatagcaccggtgctgctgctggaggagggaattgcaggttcgtggagtccccaagtcaagatcaaagacttcaggcacagcggcttcgaaaccctgatgtgcgaggttcactacagacgccccagaaccgaccacacggccaccagtccccggaactgcccgaaggctacgaacaaagaacaacagtccagggccaagtttactttttgcatacacagactggagttagcacgtggcacgaccccaggataccaagagaccttaacagtgtgaactgtgatgaacttggaccactgccgccaggctgggaagtcagaagtacagtttctgggaggatatattttgtagatcataataaccgaacaacccagtttacagacccaaggttacaccacatcatgaatcaccagtgccaactcaaggagcccagccagccgctgccactgcccagtgagggctctctggaggacgaggagcttcctgcccagagatacgaaagagatctagtccagaagctgaaagtcctcagacacgaactgtcgcttcagcagccccaagctggtcattgccgcatcgaagtgtccagagaagaaatctttgaggagtcttaccgccagataatgaagatgcgaccgaaagacttgaaaaaacggctgatggtgaaattccgtggggaagaaggtttggattacggtggtgtggccagggagtggctttacttgctgtgccatgaaatgctgaatccttattacgggctcttccagtattctacggacaatatttacatgttgcaaataaatccggattcttcaatcaaccccgaccacttgtcttatttccactttgtggggcggatcatggggctggctgtgttccatggacactacatcaacgggggcttcacagtgcccttctacaagcagctgctggggaagcccatccagctctcagatctggaatctgtggacccagagctgcataagagcttggtgtggatcctagagaacgacatcacgcctgtactggaccacaccttctgcgtggaacacaacgccttcgggcggatcctgcagcatgaactgaaacccaatggcagaaatgtgccagtcacagaggagaataagaaagaatacgtccggttgtatgtaaactggaggtttatgagaggaatcgaagcccagttcttagctctgcagaaggggttcaatgagctcatccctcaacatctgctgaagccttttgaccagaaggaactggagctgatcataggcggcctggataaaatagacttgaacgactggaagtcgaacacgcggctgaagcactgtgtggccgacagcaacatcgtgcggtggttctggcaagcggtggagacgttcgatgaagaaaggagggccaggctcctgcagtttgtgactgggtccacgcgagtcccgctccaaggcttcaaggctttgcaaggttctacaggcgcggcagggccccggctgttcaccatccacctgatagacgcgaacacagacaaccttccgaaggcccatacctgctttaaccggatcgacattccaccatatgagtcctatgagaagctctacgagaagctgctgacagccgtggaggagacctgcgggtttgctgtggagtgaaaagcaaccaaaggcaacagagtctagctcatggccaccagaccaaaagcatccagcttctgtgcacctcctgcaaagctggcagaggccctggaattccagatcacctgaggggaaagggttgtctctctcctttctgttgggggagggggatgggggacttttgttggtggctcccacccatatatccctcctttaccatagtactcccacccacttccatcacccatccaataaaatgcagccaggtttagcctttggctttggtcacacaggatattctgctgtgttgcaacccatgtggtgataaggctcacagccctgagctctttacgggagcatcaactcacagttaggggactgggcgtggctgattgagggtttggaactggtggctatgccagctattccatctcaaaacagccttgaggccccttttcaatttgagcagctgctagatatcttatcagagctcagattccagatttcacatcccagcagccggttctgggtagcagatcaatttccaactggaaaataactatataatgtatgcttattggaattctgccacagcaggaagcttgagtcaaaatgtgtttcccctttgaaaggagaaggaattggagcagcttttcctggaggcccaggatatttcttttctgggtatcttggctgaaaattttgttttacatagagaaaaacgatcttttaagggtcccttttgctgcattatctgtccagtttgacttttttttcagtgaaaacaccatgtcatggagtgtaggaaagagcagaccaaaatcagccctagagccaaccagtcagtcccaaagctgtgacctctgtgccactgttgtccatagaagagcatcgactgtgtcacttaaaatattagtaaaccatgatgcagcaactgctaagagctaaactaacaaaattgtgtcatcatagctgctggcttggtgtgaactcgcttaaaagcaatggtgaaaggataacctcgatgatgtaaatccacccaaagatactgttctacaaaaagtagggtgtggacgcaaacctgtgacagcagagggggacgacttcacactcactgcctcatgtggcccctttcccagtggcagctggtgacactaacgattgctactcggttcacttgcccagatgtcttcatatgatgagcaaggccagaagcaaggctagattcgaagtttctgacaccatttccagtttgcacaaaagtcagtattttatcttaaagtggcttgatttccaatagctgaacttgggcagaaaacagcaggccaatgttcctatgtggtttctttgttgttgtttttgtttggggtgggggcaagtacagggtaattcatgagcaagacatttcactgctgtcgaagtctctgggatcccgctgtgggtctgagatggcctgggaaggaccttgtggacaatggttttatctgttctttttgtcactgttaatttctgggctgctgaggttctagaatagaagggctgccaaatgaggtttgctgcaggaggaaagtttaatcccccattccaaaagtccaggccaaatggtgggcttagcctctttgaaaagttctgccttgcccccacaggtgggcacatcctgtgtctcattcaccatgatgcttcctgagggtgttctagaagcccgttccccagtggctgtatccagcctttccttgcatcatcttcctcttgaaggtgaggaagtgaaaactacagacctcccccggacagcccactctctatcacgagcctaacccgcgggaggcggaagagacatccattcgagaactgaagcggcctccgggatgaggtcagaggccccacctgattttcctggtggtggtatccaaaatcttcagtaactaggaaggaaaccagggtctcatggtttaaaagactttgaagcaggaatgttgcatttgacgcctttaaaactacctttttgctgttgggaggagtcgggggcgagccttagcagctgcaccgccatccccatgctggttggtgctgccctgcctctcgtgccgggtgttgcttcagcccagagccagagggctgggtcccgggtcctccacaggtgaccccggtggacacacgcgttcccatcctggcctccgtctctgcttttccacttctacctgcgtgtgggtttgccgccttgtcatcggttgtgtgagtgtcgcagacctttccagagctccggttcactctttccaaacaggcctccctgtcggtggcactgcactcctagaaccttcagtttctacgatggtttgtttggtccttttgaaccaccccaaagaactcaacatggcaaagcaaatggtaaaagcttcccgactgttctactttgggtccgcgcgaagcccactcacgtgtgatctgtgttgcccctctcggtggtcccaggcgatccagccatgccccctgcccctctgcccagatgcttcaggggcccggcttttcaggcttgccctcaccagcggccgtcagccgacactcagggatgtagctaacaccactccgccagtgctttcagtaggaagagctgaggctgcctgggaggcccggggcgaccggaaaagggctctctcaagttctgaaaagagaatctgccaccagatcgaatttcgacccctgagcttgttcggacgtatggtccaaattcagattaaggtggtcacccaacccgagatgtcaggaaaggccttctgcagagaaaatgtccccccacccgccatctgcagccaggtgtgtgccacacggcagccttcccgaaacatagtatggattttaaaaatgtgtttatttttgtttctcaaccactttataacgtattttttaatttattttgtaatgtcttgttttgaagtattgctgctatccttgttatccttcccactgtttttatcactgatttattttgtgaaagttgtacactaatgttctatgtcaaaatcaaaagtatttaatgaaatactagttctatttaatgtggttatggaaccagctggaaacacaaaacaaacagtgattgtacagcaggctgggcccaggaggtcaggttcattttgttacatatgcaataaactcacgactttaca

SEQ ID NO: 182157 - DNA, 2918 bp, Homo sapiens
  Payload ID: 15873
  Gene Symbol: SMURF2
  Gene Name: SMAD specific E3 ubiquitin protein ligase 2
  Uniprot ID: Q9HAU4
  ENST ID: ENST00000262435
  CDS Start-End: 189-2435
ggggagctcggcgtcccgctccctccgcggctcatggcgacgactctcggcacatccgggaccctccggccgtggcggccgaggcgccggctgctcgggccccagccccggccgctgtggtgactccgccgcgcctcgccgtcgcccccgtgccgcccgccgcccccgccgcccccgccgccggggacatgtctaaccccggaggccggaggaacgggcccgtcaagctgcgcctgacagtactctgtgcaaaaaacctggtgaaaaaggattttttccgacttcctgatccatttgctaaggtggtggttgatggatctgggcaatgccattctacagatactgtgaagaatacgcttgatccaaagtggaatcagcattatgacctgtatattggaaagtctgattcagttacgatcagtgtatggaatcacaagaagatccataagaaacaaggtgctggatttctcggttgtgttcgtcttctttccaatgccatcaaccgcctcaaagacactggttatcagaggttggatttatgcaaactcgggccaaatgacaatgatacagttagaggacagatagtagtaagtcttcagtccagagaccgaataggcacaggaggacaagttgtggactgcagtcgtttatttgataacgatttaccagacggctgggaagaaaggagaaccgcctctggaagaatccagtatctaaaccatataacaagaactacgcaatgggagcgcccaacacgaccggcatccgaatattctagccctggcagacctcttagctgctttgttgatgagaacactccaattagtggaacaaatggtgcaacatgtggacagtcttcagatcccaggctggcagagaggagagtcaggtcacaacgacatagaaattacatgagcagaacacatttacatactcctccagacctaccagaaggctatgaacagaggacaacgcaacaaggccaggtgtatttcttacatacacagactggtgtgagcacatggcatgatccaagagtgcccagggatcttagcaacatcaattgtgaagagcttggtccattgcctcctggatgggagatccgtaatacggcaacaggcagagtttatttcgttgaccataacaacagaacaacacaatttacagatcctcggctgtctgctaacttgcatttagttttaaatcggcagaaccaattgaaagaccaacagcaacagcaagtggtatcgttatgtcctgatgacacagaatgcctgacagtcccaaggtacaagcgagacctggttcagaaactaaaaattttgcggcaagaactttcccaacaacagcctcaggcaggtcattgccgcattgaggtttccagggaagagatttttgaggaatcatatcgacaggtcatgaaaatgagaccaaaagatctctggaagcgattaatgataaaatttcgtggagaagaaggccttgactatggaggcgttgccagggaatggttgtatctcttgtcacatgaaatgttgaatccatactatggcctcttccagtattcaagagatgatatttatacattgcagatcaatcctgattctgcagttaatccggaacatttatcctatttccactttgttggacgaataatgggaatggctgtgtttcatggacattatattgatggtggtttcacattgcctttttataagcaattgcttgggaagtcaattaccttggatgacatggagttagtagatccggatcttcacaacagtttagtgtggatacttgagaatgatattacaggtgttttggaccataccttctgtgttgaacataatgcatatggtgaaattattcagcatgaacttaaaccaaatggcaaaagtatccctgttaatgaagaaaataaaaaagaatatgtcaggctctatgtgaactggagatttttacgaggcattgaggctcaattcttggctctgcagaaaggatttaatgaagtaattccacaacatctgctgaagacatttgatgagaaggagttagagctcattatttgtggacttggaaagatagatgttaatgactggaaggtaaacacccggttaaaacactgtacaccagacagcaacattgtcaaatggttctggaaagctgtggagttttttgatgaagagcgacgagcaagattgcttcagtttgtgacaggatcctctcgagtgcctctgcagggcttcaaagcattgcaaggtgctgcaggcccgagactctttaccatacaccagattgatgcctgcactaacaacctgccgaaagcccacacttgcttcaatcgaatagacattccaccctatgaaagctatgaaaagctatatgaaaagctgctaacagccattgaagaaacatgtggatttgctgtggaatgacaagcttcaaggatttacccaggactctatttatacaaccctgactgacagcctcctttcagcagagtttcaaagaatatgctgaaatacaggaaaacactccccccccccccctttttttttttttttttacattttaggacactgtgaggggaaaggacaattttgaaattccttttcaaggaaaaaaaaggtctttatgctttgccatgaggccacattcagctgctatttaaacttaatatcttgaacctaaagaatgctgacttttcctacatttccagagttaggcagtattctacacttaaagactactactatttttataaaaggtaatctattcaaatttcttcacagatttcaagtctctcaaacatcaagacaacttcagcagtcggtacaagtcacatttcattttgattgaatacatgatcttgaacagctcctgtacttgctctttgtaaaaaaaaataaaattatttt

SEQ ID NO: 182158 - DNA, 5892 bp, Homo sapiens
  Payload ID: 15873
  Gene Symbol: SMURF2
  Gene Name: SMAD specific E3 ubiquitin protein ligase 2
  ENST ID: ENST00000582081
  CDS Start-End: 18-185
cccccgccgccggggacatgtctaaccccggaggccggaggaacgggcccgtcaagctgcgcctgacaggacttcctgatccatttgctaaggtggtggttgatggatctgggcaatgccattctacagatactgtgaagaatacgcttgatccaaagtggaatcagcattatgacctgcagtgaagtgaaatctgcaagagtcctgctcgctcaaggcctgcatacaggaaagaagcaggggaaaagcgttacaaacagcttttgttctacagcattttaaaatataacaggtatattggaaagtctgattcagttacgatcagtgtatggaatcacaagaagatccataagaaacaaggtgctggatttctcggttgtgttcgtcttctttccaatgccatcaaccgcctcaaagacactggttatcagaggttggatttatgcaaactcgggccaaatgacaatgatacagttagaggacagatagtagtaagtcttcagtccagagaccgaataggcacaggaggacaagttgtggactgcagtcgtttatttgataacgatttaccagacggctgggaagaaaggagaaccgcctctggaagaatccagtatctaaaccatataacaagaactacgcaatgggagcgcccaacacgaccggcatccgaatattctagccctggcagacctcttagctgctttgttgatgagaacactccaattagtggaacaaatggtgcaacatgtggacagtcttcagatcccaggctggcagagaggagagtcaggtcacaacgacatagaaattacatgagcagaacacatttacatactcctccagacctaccagaaggctatgaacagaggacaacgcaacaaggccaggtgtatttcttacatacacagactggtgtgagcacatggcatgatccaagagtgcccagggatcttagcaacatcaattgtgaagagcttggtccattgcctcctggatgggagatccgtaatacggcaacaggcagagtttatttcgttgaccataacaacagaacaacacaatttacagatcctcggctgtctgctaacttgcatttagttttaaatcggcagaaccaattgaaagaccaacagcaacagcaagtggtatcgttatgtcctgatgacacagaatgcctgacagtcccaaggtacaagcgagacctggttcagaaactaaaaattttgcggcaagaactttcccaacaacagcctcaggcaggtcattgccgcattgaggtttccagggaagagatttttgaggaatcatatcgacaggtcatgaaaatgagaccaaaagatctctggaagcgattaatgataaaatttcgtggagaagaaggccttgactatggaggcgttgccagggaatggttgtatctcttgtcacatgaaatgttgaatccatactatggcctcttccagtattcaagagatgatatttatacattgcagatcaatcctgattctgcagttaatccggaacatttatcctatttccactttgttggacgaataatgggaatggctgtgtttcatggacattatattgatggtggtttcacattgcctttttataagcaattgcttgggaagtcaattaccttggatgacatggagttagtagatccggatcttcacaacagtttagtgtggatacttgagaatgatattacaggtgttttggaccataccttctgtgttgaacataatgcatatggtgaaattattcagcatgaacttaaaccaaatggcaaaagtatccctgttaatgaagaaaataaaaaagaatatgtcaggctctatgtgaactggagatttttacgaggcattgaggctcaattcttggctctgcagaaaggatttaatgaagtaattccacaacatctgctgaagacatttgatgagaaggagttagagctcattatttgtggacttggaaagatagatgttaatgactggaaggtaaacacccggttaaaacactgtacaccagacagcaacattgtcaaatggttctggaaagctgtggagttttttgatgaagagcgacgagcaagattgcttcagtttgtgacaggatcctctcgagtgcctctgcagggcttcaaagcattgcaaggtgctgcaggcccgagactctttaccatacaccagattgatgcctgcactaacaacctgccgaaagcccacacttgcttcaatcgaatagacattccaccctatgaaagctatgaaaagctatatgaaaagctgctaacagccattgaagaaacatgtggatttgctgtggaatgacaagcttcaaggatttacccaggactctatttatacaaccctgactgacagcctcctttcagcagagtttcaaagaatatgctgaaatacaggaaaacactccccccccccccctttttttttttttttttacattttaggacactgtgaggggaaaggacaattttgaaattccttttcaaggaaaaaaaaggtctttatgctttgccatgaggccacattcagctgctatttaaacttaatatcttgaacctaaagaatgctgacttttcctacatttccagagttaggcagtattctacacttaaagactactactatttttataaaaggtaatctattcaaatttcttcacagatttcaagtctctcaaacatcaagacaacttcagcagtcggtacaagtcacatttcattttgattgaatacatgatcttgaacagctcctgtacttgctctttgtaaaaaaaaataaaattattttgaattattctacctttgtaaacaattggctaaaagaatcatctttaagaaattaagccatttacatgtttgtgtttttctatagcagagcattatattttgcattatatgtttcaacctagtctaagtgggtcttttttacatttttcaagaacggatttcctggaatacagcgatataattttggttgtcaaattcctaatgcaaccatttagtctaaacttagtcatttatttgtgacaataagatgtgttcaggggctccctgtttttaagagactcttttaaaaaaaaaaaaacctaatgtttttatcttgagtcaatatgattaggtattttggatttacttttaatcttaaaatactgcatttttatagcttctcagagcatgtggatgggatgggattttcgttattttgctgggtcagcttatctttaatatatggactattcctataaaccaaagtctctgacaagtgcacctaatttatattgtattttaactacagtgtaagtttccattaacaaaaccatcctaaagcgttaactgctcataattttaatcagctacagttatgaaaaaggaagaattttgctctaaagattattaataagcttagaaaatcctgcttttacctaacagaatgaagtggggttgaggggcggtagtatgaacagtgattctaactctatggcgtaaattactttgaagagttcattttggaagtaagggaatcccgcttcccttggtgttgaagatctgcatctgattttgaaacgtccagatttagctttcaaggtgcgtgcatgttgaatgatccagaagcaacgaaaactctggggtgagggattgaaaaaatctgaaatcacagttggatttttaaattcaaccatcaaaaatatgtactatcagtttttttttacattgatgtgaaataagcaaattttcatgataattaagctgcaaaatttaaagttatcaagtaaataggtcctctgtgttctgtttcatgtgatggagtgggtttcagtctgtgttcttggagccaaagggttcctcaggggtgcctcaggagtaatggtttaagagaagaggggcaatgagagggagcgagggggaaggcctagttggtatttgagcaggggccttaggctccatatccccaccccctttacccagaacagcccatttttcttatgtatattggaatttcaagtaagctttcatggggtgcagtggggcggggaggaatggatgggataaaaaaagtggagattttgctgctttaaaaaagttgagaactacttgtgtagtttttaagtattttaatgtatttcatttggccaaattcaactgccacaagcaagctagtcatagttgtaactgtgcagtggtaatatgcttatgcctacctttttcctctcaaacaatttgttttttttacattgcattctgagtactgaagagcatcttgaaatgtatggaagtggtttctatgctatttgataatcagtaatgttcagctgtcatgatagtactttactggttgcagacccatctctcttttatattaaagcactagtgcagtttataattgtgcctacttttaaaatctttcagtaaaaaagtacataatgaatacagaaatcataactgacagggatacagtaataatgaaatgctactatcacttattttaatatacaatataaagcaggcaaataccattgctttttgagtgcctttttaactttatactaatgacttaatagagctttaaaagaaagaaattggctgggcatggtggctcacacctgtaatcccagcactttgggaggccgaggtgggcggatcacctgaggtcaggagttcgagaccagcctggccaacgtggtgaaaccctgtctctactaaaaatacaaaatttagccgggcatggtggcgcactcctgtaatccaactacttgggaggctgaggcaggagaattgcttgaatctgggaggcagagattgcagtgagccgagatcgcaccactgcactccagcctgggcgacaagagtgagactccgtccccgcccaaaaaaaaaaaaaaaagaaattactctccataacagtctatgttatcaccaacatatataaaaacatgatttagatttccatttcaaagttacattacccgattacttccaaataggtgctaagcaaaaacccccaatgtattattgaaccatggacttgcacctcatgtttaatgtgaatatttatttccatgtccctcttaactggttttttcttgtcttccctctagctgtattgttatttcagatatgtgatatctgttttcatactcttgcctttccatcatgaatgcttagttatgaacagagattcctttgtagagctcataggcagtacagagaggtaagtcttgcctcagagggccttgtatcttggtgtagtttttaaatagtgcatagtgtatagtgtatagtgtacattttgttttgcacatagtttgttgccccgaatgggttttttaccaagcctttttttctttcatgtatttacagtccggagcacaagattctcttctttcaaatacaatgtaattcgctttactttacaacactaaatctgggctttgaatttccagtgcattggactgattggattgttgggagttagaggctgttccaaccatccttagtttgggagagtggctccttctgcttgttttctaagcgtacagtcaacgggtgccatttgtggtatttaacatgttaggatgattgttccaaatgctgagttgttttatttctagatgtaattagttcactttatgtaatattcttctctcagactgactttaaaaacaaagttttatcattttcattgtatttgtatttattacagagtgttttagctttgatattctttgtattttcattcatttgttacatgagctttatcagtaacatctgtataaatggtttttaaaaattaactatgtatgtgcccatgccgaagtcgagcaataaaatcaatgctgtttgcactgtcacagcatcaa

SEQ ID NO: 182159 - DNA, 1716 bp, Homo sapiens
  Payload ID: 15873
  Gene Symbol: SMURF2
  Gene Name: SMAD specific E3 ubiquitin protein ligase 2
  ENST ID: ENST00000585301
  CDS Start-End: 33-1716
ccgccgcccccgccgcccccgccgccggggacatgtctaaccccggaggccggaggaacgggcccgtcaagctgcgcctgacaggacttcctgatccatttgctaaggtggtggttgatggatctgggcaatgccattctacagatactgtgaagaatacgcttgatccaaagtggaatcagcattatgacctgtatattggaaagtctgattcagttacgatcagtgtatggaatcacaagaagatccataagaaacaaggtgctggatttctcggttgtgttcgtcttctttccaatgccatcaaccgcctcaaagacactggttatcagaggttggatttatgcaaactcgggccaaatgacaatgatacagttagaggacagatagtagtaagtcttcagtccagagaccgaataggcacaggaggacaagttgtggactgcagtcgtttatttgataacgatttaccagacggctgggaagaaaggagaaccgcctctggaagaatccagtatctaaaccatataacaagaactacgcaatgggagcgcccaacacgaccggcatccgaatattctagccctggcagacctcttagctgctttgttgatgagaacactccaattagtggaacaaatggtgcaacatgtggacagtcttcagatcccaggctggcagagaggagagtcaggtcacaacgacatagaaattacatgagcagaacacatttacatactcctccagacctaccagaaggctatgaacagaggacaacgcaacaaggccaggtgtatttcttacatacacagactggtgtgagcacatggcatgatccaagagtgcccagggatcttagcaacatcaattgtgaagagcttggtccattgcctcctggatgggagatccgtaatacggcaacaggcagagtttatttcgttgaccataacaacagaacaacacaatttacagatcctcggctgtctgctaacttgcatttagttttaaatcggcagaaccaattgaaagaccaacagcaacagcaagtggtatcgttatgtcctgatgacacagaatgcctgacagtcccaaggtacaagcgagacctggttcagaaactaaaaattttgcggcaagaactttcccaacaacagcctcaggcaggtcattgccgcattgaggtttccagggaagagatttttgaggaatcatatcgacaggtcatgaaaatgagaccaaaagatctctggaagcgattaatgataaaatttcgtggagaagaaggccttgactatggaggcgttgccagggaatggttgtatctcttgtcacatgaaatgttgaatccatactatggcctcttccagtattcaagagatgatatttatacattgcagatcaatcctgattctgcagttaatccggaacatttatcctatttccactttgttggacgaataatgggaatggctgtgtttcatggacattatattgatggtggtttcacattgcctttttataagcaattgcttgggaagtcaattaccttggatgacatggagttagtagatccggatcttcacaacagtttagtgtggatacttgagaatgatattacaggtgttttggaccataccttctgtgttgaacataatgcatatggtgaaattattcagcatgaacttaaaccaaatggcaaaagtatccctgttaatg

SEQ ID NO: 182160 - DNA, 3104 bp, Homo sapiens
  Payload ID: 15873
  Gene Symbol: SMURF2
  Gene Name: SMAD specific E3 ubiquitin protein ligase 2
  ENST ID: ENST00000578386
  CDS Start-End: 49-255
gtcgcccccgtgccgcccgccgcccccgccgcccccgccgccggggacatgtctaaccccggaggccggaggaacgggcccgtcaagctgcgcctgacagtactctgtgcaaaaaacctggtgaaaaaggattttttccgacttcctgatccatttgctaaggtggtggttgatggatctgggcaatgccattctacagatactgtgaagaatacgcttgatccaaagtggaatcagcattatgacctgcagtgaagtgaaatctgcaagagtcctgctcgctcaaggcctgcatacaggaaagaagcaggggaaaagcgttacaaacagcttttgttctacagcattttaaaatataacaggtatattggaaagtctgattcagttacgatcagtgtatggaatcacaagaagatccataagaaacaaggtgctggatttctcggttgtgttcgtcttctttccaatgccatcaaccgcctcaaagacactggttatcagaggttggatttatgcaaactcgggccaaatgacaatgatacagttagaggacagatagtagctgggaagaaaggagaaccgcctctggaagaatccagtatctaaaccatataacaagaactacgcaatgggagcgcccaacacgaccggcatccgaatattctagccctggcagacctcttagctgctttgttgatgagaacactccaattagtggaacaaatggtgcaacatgtggacagtcttcagatcccaggctggcagagaggagagtcaggtcacaacgacatagaaattacatgagcagaacacatttacatactcctccagacctaccagaaggctatgaacagaggacaacgcaacaaggccaggtgtatttcttacatacacagactggtgtgagcacatggcatgatccaagagtgcccagggatcttagcaacatcaattgtgaagagcttggtccattgcctcctggatgggagatccgtaatacggcaacaggcagagtttatttcgttgaccataacaacagaacaacacaatttacagatcctcggctgtctgctaacttgcatttagttttaaatcggcagaaccaattgaaagaccaacagcaacagcaagtggtatcgttatgtcctgatgacacagaatgcctgacagtcccaaggtacaagcgagacctggttcagaaactaaaaattttgcggcaagaactttcccaacaacagcctcaggcaggtcattgccgcattgaggtttccagggaagagatttttgaggaatcatatcgacaggtcatgaaaatgagaccaaaagatctctggaagcgattaatgataaaatttcgtggagaagaaggccttgactatggaggcgttgccagggaatggttgtatctcttgtcacatgaaatgttgaatccatactatggcctcttccagtattcaagagatgatatttatacattgcagatcaatcctgattctgcagttaatccggaacatttatcctatttccactttgttggacgaataatgggaatggctgtgtttcatggacattatattgatggtggtttcacattgcctttttataagcaattgcttgggaagtcaattaccttggatgacatggagttagtagatccggatcttcacaacagtttagtgtggatacttgagaatgatattacaggtgttttggaccataccttctgtgttgaacataatgcatatggtgaaattattcagcatgaacttaaaccaaatggcaaaagtatccctgttaatgaagaaaataaaaaagaatatgtcaggctctatgtgaactggagatttttacgaggcattgaggctcaattcttggctctgcagaaaggatttaatgaagtaattccacaacatctgctgaagacatttgatgagaaggagttagagctcattatttgtggacttggaaagatagatgttaatgactggaaggtaaacacccggttaaaacactgtacaccagacagcaacattgtcaaatggttctggaaagctgtggagttttttgatgaagagcgacgagcaagattgcttcagtttgtgacaggatcctctcgagtgcctctgcagggcttcaaagcattgcaaggtgctgcaggcccgagactctttaccatacaccagattgatgcctgcactaacaacctgccgaaagcccacacttgcttcaatcgaatagacattccaccctatgaaagctatgaaaagctatatgaaaagctgctaacagccattgaagaaacatgtggatttgctgtggaatgacaagcttcaaggatttacccaggactctatttatacaaccctgactgacagcctcctttcagcagagtttcaaagaatatgctgaaatacaggaaaacactccccccccccccctttttttttttttttttacattttaggacactgtgaggggaaaggacaattttgaaattccttttcaaggaaaaaaaaggtctttatgctttgccatgaggccacattcagctgctatttaaacttaatatcttgaacctaaagaatgctgacttttcctacatttccagagttaggcagtattctacacttaaagactactactatttttataaaaggtaatctattcaaatttcttcacagatttcaagtctctcaaacatcaagacaacttcagcagtcggtacaagtcacatttcattttgattgaatacatgatcttgaacagctcctgtacttgctctttgtaaaaaaaaataaaattattttgaattattctacctttgtaaacaattggctaaaagaatcatctttaagaaattaagccatttacatgtttgtgtttttctatagcagagcattatattttgcattatatgtttcaacctagtctaagtgggtcttttttacatttttcaagaacggatttcctggaatacagcgatataattttggttgtcaaattcctaatgcaaccatttagtctaaacttagtcatttatttgtgacaataagatgtgttcaggggctccctgtttttaagagactcttttaaaaaaaaaaaaa

SEQ ID NO: 182161 - DNA, 2403 bp, Homo sapiens
  Payload ID: 15874
  Gene Symbol: SMAP1
  Gene Name: small ArfGAP 1
  Uniprot ID: Q8IYB5
  ENST ID: ENST00000316999
  CDS Start-End: 249-1571
agtccccctccccctcccctcgccggctagggtggtgcgtgccggcaggccggtcaaggaggcgggacacgtcggcgctaccaccgccaccgccgccgccgcccctcctcccgttccagctgccgctgccgcttcctgggctgagtccgcccgcggtcccggcggcgccaggtgcgttcactctgcccggctccagccagcgtccgccgccgccgtagctgccccaggctccccgccccgctgccgagatggcgacgcgctcctgtcgggagaaggctcagaagctgaacgagcagcaccagctcatcctatccaagcttctgagggaggaggacaacaagtactgcgccgactgcgaggccaaaggtcctcgatgggcttcctggaatattggtgtgtttatttgcatcagatgtgctggaattcatagaaatcttggggttcatatatccagggtcaaatcagtcaacctagaccaatggacagcagaacagatacagtgcatgcaagatatgggaaatactaaagcaagactactctatgaagccaatcttccagagaactttcgaagaccacagacagatcaagcagtggaatttttcatcagagataaatatgaaaagaagaaatactacgataaaaatgccatagctattacaaataaagaaaaggaaaaaaaaaaggaagagaaaaagagagaaaaggagccagaaaagccggcaaaaccacttacagctgaaaagctgcagaagaaagatcagcaactggagcctaaaaaaagtaccagccctaaaaaagctgcggagcccactgtggatcttttaggacttgatggccctgctgtggcaccagtgaccaacgggaacacaacggtgccacccctgaacgatgatctggacatctttggaccgatgatttctaatcccttacctgcaactgtcatgcccccagctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtgtatttatgggacccacaaatataccatttacctcacaagcaccagctgcatttcagggctttccatcgatgggcgtgcctgtgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacagatgaatcagcagatggctggcatgagtatcagtagtgcaacccctactgcaggttttggccagccctccagcacaacagcaggatggtctggaagctcatcaggtcagactctcagcacacaactgtggaaatgaaaactgcaatacaagtttcatccagaactaccacctgacattccttgctgaaacgcatctagttcccctgtttattcatatgcatattttttttctttttacccatttgttcatattaagaatgatctgattgaccgtgttggtctgtactgattcaatttgatgtggtgaaaagcaggttgataaatcattttatgtcaagggcagctttgctcatatttcccatgatttcatgtactgcattatttgagaagctgctcaacttgcaaaatcagttttcctctcaataaaattatagctctaatgtttgcatataagggaagtagttatcatgttagtaatacctctaatagtataaaccccaccccaaaattagccagtaatcctgtaggaaggtactgtatgatcaaatgtttaatcatataaatagaatgtaaatgtctcactgagcactgttttctagtgtatcaaaatgctcttatttcatcattcacttcactgtgctgttgttatgatgtgcttaacagggaacgtgattagtgaaaggaagataaacgtggatgttactccaaaacttcgtttaatgaatgcttaaagaattcaaattttatctgcctctcttgtaatttggatctcttcttaatgtacatagtgctaacatgaagacctttttctgcactatatgcaaacagggtaactaactaaaacaaagccactttcaatcttcaatccttgaaggtatatctaggtttatgacagtaattgtgtttacattttatggtgcctagtattgacaaaatgttatttccctacattaaacatgactccatag

SEQ ID NO: 182162 - DNA, 2491 bp, Homo sapiens
  Payload ID: 15874
  Gene Symbol: SMAP1
  Gene Name: small ArfGAP 1
  Uniprot ID: Q8IYB5
  ENST ID: ENST00000370452
  CDS Start-End: 249-1559
agtccccctccccctcccctcgccggctagggtggtgcgtgccggcaggccggtcaaggaggcgggacacgtcggcgctaccaccgccaccgccgccgccgcccctcctcccgttccagctgccgctgccgcttcctgggctgagtccgcccgcggtcccggcggcgccaggtgcgttcactctgcccggctccagccagcgtccgccgccgccgtagctgccccaggctccccgccccgctgccgagatggcgacgcgctcctgtcgggagaaggctcagaagctgaacgagcagcaccagctcatcctatccaagcttctgagggaggaggacaacaagtactgcgccgactgcgaggccaaaggtcctcgatgggcttcctggaatattggtgtgtttatttgcatcagatgtgctggaattcatagaaatcttggggttcatatatccagggtcaaatcagtcaacctagaccaatggacagcagaacagatacagtgcatgcaagatatgggaaatactaaagcaagactactctatgaagccaatcttccagagaactttcgaagaccacagacagatcaagcagtggaatttttcatcagagataaatatgaaaagaagaaatactacgataaaaatgccatagctattacaaataaagaaaaggaaaaaaaaaaggaagagaaaaagagagaaaaggagccagaaaagccggcaaaaccacttacagctgaaaagctgcagaagaaagatcagcaactggagcctaaaaaaagtaccagccctaaaaaagctgcggagcccactgtggatcttttaggacttgatggccctgctgtggcaccagtgaccaacgggaacacaacggtgccacccctgaacgatgatctggacatctttggaccgatgatttctaatcccttacctgcaactgtcatgcccccagctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtgtatttatgggacccacaaatataccatttacctcacaagcaccagctgcatttcagggctttccatcgatgggcgtgcctgtgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacagataatgcagaagggtgatgctgttctccagcactccatcagtgcaatctactggccaatgacaaggtggttaaaatgtcctttagtagatgaatcagcagatggctggcatgagtatcagtagtgcaacccctactgcaggttttggccagccctccagcacaacagcaggatggtctggaagctcatcaggtcagactctcagcacacaactgtggaaatgaaaactgcaatacaagtttcatccagaactaccacctgacattccttgctgaaacgcatctagttcccctgtttattcatatgcatattttttttctttttacccatttgttcatattaagaatgatctgattgaccgtgttggtctgtactgattcaatttgatgtggtgaaaagcaggttgataaatcattttatgtcaagggcagctttgctcatatttcccatgatttcatgtactgcattatttgagaagctgctcaacttgcaaaatcagttttcctctcaataaaattatagctctaatgtttgcatataagggaagtagttatcatgttagtaatacctctaatagtataaaccccaccccaaaattagccagtaatcctgtaggaaggtactgtatgatcaaatgtttaatcatataaatagaatgtaaatgtctcactgagcactgttttctagtgtatcaaaatgctcttatttcatcattcacttcactgtgctgttgttatgatgtgcttaacagggaacgtgattagtgaaaggaagataaacgtggatgttactccaaaacttcgtttaatgaatgcttaaagaattcaaattttatctgcctctcttgtaatttggatctcttcttaatgtacatagtgctaacatgaagacctttttctgcactatatgcaaacagggtaactaactaaaacaaagccactttcaatcttcaatccttgaaggtatatctaggtttatgacagtaattgtgtttacattttatggtgcctagtattgacaaaatgttatttccctacattaaacatgactccatag

SEQ ID NO: 182163 - DNA, 3333 bp, Homo sapiens
  Payload ID: 15874
  Gene Symbol: SMAP1
  Gene Name: small ArfGAP 1
  Uniprot ID: Q8IYB5
  ENST ID: ENST00000370455
  CDS Start-End: 249-1652
agtccccctccccctcccctcgccggctagggtggtgcgtgccggcaggccggtcaaggaggcgggacacgtcggcgctaccaccgccaccgccgccgccgcccctcctcccgttccagctgccgctgccgcttcctgggctgagtccgcccgcggtcccggcggcgccaggtgcgttcactctgcccggctccagccagcgtccgccgccgccgtagctgccccaggctccccgccccgctgccgagatggcgacgcgctcctgtcgggagaaggctcagaagctgaacgagcagcaccagctcatcctatccaagcttctgagggaggaggacaacaagtactgcgccgactgcgaggccaaaggtcctcgatgggcttcctggaatattggtgtgtttatttgcatcagatgtgctggaattcatagaaatcttggggttcatatatccagggtcaaatcagtcaacctagaccaatggacagcagaacagatacagtgcatgcaagatatgggaaatactaaagcaagactactctatgaagccaatcttccagagaactttcgaagaccacagacagatcaagcagtggaatttttcatcagagataaatatgaaaagaagaaatactacgataaaaatgccatagctattacaaatatttcctcctctgatgctcctcttcagcctttggtatcctctccttctctgcaagctgctgttgacaaaaataaattggagaaagaaaaggaaaaaaaaaaggaagagaaaaagagagaaaaggagccagaaaagccggcaaaaccacttacagctgaaaagctgcagaagaaagatcagcaactggagcctaaaaaaagtaccagccctaaaaaagctgcggagcccactgtggatcttttaggacttgatggccctgctgtggcaccagtgaccaacgggaacacaacggtgccacccctgaacgatgatctggacatctttggaccgatgatttctaatcccttacctgcaactgtcatgcccccagctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtgtatttatgggacccacaaatataccatttacctcacaagcaccagctgcatttcagggctttccatcgatgggcgtgcctgtgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacagatgaatcagcagatggctggcatgagtatcagtagtgcaacccctactgcaggttttggccagccctccagcacaacagcaggatggtctggaagctcatcaggtcagactctcagcacacaactgtggaaatgaaaactgcaatacaagtttcatccagaactaccacctgacattccttgctgaaacgcatctagttcccctgtttattcatatgcatattttttttctttttacccatttgttcatattaagaatgatctgattgaccgtgttggtctgtactgattcaatttgatgtggtgaaaagcaggttgataaatcattttatgtcaagggcagctttgctcatatttcccatgatttcatgtactgcattatttgagaagctgctcaacttgcaaaatcagttttcctctcaataaaattatagctctaatgtttgcatataagggaagtagttatcatgttagtaatacctctaatagtataaaccccaccccaaaattagccagtaatcctgtaggaaggtactgtatgatcaaatgtttaatcatataaatagaatgtaaatgtctcactgagcactgttttctagtgtatcaaaatgctcttatttcatcattcacttcactgtgctgttgttatgatgtgcttaacagggaacgtgattagtgaaaggaagataaacgtggatgttactccaaaacttcgtttaatgaatgcttaaagaattcaaattttatctgcctctcttgtaatttggatctcttcttaatgtacatagtgctaacatgaagacctttttctgcactatatgcaaacagggtaactaactaaaacaaagccactttcaatcttcaatccttgaaggtatatctaggtttatgacagtaattgtgtttacattttatggtgcctagtattgacaaaatgttatttccctacattaaacatgactccatagaccttttcatttgtgggtttttatttcctatgatgtatactgccactaaccttccaaaaattacttagtattgcaaagtcaggaatcatcaggaacgtttagctgacaaaatacttgtctgttttaaaaacctgttcaagtctaccaacctgttcaagtctaccaattataagggcaaattggagaaaaagaaaaaatatatactcaagagtggtatcttgcagtatcggcactgtacaaaaaaatcttccaatttagttgttgtagagaaaacatgcagaacaaatgaagacaaaacatacattttgtaccaaccatccaattagcttatgttaactgacaagctccatttaaacagatgtccatcagatgacaagaaaggctgctgtactgaagtaaaacaaacaatacctgaatgctctgtagcctaaactccaaacatcctcttccatatggatccactggctggacaaactgcaccagttgctgcttcaatttatacctcaattttcactgtgtccaggtggtactttggctcgttggctagattaaccttctctgtccgagtgtgccacacgagaacctgaaggggaaggaaatagcttgggtagcgcactcttcatggtgacactcgaggtcgggcagcacaagtgtaatgaataccttagtgcagttatttgctttcggttccagttcttcgactgttgttatctgtttgagaaagtcagattcttgcatccctggctgggatccacgacgcttaaatacagcttttggattggacaaaatgacttgaagacttacagcaaatcctttgtgaaaaataaaaaaaaaaaagagactttaaaa

SEQ ID NO: 182164 - DNA, 419 bp, Homo sapiens
  Payload ID: 15874
  Gene Symbol: SMAP1
  Gene Name: small ArfGAP 1
  ENST ID: ENST00000439432
  CDS Start-End: 1-376
gaaatactacgataaaaatgccatagctattacaaatatttcctcctctgatgctcctcttcagcctttggtatcctctccttctctgcaagctgctgttgacaaaaataaattggagaaagaaaaggaaaaaaaaaaggaagagaaaaagagagaaaaggagccagaaaagccggcaaaaccacttacagctgaaaagctgcagaagaaagatcagcaactggagcctaaaaaaagtaccagccctaaaaaagctgcggagcccactgtggatcttttaggacttgtttggagaaagattgagaaggaaaagagtgaaaggcagttagttgaagtggaagagttgaccttcatgtactgctttccaaaaaattgatcctagttgttattgaataaattgttgtctgttttaagaatta

SEQ ID NO: 182165 - DNA, 578 bp, Homo sapiens
  Payload ID: 15874
  Gene Symbol: SMAP1
  Gene Name: small ArfGAP 1
  ENST ID: ENST00000445046
  CDS Start-End: 393-578
ttaaaggacccaaagtatgtacagcatatatagtataggatgtctggctcagtgtgggtacttgcatagatgttaatttcttataccaaaaaccccaaatgaacctgaattgaatttaaagtgtggtgatgcattgatagtggtggtggtgatgtaggaattaagaattgtcatttacttttctttctagaattagtttggatgagttttgttcagtgagaaaatttcctgaaagaggtagacttctttaagagaaagaaaagtagtttacagaatgtagttgcagaaataatgtgaaagagagcacagattgaggagtaggaaaattaaatttagagtcccagctttgtggagtggcgtgaataaagggaagtgtacatatcactgaattcatgcttttccttaagttatctgttttcagagcagtggaatttttcatcagagataaatatgaaaagaagaaatactacgataaaaatgccatagctattacaaatatttcctcctctgatgctcctcttcagcctttggtatcctctccttctctgcaagctgctgttgacaaaaataaattggag

SEQ ID NO: 182166 - DNA, 3150 bp, Homo sapiens
  Payload ID: 15874
  Gene Symbol: SMAP1
  Gene Name: small ArfGAP 1
  ENST ID: ENST00000619054
  CDS Start-End: 100-1473
atctctgtgggtggggccgcgcttaggtctggatcccctcctctaccctccggtgtgaccacgtcctcccactccgggctcggattcttggtctcctagatggagccctacctgcctgcccacctgacagcttttgtacaaggcttttatctctgcttcctgaaaaagagtatggtggtctttttcggtcctcgatgggcttcctggaatattggtgtgtttatttgcatcagatgtgctggaattcatagaaatcttggggttcatatatccagggtcaaatcagtcaacctagaccaatggacagcagaacagatacagtgcatgcaagatatgggaaatactaaagcaagactactctatgaagccaatcttccagagaactttcgaagaccacagacagatcaagcagtggaatttttcatcagagataaatatgaaaagaagaaatactacgataaaaatgccatagctattacaaatatttcctcctctgatgctcctcttcagcctttggtatcctctccttctctgcaagctgctgttgacaaaaataaattggagaaagaaaaggaaaaaaaaaaggaagagaaaaagagagaaaaggagccagaaaagccggcaaaaccacttacagctgaaaagctgcagaagaaagatcagcaactggagcctaaaaaaagtaccagccctaaaaaagctgcggagcccactgtggatcttttaggacttgatggccctgctgtggcaccagtgaccaacgggaacacaacggtgccacccctgaacgatgatctggacatctttggaccgatgatttctaatcccttacctgcaactgtcatgcccccagctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtgtatttatgggacccacaaatataccatttacctcacaagcaccagctgcatttcagggctttccatcgatgggcgtgcctgtgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacagatgaatcagcagatggctggcatgagtatcagtagtgcaacccctactgcaggttttggccagccctccagcacaacagcaggatggtctggaagctcatcaggtcagactctcagcacacaactgtggaaatgaaaactgcaatacaagtttcatccagaactaccacctgacattccttgctgaaacgcatctagttcccctgtttattcatatgcatattttttttctttttacccatttgttcatattaagaatgatctgattgaccgtgttggtctgtactgattcaatttgatgtggtgaaaagcaggttgataaatcattttatgtcaagggcagctttgctcatatttcccatgatttcatgtactgcattatttgagaagctgctcaacttgcaaaatcagttttcctctcaataaaattatagctctaatgtttgcatataagggaagtagttatcatgttagtaatacctctaatagtataaaccccaccccaaaattagccagtaatcctgtaggaaggtactgtatgatcaaatgtttaatcatataaatagaatgtaaatgtctcactgagcactgttttctagtgtatcaaaatgctcttatttcatcattcacttcactgtgctgttgttatgatgtgcttaacagggaacgtgattagtgaaaggaagataaacgtggatgttactccaaaacttcgtttaatgaatgcttaaagaattcaaattttatctgcctctcttgtaatttggatctcttcttaatgtacatagtgctaacatgaagacctttttctgcactatatgcaaacagggtaactaactaaaacaaagccactttcaatcttcaatccttgaaggtatatctaggtttatgacagtaattgtgtttacattttatggtgcctagtattgacaaaatgttatttccctacattaaacatgactccatagaccttttcatttgtgggtttttatttcctatgatgtatactgccactaaccttccaaaaattacttagtattgcaaagtcaggaatcatcaggaacgtttagctgacaaaatacttgtctgttttaaaaacctgttcaagtctaccaacctgttcaagtctaccaattataagggcaaattggagaaaaagaaaaaatatatactcaagagtggtatcttgcagtatcggcactgtacaaaaaaatcttccaatttagttgttgtagagaaaacatgcagaacaaatgaagacaaaacatacattttgtaccaaccatccaattagcttatgttaactgacaagctccatttaaacagatgtccatcagatgacaagaaaggctgctgtactgaagtaaaacaaacaatacctgaatgctctgtagcctaaactccaaacatcctcttccatatggatccactggctggacaaactgcaccagttgctgcttcaatttatacctcaattttcactgtgtccaggtggtactttggctcgttggctagattaaccttctctgtccgagtgtgccacacgagaacctgaaggggaaggaaatagcttgggtagcgcactcttcatggtgacactcgaggtcgggcagcacaagtgtaatgaataccttagtgcagttatttgctttcggttccagttcttcgactgttgttatctgtttgagaaagtcagattcttgcatccctggctgggatccacgacgcttaaatacagcttttggattggacaaaatgacttgaagacttacagcaaatcctttgtgaaaaataaaaaaaaaaaagagacttt

SEQ ID NO: 182167 - DNA, 2473 bp, Homo sapiens
  Payload ID: 15875
  Gene Symbol: SMAP2
  Gene Name: small ArfGAP2
  Uniprot ID: Q8WU79
  ENST ID: ENST00000372708
  CDS Start-End: 49-1248
gaggaggaggaggagggaagtgagatggcggaaaggaaaactgcttaaatgatttttaaagggccgcgatgggcctcttggaacattggtgtgttcatctgcattcgatgtgctggaatccacaggaatctgggggtgcacatatccagggtaaagtcagttaacctcgaccagtggactcaagaacagattcagtgcatgcaagagatgggaaatggaaaggcaaaccgactttatgaagcctatcttcctgagacctttcggcgacctcagatagacccagctgttgaaggatttattcgagacaaatatgagaagaagaaatacatggaccgaagtctggacatcaatgcctttaggaaagaaaaagatgacaagtggaaaagagggagcgaaccagttccagaaaaaaaattggaacctgttgtttttgagaaggtgaaaatgccacagaaaaaagaagacccacagctacctcggaaaagctccccgaaatccacagcgcctgtcatggatttgttgggccttgatgctcctgtggcctgctccattgcaaatagtaagaccagcaataccctagagaaggatttagatctgttggcctctgttccatccccttcttcttccggttccagaaaggttgtaggttccatgccaactgcagggagtgccggctctgttcctgaaaatctgaacctgtttccggagccagggagcaaatcagaagaaataggcaagaaacagctctctaaagactccattctttcactgtatggatcccagacgcctcaaatgcctactcaagcaatgttcatggctcccgctcagatggcatatcccacagcctaccccagcttccccggggttacacctcctaacagcataatggggagcatgatgcctccaccagtaggcatggttgctcagccaggagcttctgggatggttgcccccatggccatgcctgcaggctatatgggtggcatgcaggcatcaatgatgggtgtgccgaatggaatgatgaccacccagcaggctggctacatggcaggcatggcagctatgccccagactgtgtatggggtccagccagctcagcagctgcaatggaaccttactcagatgacccagcagatggctgggatgaacttctatggagccaatggcatgatgaactatggacagtcaatgagtggcggaaatggacaggcagcaaatcagactctcagtcctcagatgtggaaataaaaacaaaacacctgtatggctgccattctcttcagccctcgctctcccctttccacagcctccacccctgacccccatcctcttttcctacctctctgtttggtttagaaattgctcaataagtcatttggggtttggcatcctgcccagccacttcccaaacatgaagacctctctgttgctttatgttgtacatgccccatagccatcccaacgtcctccccagtcctctcctggcaccagcaccttagaagttgttggcagaaggcacttaaactgtgggagaagtgtgcacacctttgagtcccttccctcaaggttaaagctcctgtcagactctcagaagggtctgtgggtgttgtatattaggcaaacaggggaaagcttagaggtccttctatatgtgttaataagctgtttctaagtgtttaaatttgaaaagcatcatgttctcatgatttatgggaatgaagcaagtactgaaatcaaattaaatactccctgggtcctgggtcagtttgaccctagccctggggtgaggcaagccccctcctatgaggatgagcaaaaatactactctcttcgccctgagttgctttctggatctggggcttcaggacttgctgcttcagtcagcctttattagcaccaaagactttatgaagatcccacacacagacacacatcccttcccgcctcccccctgccttcagtaggatctggctccgtggctggaggaccaacccctatagtgggaatgcagagcttaacgtgtactgcttgtgtgtgtgcgtgagtgtgtgtgtgtgtatgagtgtgtgttccgcctcccaccctctccccatctgctctgggtatttttgtttttgtttagttttaggtttacaacagagaggaattaatttatcagcagcctaaaactgttgtgtttttcttatggtttaaaaaacgccatgtcattgataactccctttctcccttcccttctcccggtctgctgatcactctttcatgcctgtgtatccagggtgctctgtttccccaccgttcccaggtgtacgaggcagagggccgggacagctttcctctcagtcattgttcaccccacttgaaaattcagacaagaaaactttgcttaaaagatttcatgtgtgggaaccacagttcctggctgcctttctcctgtgtatgtgtaaattccttaataaatattgcagggaaggac

SEQ ID NO: 182168 - DNA, 2939 bp, Homo sapiens
  Payload ID: 15875
  Gene Symbol: SMAP2
  Gene Name: small ArfGAP2
  Uniprot ID: Q8WU79
  ENST ID: ENST00000372718
  CDS Start-End: 425-1714
ggggaggaagagctgccggaagtaggcggtggaggtggtagcggagctgacggcagctgccagggaaaccgaggcgcgggacgcaaggccagcagacaggccggccagagggtcatctgcgtccggcacccaggaggctcgtggtccgcctttgcctgggctgagggtctctggccccgcagcctctcttggaggcgggcctgtccctaagcccgccaaggggcgccgcgccgaggggctgcggagtgggggacggacgcccccgacccgggaaggggcgtccggcggggccggaggagagggctctccccgctcaggaggtgcccctgggcgggggaccgggagtcctcaaccccggactgaggcaggggtctctgggggcgaggagggcgcgtcgccctctgcccccgccggcaccctggccatgacaggcaagtcggtgaaggacgtggatcggtaccaggctgtcctggccaacctgctgctggaggaggataacaagttttgtgcagattgccagtctaaagggccgcgatgggcctcttggaacattggtgtgttcatctgcattcgatgtgctggaatccacaggaatctgggggtgcacatatccagggtaaagtcagttaacctcgaccagtggactcaagaacagattcagtgcatgcaagagatgggaaatggaaaggcaaaccgactttatgaagcctatcttcctgagacctttcggcgacctcagatagacccagctgttgaaggatttattcgagacaaatatgagaagaagaaatacatggaccgaagtctggacatcaatgcctttaggaaagaaaaagatgacaagtggaaaagagggagcgaaccagttccagaaaaaaaattggaacctgttgtttttgagaaggtgaaaatgccacagaaaaaagaagacccacagctacctcggaaaagctccccgaaatccacagcgcctgtcatggatttgttgggccttgatgctcctgtggcctgctccattgcaaatagtaagaccagcaataccctagagaaggatttagatctgttggcctctgttccatccccttcttcttccggttccagaaaggttgtaggttccatgccaactgcagggagtgccggctctgttcctgaaaatctgaacctgtttccggagccagggagcaaatcagaagaaataggcaagaaacagctctctaaagactccattctttcactgtatggatcccagacgcctcaaatgcctactcaagcaatgttcatggctcccgctcagatggcatatcccacagcctaccccagcttccccggggttacacctcctaacagcataatggggagcatgatgcctccaccagtaggcatggttgctcagccaggagcttctgggatggttgcccccatggccatgcctgcaggctatatgggtggcatgcaggcatcaatgatgggtgtgccgaatggaatgatgaccacccagcaggctggctacatggcaggcatggcagctatgccccagactgtgtatggggtccagccagctcagcagctgcaatggaaccttactcagatgacccagcagatggctgggatgaacttctatggagccaatggcatgatgaactatggacagtcaatgagtggcggaaatggacaggcagcaaatcagactctcagtcctcagatgtggaaataaaaacaaaacacctgtatggctgccattctcttcagccctcgctctcccctttccacagcctccacccctgacccccatcctcttttcctacctctctgtttggtttagaaattgctcaataagtcatttggggtttggcatcctgcccagccacttcccaaacatgaagacctctctgttgctttatgttgtacatgccccatagccatcccaacgtcctccccagtcctctcctggcaccagcaccttagaagttgttggcagaaggcacttaaactgtgggagaagtgtgcacacctttgagtcccttccctcaaggttaaagctcctgtcagactctcagaagggtctgtgggtgttgtatattaggcaaacaggggaaagcttagaggtccttctatatgtgttaataagctgtttctaagtgtttaaatttgaaaagcatcatgttctcatgatttatgggaatgaagcaagtactgaaatcaaattaaatactccctgggtcctgggtcagtttgaccctagccctggggtgaggcaagccccctcctatgaggatgagcaaaaatactactctcttcgccctgagttgctttctggatctggggcttcaggacttgctgcttcagtcagcctttattagcaccaaagactttatgaagatcccacacacagacacacatcccttcccgcctcccccctgccttcagtaggatctggctccgtggctggaggaccaacccctatagtgggaatgcagagcttaacgtgtactgcttgtgtgtgtgcgtgagtgtgtgtgtgtgtatgagtgtgtgttccgcctcccaccctctccccatctgctctgggtatttttgtttttgtttagttttaggtttacaacagagaggaattaatttatcagcagcctaaaactgttgtgtttttcttatggtttaaaaaacgccatgtcattgataactccctttctcccttcccttctcccggtctgctgatcactctttcatgcctgtgtatccagggtgctctgtttccccaccgttcccaggtgtacgaggcagagggccgggacagctttcctctcagtcattgttcaccccacttgaaaattcagacaagaaaactttgcttaaaagatttcatgtgtgggaaccacagttcctggctgcctttctcctgtgtatgtgtaaattccttaataaatattgcagggaaggac

SEQ ID NO: 182169 - DNA, 666 bp, Homo sapiens
  Payload ID: 15875
  Gene Symbol: SMAP2
  Gene Name: small ArfGAP2
  ENST ID: ENST00000435168
  CDS Start-End: 144-666
gattccagttcattcctagctcagaaagcaacgttttgagccacaactgtcacaactccagctggtgtgcagagaagccaggttgatgccatctatcaaagttgtctcttagacctcagagccagttgaagggctgagagaggatgtggaagccaatggaacacagccagcgcaggaggcaagattttgaaatctatgggccgcgatgggcctcttggaacattggtgtgttcatctgcattcgatgtgctggaatccacaggaatctgggggtgcacatatccagggtaaagtcagttaacctcgaccagtggactcaagaacagattcagtgcatgcaagagatgggaaatggaaaggcaaaccgactttatgaagcctatcttcctgagacctttcggcgacctcagatagacccagctgttgaaggatttattcgagacaaatatgagaagaagaaatacatggaccgaagtctggacatcaatgcctttaggaaagaaaaagatgacaagtggaaaagagggagcgaaccagttccagaaaaaaaattggaacctgttgtttttgagaaggtgaaaatgccacagaaaaaagaagacccacagctacctcggaaaagctccccgaaatccacagcgcctgtcatggatttgttgggccttg

SEQ ID NO: 182170 - DNA, 2501 bp, Homo sapiens
  Payload ID: 15875
  Gene Symbol: SMAP2
  Gene Name: small ArfGAP2
  Uniprot ID: Q8WU79
  ENST ID: ENST00000539317
  CDS Start-End: 229-1278
acacaatttttccaagatcccactggtgtttctgtgtattcttccttttcagtgaatcagagaatggagggatataatgagtggaactgagggccgcgatgggcctcttggaacattggtgtgttcatctgcattcgatgtgctggaatccacaggaatctgggggtgcacatatccagggtaaagtcagttaacctcgaccagtggactcaagaacagattcagtgcatgcaagagatgggaaatggaaaggcaaaccgactttatgaagcctatcttcctgagacctttcggcgacctcagatagacccagctgttgaaggatttattcgagacaaatatgagaagaagaaatacatggaccgaagtctggacatcaatgcctttaggaaagaaaaagatgacaagtggaaaagagggagcgaaccagttccagaaaaaaaattggaacctgttgtttttgagaaggtgaaaatgccacagaaaaaagaagacccacagctacctcggaaaagctccccgaaatccacagcgcctgtcatggatttgttgggccttgatgctcctgtggcctgctccattgcaaatagtaagaccagcaataccctagagaaggatttagatctgttggcctctgttccatccccttcttcttccggttccagaaaggttgtaggttccatgccaactgcagggagtgccggctctgttcctgaaaatctgaacctgtttccggagccagggagcaaatcagaagaaataggcaagaaacagctctctaaagactccattctttcactgtatggatcccagacgcctcaaatgcctactcaagcaatgttcatggctcccgctcagatggcatatcccacagcctaccccagcttccccggggttacacctcctaacagcataatggggagcatgatgcctccaccagtaggcatggttgctcagccaggagcttctgggatggttgcccccatggccatgcctgcaggctatatgggtggcatgcaggcatcaatgatgggtgtgccgaatggaatgatgaccacccagcaggctggctacatggcaggcatggcagctatgccccagactgtgtatggggtccagccagctcagcagctgcaatggaaccttactcagatgacccagcagatggctgggatgaacttctatggagccaatggcatgatgaactatggacagtcaatgagtggcggaaatggacaggcagcaaatcagactctcagtcctcagatgtggaaataaaaacaaaacacctgtatggctgccattctcttcagccctcgctctcccctttccacagcctccacccctgacccccatcctcttttcctacctctctgtttggtttagaaattgctcaataagtcatttggggtttggcatcctgcccagccacttcccaaacatgaagacctctctgttgctttatgttgtacatgccccatagccatcccaacgtcctccccagtcctctcctggcaccagcaccttagaagttgttggcagaaggcacttaaactgtgggagaagtgtgcacacctttgagtcccttccctcaaggttaaagctcctgtcagactctcagaagggtctgtgggtgttgtatattaggcaaacaggggaaagcttagaggtccttctatatgtgttaataagctgtttctaagtgtttaaatttgaaaagcatcatgttctcatgatttatgggaatgaagcaagtactgaaatcaaattaaatactccctgggtcctgggtcagtttgaccctagccctggggtgaggcaagccccctcctatgaggatgagcaaaaatactactctcttcgccctgagttgctttctggatctggggcttcaggacttgctgcttcagtcagcctttattagcaccaaagactttatgaagatcccacacacagacacacatcccttcccgcctcccccctgccttcagtaggatctggctccgtggctggaggaccaacccctatagtgggaatgcagagcttaacgtgtactgcttgtgtgtgtgcgtgagtgtgtgtgtgtgtatgagtgtgtgttccgcctcccaccctctccccatctgctctgggtatttttgtttttgtttagttttaggtttacaacagagaggaattaatttatcagcagcctaaaactgttgtgtttttcttatggtttaaaaaacgccatgtcattgataactccctttctcccttcccttctcccggtctgctgatcactctttcatgcctgtgtatccagggtgctctgtttccccaccgttcccaggtgtacgaggcagagggccgggacagctttcctctcagtcattgttcaccccacttgaaaattcagacaagaaaactttgcttaaaagatttcatgtgtgggaaccacagttcctggctgcctttctcctgtgtatgtgtaaattccttaataaatattgcagggaagg

SEQ ID NO: 182171 - DNA, 2570 bp, Homo sapiens
  Payload ID: 15875
  Gene Symbol: SMAP2
  Gene Name: small ArfGAP2
  ENST ID: ENST00000614549
  CDS Start-End: 73-1347
acaaatgagtgagtgcagcaggagaggcagcagagcgccgtgggagttggaataggaaggagaaaaggcttcatggggaaagtgggcagagcaagatttgcacaaaaagatgttttgcaaatagaggaaataggccctgtaaagctatttgtgagagactggccgcgatgggcctcttggaacattggtgtgttcatctgcattcgatgtgctggaatccacaggaatctgggggtgcacatatccagggtaaagtcagttaacctcgaccagtggactcaagaacagattcagtgcatgcaagagatgggaaatggaaaggcaaaccgactttatgaagcctatcttcctgagacctttcggcgacctcagatagacccagctgttgaaggatttattcgagacaaatatgagaagaagaaatacatggaccgaagtctggacatcaatgcctttaggaaagaaaaagatgacaagtggaaaagagggagcgaaccagttccagaaaaaaaattggaacctgttgtttttgagaaggtgaaaatgccacagaaaaaagaagacccacagctacctcggaaaagctccccgaaatccacagcgcctgtcatggatttgttgggccttgatgctcctgtggcctgctccattgcaaatagtaagaccagcaataccctagagaaggatttagatctgttggcctctgttccatccccttcttcttccggttccagaaaggttgtaggttccatgccaactgcagggagtgccggctctgttcctgaaaatctgaacctgtttccggagccagggagcaaatcagaagaaataggcaagaaacagctctctaaagactccattctttcactgtatggatcccagacgcctcaaatgcctactcaagcaatgttcatggctcccgctcagatggcatatcccacagcctaccccagcttccccggggttacacctcctaacagcataatggggagcatgatgcctccaccagtaggcatggttgctcagccaggagcttctgggatggttgcccccatggccatgcctgcaggctatatgggtggcatgcaggcatcaatgatgggtgtgccgaatggaatgatgaccacccagcaggctggctacatggcaggcatggcagctatgccccagactgtgtatggggtccagccagctcagcagctgcaatggaaccttactcagatgacccagcagatggctgggatgaacttctatggagccaatggcatgatgaactatggacagtcaatgagtggcggaaatggacaggcagcaaatcagactctcagtcctcagatgtggaaataaaaacaaaacacctgtatggctgccattctcttcagccctcgctctcccctttccacagcctccacccctgacccccatcctcttttcctacctctctgtttggtttagaaattgctcaataagtcatttggggtttggcatcctgcccagccacttcccaaacatgaagacctctctgttgctttatgttgtacatgccccatagccatcccaacgtcctccccagtcctctcctggcaccagcaccttagaagttgttggcagaaggcacttaaactgtgggagaagtgtgcacacctttgagtcccttccctcaaggttaaagctcctgtcagactctcagaagggtctgtgggtgttgtatattaggcaaacaggggaaagcttagaggtccttctatatgtgttaataagctgtttctaagtgtttaaatttgaaaagcatcatgttctcatgatttatgggaatgaagcaagtactgaaatcaaattaaatactccctgggtcctgggtcagtttgaccctagccctggggtgaggcaagccccctcctatgaggatgagcaaaaatactactctcttcgccctgagttgctttctggatctggggcttcaggacttgctgcttcagtcagcctttattagcaccaaagactttatgaagatcccacacacagacacacatcccttcccgcctcccccctgccttcagtaggatctggctccgtggctggaggaccaacccctatagtgggaatgcagagcttaacgtgtactgcttgtgtgtgtgcgtgagtgtgtgtgtgtgtatgagtgtgtgttccgcctcccaccctctccccatctgctctgggtatttttgtttttgtttagttttaggtttacaacagagaggaattaatttatcagcagcctaaaactgttgtgtttttcttatggtttaaaaaacgccatgtcattgataactccctttctcccttcccttctcccggtctgctgatcactctttcatgcctgtgtatccagggtgctctgtttccccaccgttcccaggtgtacgaggcagagggccgggacagctttcctctcagtcattgttcaccccacttgaaaattcagacaagaaaactttgcttaaaagatttcatgtgtgggaaccacagttcctggctgcctttctcctgtgtatgtgtaaattccttaataaatattgcagggaagg

SEQ ID NO: 182172 - DNA, 1045 bp, Homo sapiens
  Payload ID: 15876
  Gene Symbol: SMAGP
  Gene Name: small cell adhesion glycoprotein
  ENST ID: ENST00000380103
  CDS Start-End: 43-156
acagatctgcctcttctccaagaaactcaaccactagtgacaatgaccagcctcctgactactccttctccaagagggtctcactctgtcacccagactagagtacagtggcacaatcacagctcactgcagcctggacctcctgggctccagtgatcctctcacctcaagtttaccgagtagctgggactacagaagaactgatgaccaccccaattttacagcccactgaggccctgtccccagaagatggagccagcacagcactcattgcagttgttatcaccgttgtcttcctcaccctgctctcggtcgtgatcttgatcttcttttacctgtacaagaacaaaggcagctacgtcacctatgaacctacagaaggtgagcccagtgccatcgtccagatggagagtgacttggccaagggcagcgagaaagaggaatatttcatctaatgactcccaggccccaaggagcttattcctggctccatcgctaacacgttgactgcttattatgggaaagttttctctgaagccagggagaagcattgattgatgtgggcaaatccaagctccagccaggtcgcagtcccaaatgccgacatcactgactccagggaccagggacatggagaaagctgtttatgatatctttaaccaggccctcttactagagctggtgtttgtgactggccaacaagatgtggctatgccaggggacatctgagtatgtgcccagtcatcttttttcacaggttgaagggagagaaaagattttgagttaaggtcattggctgctctactctgtcccctacctggtcacctagtgatagccccagtggagatactgtccatacaaggtcttcccagaggctggataccacagtaaaaggccaggccaggaggggtaggagactatggagatcttacctcctgataaatgtgctacaccccctaatctgagcccttcctttccgtgttccccaacaacctcatgcttacgtgatttttattcaaattaaaaattttcattgctacagaaa

SEQ ID NO: 182173 - DNA, 1062 bp, Homo sapiens
  Payload ID: 15876
  Gene Symbol: SMAGP
  Gene Name: small cell adhesion glycoprotein
  Uniprot ID: Q0VAQ4
  ENST ID: ENST00000398453
  CDS Start-End: 179-472
gccacctcggccgtggcaggaaccgaaacccggagcggccgaagctcagcgctccgctggggcagagggtcgcggcggctgggaacgccgctccccgacgcaccggccgcccccagcgcagcgcgctccgcggggtgctgatctgcctcttctccaagaaactcaaccactagtgacaatgaccagcctcctgactactccttctccaagagaagaactgatgaccaccccaattttacagcccactgaggccctgtccccagaagatggagccagcacagcactcattgcagttgttatcaccgttgtcttcctcaccctgctctcggtcgtgatcttgatcttcttttacctgtacaagaacaaaggcagctacgtcacctatgaacctacagaaggtgagcccagtgccatcgtccagatggagagtgacttggccaagggcagcgagaaagaggaatatttcatctaatgactcccaggccccaaggagcttattcctggctccatcgctaacacgttgactgcttattatgggaaagttttctctgaagccagggagaagcattgattgatgtgggcaaatccaagctccagccaggtcgcagtcccaaatgccgacatcactgactccagggaccagggacatggagaaagctgtttatgatatctttaaccaggccctcttactagagctggtgtttgtgactggccaacaagatgtggctatgccaggggacatctgagtatgtgcccagtcatcttttttcacaggttgaagggagagaaaagattttgagttaaggtcattggctgctctactctgtcccctacctggtcacctagtgatagccccagtggagatactgtccatacaaggtcttcccagaggctggataccacagtaaaaggccaggccaggaggggtaggagactatggagatcttacctcctgataaatgtgctacaccccctaatctgagcccttcctttccgtgttccccaacaacctcatgcttacgtgatttttattcaaattaaaaattttcattgctacagaaa

SEQ ID NO: 182174 - DNA, 610 bp, Homo sapiens
  Payload ID: 15876
  Gene Symbol: SMAGP
  Gene Name: small cell adhesion glycoprotein
  ENST ID: ENST00000605426
  CDS Start-End: 461-610
gaggatctccggggcgcggggcgcgggctggggcccagtgaggcttggcaggctgtgcgcggaccgcgccctggacggcgaaagcaggcccggagggggcggccagtccggcgtcccagcgtccgaggcgagccagaaggcggcccacggccgtcgcctcccggtcccggcccggctactgcgctgcgcccactccgctctggagcctgggcgcgggtcctgaccttcccggccctctcctgacacctggtggatggcgtcaccagaactcctagctgtggaaccctagggtacctgttaccgcgctttggcgaaactgggttcgctgctgatttgcgaacctttgcctgactttctcaggccttgagagatctaagtaaatttggtggcccattgaaaggacctggagagagcgtatgaagatctgcctcttctccaagaaactcaaccactagtgacaatgaccagcctcctgactactccttctccaagagaagaactgatgaccaccccaattttacagcccactgaggccctgtccccagaagatggagccagcacagcactcattgcagttgttatcaccgttgtcttcctcaccctgctctcg

SEQ ID NO: 182175 - DNA, 816 bp, Homo sapiens
  Payload ID: 15876
  Gene Symbol: SMAGP
  Gene Name: small cell adhesion glycoprotein
  ENST ID: ENST00000603838
  CDS Start-End: 415-543
ggcaggctgtgcgcggaccgcgccctggacggcgaaagcaggcccggagggggcggccagtccggcgtcccagcgtccgaggcgagccagaaggcggcccacggccgtcgcctcccggtcccggcccggctactgcgctgcgcccactccgctctggagcctgggcgcgggtcctgaccttcccggccctctcctgacacctggtggatggcgtcaccagaactcctagctgtggaaccctagggtacctgttaccgcgctttggcgaaactgggttcgctgctgatttgcgaacctttgcctgactttctcaggccttgagagatctaagtaaatttggtggcccattgaaaggacctggagagagcgtatgaagatctgcctcttctccaagaaactcaaccactagtgacaatgaccagcctcctgactactccttctccaagagaagaactgatgaccaccccaattttacagcccactgaggccctgtccccagaagatggagccagcacagcactcattgcaggtaatagactctgagccaactccaagggaccttctggatcaagggcatctctctccagagggagcctgaccaaatccattaatgggctcactctggcttgtaagttatattacacacacacacacacacacacacacacacacacagccataaaagactcggaggcttctgtcagaggcactaccagtaaatgacaggttgggaggtggccgcaaatagatatgcatacggacgttacacttgagtacgtgggtagggacgaggatatatgtggttggttgagtggg

SEQ ID NO: 182176 - DNA, 1518 bp, Homo sapiens
  Payload ID: 15876
  Gene Symbol: SMAGP
  Gene Name: small cell adhesion glycoprotein
  Uniprot ID: Q0VAQ4
  ENST ID: ENST00000603864
  CDS Start-End: 672-965
cggggcgcggggcgcgggctggggcccagtgaggcttggcaggctgtgcgcggaccgcgccctggacggcgaaagcaggcccggagggggcggccagtccggcgtcccagcgtccgaggcgagccagaaggcggcccacggccgtcgcctcccggtcccggcccggctactgcgctgcgcccactccgctctggagcctgggcgcgggtcctgaccttcccggccctctcctgacacctggtggatggcgtcaccagaactcctagctgtggaaccctagggtacctgttaccgcgctttggcgaaactgggttcgctgctgatttgcgaacctttgcctgactttctcaggccttgagagatctaagtaaatttggtggcccattgaaaggacctggagagagcgtatgaaggtaacaccccgtcaaactgcatgcggcctcagacctgctcctgtggagagctgttggtacctggagcctgaggagatattcagggaaaccagaagaggacaagagaaaaaggggaagggacttgggagaacctggcaccagaggctttcctgggacttccaggactcaaagccataggggcccacccgctacattcctgtctttgcccctcttcctacagatctgcctcttctccaagaaactcaaccactagtgacaatgaccagcctcctgactactccttctccaagagaagaactgatgaccaccccaattttacagcccactgaggccctgtccccagaagatggagccagcacagcactcattgcagttgttatcaccgttgtcttcctcaccctgctctcggtcgtgatcttgatcttcttttacctgtacaagaacaaaggcagctacgtcacctatgaacctacagaaggtgagcccagtgccatcgtccagatggagagtgacttggccaagggcagcgagaaagaggaatatttcatctaatgactcccaggccccaaggagcttattcctggctccatcgctaacacgttgactgcttattatgggaaagttttctctgaagccagggagaagcattgattgatgtgggcaaatccaagctccagccaggtcgcagtcccaaatgccgacatcactgactccagggaccagggacatggagaaagctgtttatgatatctttaaccaggccctcttactagagctggtgtttgtgactggccaacaagatgtggctatgccaggggacatctgagtatgtgcccagtcatcttttttcacaggttgaagggagagaaaagattttgagttaaggtcattggctgctctactctgtcccctacctggtcacctagtgatagccccagtggagatactgtccatacaaggtcttcccagaggctggataccacagtaaaaggccaggccaggaggggtaggagactatggagatcttacctcctgataaatgtgctacaccccctaatctgagcccttcctttccgtgttccccaacaacctcatgcttacgtga

SEQ ID NO: 182177 - DNA, 433 bp, Homo sapiens
  Payload ID: 15876
  Gene Symbol: SMAGP
  Gene Name: small cell adhesion glycoprotein
  ENST ID: ENST00000604188
  CDS Start-End: 165-293
ggcaggaaccgaaacccggagcggccgaagctcagcgctccgctggggcagagggtcgcggcggctgggaacgccgctccccgacgcaccggccgcccccagcgcagcgcgctccgcggggtgctgatctgcctcttctccaagaaactcaaccactagtgacaatgaccagcctcctgactactccttctccaagagaagaactgatgaccaccccaattttacagcccactgaggccctgtccccagaagatggagccagcacagcactcattgcaggtaatagactctgagccaactccaagggaccttctggatcaagggcatctctctccagagggagcctgaccaaatccattaatgggctcactctggcttgtaagttatattacacacacacacacacacacacacacacacacacagccataaa

SEQ ID NO: 182178 - DNA, 2350 bp, Homo sapiens
  Payload ID: 15876
  Gene Symbol: SMAGP
  Gene Name: small cell adhesion glycoprotein
  Uniprot ID: Q0VAQ4
  ENST ID: ENST00000603798
  CDS Start-End: 674-967
gtttgaatccaaagtccacggcactcctaaccgctgctcaacgctgccccacaagaacgtccagctggcaagacccgggtggggctcgttgctctccccgcttcacctccctgcttcacggccgggggtgtgctggctaagttcgctcatctgccaagcttcaggacacagacctatgtgagcaagcgataaacaaatgcaaataaatgtaactttccacattagctaaaaattcagagaacgtcaagcccagggaaatgggacggatcccagttagcccgcggctccaatctggtccccccccaaccccgagcctcgcggcgagaaaggaagcggctccggatggagagtaaagtgacaatcggagaagggcaggctgcctttcctcccgggggagccaaggggacctgcagagggcggtttctctccgcttttcctgtcccaccccgtcggcctgccccccaccccctccggcctctgcgccaaccccgcgcgccacccgcggcttcctccgctcggggtcctcgttcggcctctgctggcctccgcgactccgcggtgcccgcccccgttgagttcaaaaggacgcgcggagcggcgccggcccttcaccagcagcccgtccgactggaaagatctgcctcttctccaagaaactcaaccactagtgacaatgaccagcctcctgactactccttctccaagagaagaactgatgaccaccccaattttacagcccactgaggccctgtccccagaagatggagccagcacagcactcattgcagttgttatcaccgttgtcttcctcaccctgctctcggtcgtgatcttgatcttcttttacctgtacaagaacaaaggcagctacgtcacctatgaacctacagaaggtgagcccagtgccatcgtccagatggagagtgacttggccaagggcagcgagaaagaggaatatttcatctaatgactcccaggccccaaggagcttattcctggctccatcgctaacacgttgactgcttattatgggaaagttttctctgaagccagggagaagcattgattgatgtgggcaaatccaagctccagccaggtcgcagtcccaaatgccgacatcactgactccagggaccagggacatggagaaagctgtttatgatatctttaaccaggccctcttactagagctggtgtttgtgactggccaacaagatgtggctatgccaggggacatctgagtatgtgcccagtcatcttttttcacaggttgaagggagagaaaagattttgagttaaggtcattggctgctctactctgtcccctacctggtcacctagtgatagccccagtggagatactgtccatacaaggtcttcccagaggctggataccacagtaaaaggccaggccaggaggggtaggagactatggagatcttacctcctgataaatgtgctacaccccctaatctgagcccttcctttccgtgttccccaacaacctcatgcttacgtgatttttattcaaattaaaaattttcattgctacagaaatcagattctcatgtgcaagaagtaactacattttgacttatttttgcttaaacatttttgacattttcttttccctatttaacgcctttacatatgttctcttccaagcaataagaaccctaggaaagttctagaagtttgcagaactatctcagggatttgagacaaagatggtgcaggaaagcttgttccaggggaacatcattagaaacataccctgggagggccgggttcggtggctcacgcctgtgatcccagcactttgggaggccgaggcaggcggatcacaaggttaggagatcgagaccatcctggctaacacggtgaaaccccgtctctactaaaaatatataaaaaaaatagctgggcgtggtggcgggcgcccatagtcccagctgcttgggaggctgaggcaggagaatggcttgaacccaggaggcggagcttgcagtgagctgagattgcaccactatactccagcctgggcaacagagtgagactccgtctcaaaaaaaaaaaaaaaaaaaaaagtaccctgggagatgagttggttcaagcctccatcctggcaagggccagaatttcccagaatcccttctacatatatacagaaggaaccagaaaaaatcaacctaccacctttcccagtgtatcctcagaatcaagccaagaagcttcttggattttagtctcaagataagttgtgtttaaaaggcacattttggtataaattattagctcatcagatattgttcactttggaattaaagctagatctcctttgaagtcttaa

SEQ ID NO: 182179 - DNA, 577 bp, Homo sapiens
  Payload ID: 15876
  Gene Symbol: SMAGP
  Gene Name: small cell adhesion glycoprotein
  ENST ID: ENST00000605627
  CDS Start-End: 130-381
cttcaccagcagcccgtccgactggaaagatctgcctcttctccaagaaactcaaccactagtgacaatgaccagcctcctgactactccttctccaagagaatttccttcctctttaaggaagaactgatgaccaccccaattttacagcccactgaggccctgtccccagaagatggagccagcacagcactcattgcagttgttatcaccgttgtcttcctcaccctgctctcggtcgtgatcttgatcttcttttacctgtacaagaacaaaggcagctacgtcacctatgaacctacagaaggtgagcccagtgccatcgtccagatggagagtgacttggccaagggcagcgagaaagaggaatatttcatctaatgactcccaggccccaaggagcttattcctggctccatcgctaacacgttgactgcttattatgggaaagttttctctgaagccagggagaagcattgattgatgtgggcaaatccaagctccagccaggtcgcagtcccaaatgccgacatcactgactccagggaccagggacatggagaaagctgtttatgat

SEQ ID NO: 182180 - DNA, 963 bp, Homo sapiens
  Payload ID: 15877
  Gene Symbol: SERF1A
  Gene Name: small EDRK-rich factor 1A (telomeric)
  Uniprot ID: O75920
  ENST ID: ENST00000317633
  CDS Start-End: 206-394
gcgcagtgacgcgccggccatgccggcggctgttgtcgggcctccagcgggcggggccgttggcggagcagaggggaggcgcagccgggcggagggcccacgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagggactctgagatcatgcaagaaaagcagaaggcagctaatgagaagaagtctatgcagacaagagaaaagtgatgactggctatttggaaaacctgggtgctactgccaactgggtgtatcataagctctaagatcaagattttgtagagtggacagtcattacatatgttataacttatcctttaaaaactattttaaactttatcctttcagctttacttagtgcgatgttttagaagcagtcttcaaagaataaaacactaaccatgcatgtgacatattggtgaacattatttttattattgaacattcatatataatttattaggtaatatgatcagataataggatctcttatataataaagaatctttgtcatcagctttgttaacatagtttttttttcctcacagtttctaaggataaggataaaatagatctttgaagtaaacttaaatatataatagaagttagggtccatttgtataattttgctttgaaatcaagttaaagggccaggtgcggtggcttatgcccacaatcccagcactttgggaggccgaggcgggcggatcacttgaggtcaggagtttgagaccagcctgaccaacatgatgaaacctcatctttactaaaaatac

SEQ ID NO: 182181 - DNA, 1889 bp, Homo sapiens
  Payload ID: 15877
  Gene Symbol: SERF1A
  Gene Name: small EDRK-rich factor 1A (telomeric)
  Uniprot ID: O75920
  ENST ID: ENST00000354833
  CDS Start-End: 184-516
ccggcggctgttgtcgggcctccagcgggcggggccgttggcggagcagaggggaggcgcagccgggcggagggcccacgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatgaggacttttgctgttggatttaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggtgccatctcagctccatgcaacctctgcctcctgggttcaagcagttctcttgcctcagcctcctgggtagctgggattacaggcacgcgctgccacacccaggtaatttatttattttttttttgagacagagtctcgcactgttgcccaggctggactgcagtggcgtgatctctgctcactgcaacctccgcctcccgggttcaagcgattctccagcctcagcttcctgagtagatgggattacaggcgcctgccaccacgcccagctaattttttgtattcttagtagagatggggtttcaccatgttggccaggctggtctccatctcctgacctcgtgattcacccgcctcggcctcccaaagtgctgggattacaggcgtgagtcacagcccccggccataatttagcactttaaaaaataatagccatgttgggccaggcgtggtggctcatgcctgtaatctgagcactttgggagaccaaggcgggtagatcccttgtgcccaggagttcaagaccagcctgggcaacatggcgaaaccccatttctactaaaaatacaaaaattagctggggcgaggggataggccgagttccgggtgtaagggggccattagggagagcagagcgaggcagctgatcttccggattgggggccttgcccggaagctggacctcacggagatgaaacggaagatgcacgaggatatgatctccatacagaactttctcatctacgtggccctgctgcgagtcactccatttatcttaaagaaattggacagcatatgaagattggacatcacatgtgaatgcatgatatgaagagcctggttacagtttctactgttctctgcaagtaaataggcccagaaaggtataagagactctttgaatggacataaaaattctgcttgttaagaacaagttgagctctggtaactgatcttaatagctaaaatataaaaatatttgggaagtctgaaatgaggtctcctggccctggtgtgcccttaatgcctgtgacagttggcctctgtgaatattggtataattgtaaataatgtcaaactccattttctagcaagtattaataattaagggaagtatgtctgaaatggca

SEQ ID NO: 182182 - DNA, 1693 bp, Homo sapiens
  Payload ID: 15877
  Gene Symbol: SERF1A
  Gene Name: small EDRK-rich factor 1A (telomeric)
  ENST ID: ENST00000513436
  CDS Start-End: 107-352
acgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggtgccatctcagctccatgcaacctctgcctcctgggttcaagcagttctcttgcctcagcctcctgggtagctgggattacaggcacgcgctgccacacccaggtaatttatttattttttttttgagacagagtctcgcactgttgcccaggctggactgcagtggcgtgatctctgctcactgcaacctccgcctcccgggttcaagcgattctccagcctcagcttcctgagtagatgggattacaggcgcctgccaccacgcccagctaattttttgtattcttagtagagatggggtttcaccatgttggccaggctggtctccatctcctgacctcgtgattcacccgcctcggcctcccaaagtgctgggattacaggcgtgagtcacagcccccggccataatttagcactttaaaaaataatagccatgttgggccaggcgtggtggctcatgcctgtaatctgagcactttgggagaccaaggcgggtagatcccttgtgcccaggagttcaagaccagcctgggcaacatggcgaaaccccatttctactaaaaatacaaaaattagctggggcgaggggataggccgagttccgggtgtaagggggccattagggagagcagagcgaggcagctgatcttccggattgggggccttgcccggaagctggacctcacggagatgaaacggaagatgcacgaggatatgatctccatacagaactttctcatctacgtggccctgctgcgagtcactccatttatcttaaagaaattggacagcatatgaagattggacatcacatgtgaatgcatgatatgaagagcctggttacagtttctactgttctctgcaagtaaataggcccagaaaggtataagagactctttgaatggacataaaaattctgcttgttaagaacaagttgagctctggtaactgatcttaatagctaaaatataaaaatatttgggaagtctgaaatgaggtctcctggccctggtgtgcccttaatgcctgtgacagttggcctctgtgaatattggtataattgtaaataatgtcaaactccattttctagcaagtattaataattaagggaagtatgtc

SEQ ID NO: 182183 - DNA, 569 bp, Homo sapiens
  Payload ID: 15877
  Gene Symbol: SERF1A
  Gene Name: small EDRK-rich factor 1A (telomeric)
  ENST ID: ENST00000504458
  CDS Start-End: 97-324
agccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagatatggcgtcttactctgtgacccagactggagtgcagtgccacagtctcggttcactgcaagctctgcctcccaggctcaagtgaccctcccacctcagccttctgagtagctgggactacaagggcacaccaccaagcccagatagtttttatattttttgtagaaacggggtttcatcatgttgtccaggcaggtcttgaacttctggggtcaagtgatttgcccacctcagtcccccaaagtgctggaattacaggtgtgagccactatgcccggccctaacatttattattaaagtgataagctttgtcttcaatttctgttgactcacattagagtaaaaatgaacatggt

SEQ ID NO: 182184 - DNA, 663 bp, Homo sapiens
  Payload ID: 15877
  Gene Symbol: SERF1A
  Gene Name: small EDRK-rich factor 1A (telomeric)
  ENST ID: ENST00000507348
  CDS Start-End: 208-354
gtcgcgcagtgcggggatccccgcttcagtcggcagagagagagctcgcgggtggttccggtccggcttttcaggccggacgggtgcctgcccctcaggtgcgagtttgtgcggtaaagaacacaccccggagatgtggacacggccgccccaggagggtccttgtttggaggtggaaatcaacgagaacttgcccgccagaaaaacatgaagaaaacccaggaaattagcaagggaaagaggaaagaggatagcttgactgcctctcagagaaagcagagggactctgagatcatgcaagaaaagcagaaggcagctaatgagaagaagtctatgcagacaagagaaaagtgatgactggctatttggaaaacctgggtgctactgccaactgggtgtatcataagctctaagatcaagattttgtagagtggacagtcattacatatgttataacttatcctttaaaaactattttaaactttatcctttcagctttacttagtgcgatgttttagaagcagtcttcaaagaataaaacactaaccatgcatgtgacatattggtgaacattatttttattattgaacattcatatataatttattaggtaatatgatcagataataggatctcttatataataaagaatctttgtcatca

SEQ ID NO: 182185 - DNA, 328 bp, Homo sapiens
  Payload ID: 15877
  Gene Symbol: SERF1A
  Gene Name: small EDRK-rich factor 1A (telomeric)
  ENST ID: ENST00000511162
  CDS Start-End: 267-328
agtgacgcgccggccatgccggcggctgttgtcgggcctccagcgggcggggccgttggcggagcagaggggaggcgcagccgggcggagggcccacgagggctcagccttcccggtcagcggtggtgacggtatcccagagtgccagagaaccgttgcttttccgagttgctcttcttccaggctccgttggtggtcggcatggcccagcatgactgtttgactttgtaggtggaaatcaacgagaacttgcccgccagaaaaacatgaagaaaacccaggaaattagcaagggaaagaggaaagaggatagcttgactgcctctca

SEQ ID NO: 182186 - DNA, 532 bp, Homo sapiens
  Payload ID: 15877
  Gene Symbol: SERF1A
  Gene Name: small EDRK-rich factor 1A (telomeric)
  ENST ID: ENST00000512868
  CDS Start-End: 265-532
gcgcagtgcggggatccccgcttcagtcggcagagagagagctcgcgggtggttccggtccggcttttcaggccggacgggtgcctgcccctcaggtgcgagtttgtgcggtaaagaacacaccccggagatgtggacacggccgccccaggagggtccttgtttggagacttaccttcaatctgttcagtctccatccacccctctccgcctctgcatggggataaaggtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatg

SEQ ID NO: 182187 - DNA, 846 bp, Homo sapiens
  Payload ID: 15877
  Gene Symbol: SERF1A
  Gene Name: small EDRK-rich factor 1A (telomeric)
  ENST ID: ENST00000512649
  CDS Start-End: 192-482
atccccgcttcagtcggcagagagagagctcgcgggtggttccggtccggcttttcaggccggacgggtgcctgcccctcaggtgcgagtttgtgcggtaaagaacacaccccggagatgtggacacggccgccccaggagggtccttgtttggaggtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatgaggacttttgctgttggatttaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggtgccatctcagctccatgcaacctctgcctcctgggttcaagcagttctcttgcctcagcctcctgggtagctgggattacaggcacgcgctgccacacccaggtaatttatttattttttt

SEQ ID NO: 182188 - DNA, 1889 bp, Homo sapiens
  Payload ID: 15877
  Gene Symbol: SERF1A
  Gene Name: small EDRK-rich factor 1A (telomeric)
  Uniprot ID: O75920
  ENST ID: ENST00000614527
  CDS Start-End: 184-516
ccggcggctgttgtcgggcctccagcgggcggggccgttggcggagcagagcggaggcgcagccgggcggagggcccacgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatgaggacttttgctgttggatttaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggcgccatctcagctccatgcaacctctgcctcctgggttcaagcagttctcttgcctcagcctcctgggtagctgggattacaggcacgcgctgccacacccaggtaatttatttattttttttttgagacagagtctcgcactgttgcccaggctggactgcagtggcgtgatctctgctcactgcaacctccgcctcccgggttcaagcgattctccagcctcagcttcctgagtagatgggattacaggcgcctgccaccacgcccagctaattttttgtattcttagtagagatggggtttcaccatgttggccaggctggtctccatctcctgacctcgtgattcacccgcctcggcctcccaaagtgctgggattacaggcgtgagtcacagcccccggccataatttagcactttaaaaaataatagccatgttgggccaggcgtggtggctcatgcctgtaatctgagcactttgggagaccaaggcgggtagatcccttgtgcccaggagttcaagaccagcctgggcaacatggcgaaaccccatttctactaaaaatacaaaaattagctggggcgaggggataggccgagttccgggtgtaagggggccattagggagagcagagcgaggcagctgatcttccggattgggggccttgcccggaagctggacctcacggagatgaaacggaagatgcacgaggatatgatctccatacagaactttctcatctacgtggccctgctgcgagtcactccatttatcttaaagaaattggacagcatatgaagattggacatcacatgtgaatgcatgatatgaagagcctggttacagtttctactgttctctgcaagtaaataggcccagaaaggtataagagactctttgaatggacataaaaattctgcttgttaagaacaagttgagctctggtaactgatcttaatagctaaaatataaaaatatttgggaagtctgaaatgaggtctcctggccctggtgtgcccttaatgcctgtgacagttggcctctgtgaatattggtataattgtaaataatgtcaaactccattttctagcaagtattaataattaagggaagtatgtctgaaatggca

SEQ ID NO: 182189 - DNA, 632 bp, Homo sapiens
  Payload ID: 15877
  Gene Symbol: SERF1A
  Gene Name: small EDRK-rich factor 1A (telomeric)
  ENST ID: ENST00000614310
  CDS Start-End: 179-325
agatctaggagcaccatcaatctgttactctgctagtttatctatgaaaacacaaactaaagatgcatttaaataaggcctgtttattggaattattaataattttggagatgggaaaagagcatgactgtttgactttgtaggtggaaatcaacgagaacttgcccgccagaaaaacatgaagaaaacccaggaaattagcaagggaaagaggaaagaggatagcttgactgcctctcagagaaagcagagggactctgagatcatgcaagaaaagcagaaggcagctaatgagaagaagtctatgcagacaagagaaaagtgatgactggctatttggaaaacctgggtgctactgccaactgggtgtatcataagctctaagatcaagattttgtagagtggacagtcattacatatgttataacttatcctttaaaaactattttaaactttatcctttcagctttacttagtgcgatgttttagaagcagtcttcaaagaataaaacactaaccatgcatgtgacatattggtgaacattatttttattattgaacattcatatataatttattaggtaatatgatcagataataggatctcttatataataaagaatctttgtcat

SEQ ID NO: 182190 - DNA, 569 bp, Homo sapiens; identical to SEQ ID NO: 182183
  Payload ID: 15877
  Gene Symbol: SERF1A
  Gene Name: small EDRK-rich factor 1A (telomeric)
  ENST ID: ENST00000628888
  CDS Start-End: 97-324

SEQ ID NO: 182191 - DNA, 663 bp, Homo sapiens; identical to SEQ ID NO: 182184
  Payload ID: 15877
  Gene Symbol: SERF1A
  Gene Name: small EDRK-rich factor 1A (telomeric)
  ENST ID: ENST00000630603
  CDS Start-End: 208-354

SEQ ID NO: 182192 - DNA, 532 bp, Homo sapiens; identical to SEQ ID NO: 182186
  Payload ID: 15877
  Gene Symbol: SERF1A
  Gene Name: small EDRK-rich factor 1A (telomeric)
  ENST ID: ENST00000627451
  CDS Start-End: 265-532

SEQ ID NO: 182193 - DNA, 892 bp, Homo sapiens
  Payload ID: 15877
  Gene Symbol: SERF1A
  Gene Name: small EDRK-rich factor 1A (telomeric)
  ENST ID: ENST00000629958
  CDS Start-End: 238-528
aggcggagtccggctggagaatccccctgggtcgcgcagtgcggggatccccgcttcagtcggcagagagagagctcgcgggtggttccggtccggcttttcaggccggacgggtgcctgcccctcaggtgcgagtttgtgcggtaaagaacacaccccggagatgtggacacggccgccccaggagggtccttgtttggaggtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatgaggacttttgctgttggatttaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggcgccatctcagctccatgcaacctctgcctcctgggttcaagcagttctcttgcctcagcctcctgggtagctgggattacaggcacgcgctgccacacccaggtaatttatttattttttt

SEQ ID NO: 182194 - DNA, 703 bp, Homo sapiens
  Payload ID: 15877
  Gene Symbol: SERF1A
  Gene Name: small EDRK-rich factor 1A (telomeric)
  Uniprot ID: O75920
  ENST ID: ENST00000627372
  CDS Start-End: 206-394
gcgcagtgacgcgccggccatgccggcggctgttgtcgggcctccagcgggcggggccgttggcggagcagagcggaggcgcagccgggcggagggcccacgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagggactctgagatcatgcaagaaaagcagaaggcagctaatgagaagaagtctatgcagacaagagaaaagtgatgactggctatttggaaaacctgggtgctactgccaactgggtgtatcataagctctaagatcaagattttgtagagtggacagtcattacatatgttataacttatcctttaaaaactattttaaactttatcctttcagctttacttagtgcgatgttttagaagcagtcttcaaagaataaaacactaaccatgcatgtgacatattggtgaacattatttttattattgaacattcatatataatttattaggtaatatgatcagataataggatctcttatataataaagaatctttgtcatca

SEQ ID NO: 182195 - DNA, 984 bp, Homo sapiens
  Payload ID: 15877
  Gene Symbol: SERF1A
  Gene Name: small EDRK-rich factor 1A (telomeric)
  ENST ID: ENST00000625868
  CDS Start-End: 107-352
acgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggcgccatctcagctccatgcaacctctgcctcctgggttcaagcagttctcttgcctcagcctcctgggtagctgggattacaggcacgcgctgccacacccaggtaatttatttattttttttttgagacagagtctcgcactgttgcccaggctggactgcagtggcgtgatctctgctcactgcaacctccgcctcccgggttcaagcgattctccagcctcagcttcctgagtagatgggattacaggcgcctgccaccacgcccagctaattttttgtattcttagtagagatggggtttcaccatgttggccaggctggtctccatctcctgacctcgtgattcacccgcctcggcctcccaaagtgctgggattacaggcgtgagtcacagcccccggccataatt

SEQ ID NO: 182196 - DNA, 591 bp, Homo sapiens
  Payload ID: 15877
  Gene Symbol: SERF1A
  Gene Name: small EDRK-rich factor 1A (telomeric)
  Uniprot ID: O75920
  ENST ID: ENST00000630567
  CDS Start-End: 1-333
atggcccgtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatgaggacttttgctgttggatttaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaaccccatttctactaaaaatacaaaaattagctggggcgaggggataggccgagttccgggtgtaagggggccattagggagagcagagcgagg

SEQ ID NO: 182197 - DNA, 1889 bp, Homo sapiens
  Payload ID: 15878
  Gene Symbol: SERF1B
  Gene Name: small EDRK-rich factor 1B (centromeric)
  Uniprot ID: O75920
  ENST ID: ENST00000380750
  CDS Start-End: 184-516
ccggcggctgttgtcgggcctccagcgggcggggccgttggcggagcagaggggaggcgcagccgggcggagggcccacgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatgaggacttttgctgttggatttaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggcgccatctcagctccatgcaacctctgcctcctgggttcaagcagttctcttgcctcagcctcctgggtagctgggattacaggcacgcgctgccacacccaggtaatttatttattttttttttgagacagagtctcgcactgttgcccaggctggactgcagtggcgtgatctctgctcactgcaacctccgcctcccgggttcaagcgattctccagcctcagcttcctgagtagatgggattacaggcgcctgccaccacgcccagctaattttttgtattcttagtagagatggggtttcaccatgttggccaggctggtctccatctcctgacctcgtgattcacccgcctcggcctcccaaagtgctgggattacaggcgtgagtcacagcccccggccataatttagcactttaaaaaataatagccatgttgggccaggcgtggtggctcatgcctgtaatctgagcactttgggagaccaaggcgggtagatcccttgtgcccaggagttcaagaccagcctgggcaacatggcgaaaccccatttctactaaaaatacaaaaattagctggggcgaggggataggccgagttccgggtgtaagggggccattagggagagcagagcgaggcagctgatcttccggattgggggccttgcccggaagctggacctcacggagatgaaacggaagatgcacgaggatatgatctccatacagaactttctcatctacgtggccctgctgcgagtcactccatttatcttaaagaaattggacagcatatgaagattggacatcacatgtgaatgcatgatatgaagagcctggttacagtttctactgttctctgcaagtaaataggcccagaaaggtataagagactctttgaatggacataaaaattctgcttgttaagaacaagttgagctctggtaactgatcttaatagctaaaatataaaaatatttgggaagtctgaaatgaggtctcctggccctggtgtgcccttaatgcctgtgacagttggcctctgtgaatattggtataattgtaaataatgtcaaactccattttctagcaagtattaataattaagggaagtatgtctgaaatggca

SEQ ID NO: 182198 - DNA, 703 bp, Homo sapiens
  Payload ID: 15878
  Gene Symbol: SERF1B
  Gene Name: small EDRK-rich factor 1B (centromeric)
  Uniprot ID: O75920
  ENST ID: ENST00000380751
  CDS Start-End: 206-394
gcgcagtgacgcgccggccatgccggcggctgttgtcgggcctccagcgggcggggccgttggcggagcagaggggaggcgcagccgggcggagggcccacgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagggactctgagatcatgcaagaaaagcagaaggcagctaatgagaagaagtctatgcagacaagagaaaagtgatgactggctatttggaaaacctgggtgctactgccaactgggtgtatcataagctctaagatcaagattttgtagagtggacagtcattacatatgttataacttatcctttaaaaactattttaaactttatcctttcagctttacttagtgcgatgttttagaagcagtcttcaaagaataaaacactaaccatgcatgtgacatattggtgaacattatttttattattgaacattcatatataatttattaggtaatatgatcagataataggatctcttatataataaagaatctttgtcatca

SEQ ID NO: 182199 - DNA, 1666 bp, Homo sapiens
  Payload ID: 15878
  Gene Symbol: SERF1B
  Gene Name: small EDRK-rich factor 1B (centromeric)
  ENST ID: ENST00000506542
  CDS Start-End: 80-325
gtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggcgccatctcagctccatgcaacctctgcctcctgggttcaagcagttctcttgcctcagcctcctgggtagctgggattacaggcacgcgctgccacacccaggtaatttatttattttttttttgagacagagtctcgcactgttgcccaggctggactgcagtggcgtgatctctgctcactgcaacctccgcctcccgggttcaagcgattctccagcctcagcttcctgagtagatgggattacaggcgcctgccaccacgcccagctaattttttgtattcttagtagagatggggtttcaccatgttggccaggctggtctccatctcctgacctcgtgattcacccgcctcggcctcccaaagtgctgggattacaggcgtgagtcacagcccccggccataatttagcactttaaaaaataatagccatgttgggccaggcgtggtggctcatgcctgtaatctgagcactttgggagaccaaggcgggtagatcccttgtgcccaggagttcaagaccagcctgggcaacatggcgaaaccccatttctactaaaaatacaaaaattagctggggcgaggggataggccgagttccgggtgtaagggggccattagggagagcagagcgaggcagctgatcttccggattgggggccttgcccggaagctggacctcacggagatgaaacggaagatgcacgaggatatgatctccatacagaactttctcatctacgtggccctgctgcgagtcactccatttatcttaaagaaattggacagcatatgaagattggacatcacatgtgaatgcatgatatgaagagcctggttacagtttctactgttctctgcaagtaaataggcccagaaaggtataagagactctttgaatggacataaaaattctgcttgttaagaacaagttgagctctggtaactgatcttaatagctaaaatataaaaatatttgggaagtctgaaatgaggtctcctggccctggtgtgcccttaatgcctgtgacagttggcctctgtgaatattggtataattgtaaataatgtcaaactccattttctagcaagtattaataattaagggaagtatgtc

SEQ ID NO: 182200 - DNA, 569 bp, Homo sapiens; identical to SEQ ID NO: 182183
  Payload ID: 15878
  Gene Symbol: SERF1B
  Gene Name: small EDRK-rich factor 1B (centromeric)
  ENST ID: ENST00000503931
  CDS Start-End: 97-324

SEQ ID NO: 182201 - DNA, 792 bp, Homo sapiens
  Payload ID: 15878
  Gene Symbol: SERF1B
  Gene Name: small EDRK-rich factor 1B (centromeric)
  ENST ID: ENST00000515588
  CDS Start-End: 234-524
ggagtccggctggagaatccccctgggtcgcgcagtgcggggatccccgcttcagtcggcagagagagagctcgcgggtggttccggtccggcttttcaggccggacgggtgcctgcccctcaggtgcgagtttgtgcggtaaagaacacaccccggagatgtggacacggccgccccaggagggtccttgtttggaggtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatgaggacttttgctgttggatttaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggcgccatctcagctccatgcaacctct

SEQ ID NO: 182202 - DNA, 1666 bp, Homo sapiens
  Payload ID: 15878
  Gene Symbol: SERF1B
  Gene Name: small EDRK-rich factor 1B (centromeric)
  ENST ID: ENST00000614330
  CDS Start-End: 80-325
gtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggcgccatctcagctccatgcaacctctgcctcctgggttcaagcagttctcttgcctcagcctcctgggtagctgggattacaggcacgcgctgccacacccaggtaatttatttattttttttttgagacagagtctcgcactgttgcccaggctggactgcagtggcgtgatctctgctcactgcaacctccgcctcccgggttcaagcgattctccagcctcagcttcctgagtagatgggattacaggcgcctgccaccacgcccagctaattttttgtattcttagtagagatggggtttcaccatgttggccaggctggtctccatctcctgacctcgtgattcacccgcctcggcctcccaaagtgctgggattacaggcgtgagtcacagcccccggccataatttagcactttaaaaaataatagccatgttgggccaggcgtggtggctcatgcctgtaatctgagcactttgggagaccaaggcgggtagatcccttgtgcccaggagttcaagaccagcctgggcaacatggcgaaaccccatttctactaaaaatacaaaaattagctggggcgaggggataggccgagttccgggtgtaagggggccattagggagagcagagtgaggcagctgatcttccggattgggggccttgcccggaagctggacctcacggagatgaaacggaagatgcacgaggatatgatctccatacagaactttctcatctacgtggccctgctgcgagtcactccatttatcttaaagaaattggacagcatatgaagattggacatcacatgtgaatgcatgatatgaagagcctggttacagtttctactgttctctgcaagtaaataggcccagaaaggtataagagactctttgaatggacataaaaattctgcttgttaagaacaagttgagctctggtaactgatcttaatagctaaaatataaaaatatttgggaagtctgaaatgaggtctcctggccctggtgtgcccttaatgcctgtgacagttggcctctgtgaatattggtataattgtaaataatgtcaaactccattttctagcaagtattaataattaagggaagtatgtc

SEQ ID NO: 182203 - DNA, 792 bp, Homo sapiens; identical to SEQ ID NO: 182201
  Payload ID: 15878
  Gene Symbol: SERF1B
  Gene Name: small EDRK-rich factor 1B (centromeric)
  ENST ID: ENST00000613176
  CDS Start-End: 234-524

SEQ ID NO: 182204 - DNA, 1889 bp, Homo sapiens
  Payload ID: 15878
  Gene Symbol: SERF1B
  Gene Name: small EDRK-rich factor 1B (centromeric)
  Uniprot ID: O75920
  ENST ID: ENST00000622553
  CDS Start-End: 184-516
ccggcggctgttgtcgggcctccagcgggcggggccgttggcggagcagagcggaggcgcagccgggcggagggcccacgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatgaggacttttgctgttggatttaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggcgccatctcagctccatgcaacctctgcctcctgggttcaagcagttctcttgcctcagcctcctgggtagctgggattacaggcacgcgctgccacacccaggtaatttatttattttttttttgagacagagtctcgcactgttgcccaggctggactgcagtggcgtgatctctgctcactgcaacctccgcctcccgggttcaagcgattctccagcctcagcttcctgagtagatgggattacaggcgcctgccaccacgcccagctaattttttgtattcttagtagagatggggtttcaccatgttggccaggctggtctccatctcctgacctcgtgattcacccgcctcggcctcccaaagtgctgggattacaggcgtgagtcacagcccccggccataatttagcactttaaaaaataatagccatgttgggccaggcgtggtggctcatgcctgtaatctgagcactttgggagaccaaggcgggtagatcccttgtgcccaggagttcaagaccagcctgggcaacatggcgaaaccccatttctactaaaaatacaaaaattagctggggcgaggggataggccgagttccgggtgtaagggggccattagggagagcagagtgaggcagctgatcttccggattgggggccttgcccggaagctggacctcacggagatgaaacggaagatgcacgaggatatgatctccatacagaactttctcatctacgtggccctgctgcgagtcactccatttatcttaaagaaattggacagcatatgaagattggacatcacatgtgaatgcatgatatgaagagcctggttacagtttctactgttctctgcaagtaaataggcccagaaaggtataagagactctttgaatggacataaaaattctgcttgttaagaacaagttgagctctggtaactgatcttaatagctaaaatataaaaatatttgggaagtctgaaatgaggtctcctggccctggtgtgcccttaatgcctgtgacagttggcctctgtgaatattggtataattgtaaataatgtcaaactccattttctagcaagtattaataattaagggaagtatgtctgaaatggca

SEQ ID NO: 182205 - DNA, 703 bp, Homo sapiens; identical to SEQ ID NO: 182194
  Payload ID: 15878
  Gene Symbol: SERF1B
  Gene Name: small EDRK-rich factor 1B (centromeric)
  Uniprot ID: O75920
  ENST ID: ENST00000621283
  CDS Start-End: 206-394

SEQ ID NO: 182206 - DNA, 338 bp, Homo sapiens
  Payload ID: 15878
  Gene Symbol: SERF1B
  Gene Name: small EDRK-rich factor 1B (centromeric)
  ENST ID: ENST00000621240
  CDS Start-End: 265-338
gcgcagtgcggggatccccgcttcagtcggcagagagagagctcgcgggtggttccggtccggcttttcaggccggacgggtgcctgcccctcaggtgcgagtttgtgcggtaaagaacacaccccggagatgtggacacggccgccccaggagggtccttgtttggagacttaccttcaatctgttcagtctccatccacccctctccgcctctgcatggggataaaggtggaaatcaacgagaacttgcccgccagaaaaacatgaagaaaacccaggaaattagcaagggaaagaggaaagaggatagcttgactgcctctcagagaaagcagag

SEQ ID NO: 182207 - DNA, 703 bp, Homo sapiens; identical to SEQ ID NO: 182194
  Payload ID: 15878
  Gene Symbol: SERF1B
  Gene Name: small EDRK-rich factor 1B (centromeric)
  Uniprot ID: O75920
  ENST ID: ENST00000611616
  CDS Start-End: 206-394

SEQ ID NO: 182208 - DNA, 433 bp, Homo sapiens
  Payload ID: 15878
  Gene Symbol: SERF1B
  Gene Name: small EDRK-rich factor 1B (centromeric)
  ENST ID: ENST00000622047
  CDS Start-End: 181-327
agtcggcagagagagagctcgcgggtggttccggtccggcttttcaggccggacgggtgcctgcccctcaggtgcgagtttgtgcggtaaagaacacaccccggagatgtggacacggccgccccaggagggtccttgtttggaggtggaaatcaacgagaacttgcccgccagaaaaacatgaagaaaacccaggaaattagcaagggaaagaggaaagaggatagcttgactgcctctcagagaaagcagagggactctgagatcatgcaagaaaagcagaaggcagctaatgagaagaagtctatgcagacaagagaaaagtgatgactggctatttggaaaacctgggtgctactgccaactgggtgtatcataagctctaagatcaagattttgtagagtggacagtcattacatatgttataactta

SEQ ID NO: 182209 - DNA, 1889 bp, Homo sapiens; identical to SEQ ID NO: 182188
  Payload ID: 15878
  Gene Symbol: SERF1B
  Gene Name: small EDRK-rich factor 1B (centromeric)
  Uniprot ID: O75920
  ENST ID: ENST00000613172
  CDS Start-End: 184-516

SEQ ID NO: 182210 - DNA, 632 bp, Homo sapiens; identical to SEQ ID NO: 182189
  Payload ID: 15878
  Gene Symbol: SERF1B
  Gene Name: small EDRK-rich factor 1B (centromeric)
  ENST ID: ENST00000611277
  CDS Start-End: 179-325

SEQ ID NO: 182211 - DNA, 569 bp, Homo sapiens; identical to SEQ ID NO: 182183
  Payload ID: 15878
  Gene Symbol: SERF1B
  Gene Name: small EDRK-rich factor 1B (centromeric)
  ENST ID: ENST00000611952
  CDS Start-End: 97-324

SEQ ID NO: 182212 - DNA, 328 bp, Homo sapiens
  Payload ID: 15878
  Gene Symbol: SERF1B
  Gene Name: small EDRK-rich factor 1B (centromeric)
  ENST ID: ENST00000628627
  CDS Start-End: 267-328
agtgacgcgccggccatgccggcggctgttgtcgggcctccagcgggcggggccgttggcggagcagagcggaggcgcagccgggcggagggcccacgagggctcagccttcccggtcagcggtggtgacggtatcccagagtgccagagaaccgttgcttttccgagttgctcttcttccaggctccgttggtggtcggcatggcccagcatgactgtttgactttgtaggtggaaatcaacgagaacttgcccgccagaaaaacatgaagaaaacccaggaaattagcaagggaaagaggaaagaggatagcttgactgcctctca

SEQ ID NO: 182213 - DNA, 1693 bp, Homo sapiens
  Payload ID: 15878
  Gene Symbol: SERF1B
  Gene Name: small EDRK-rich factor 1B (centromeric)
  ENST ID: ENST00000625862
  CDS Start-End: 107-352
acgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggcgccatctcagctccatgcaacctctgcctcctgggttcaagcagttctcttgcctcagcctcctgggtagctgggattacaggcacgcgctgccacacccaggtaatttatttattttttttttgagacagagtctcgcactgttgcccaggctggactgcagtggcgtgatctctgctcactgcaacctccgcctcccgggttcaagcgattctccagcctcagcttcctgagtagatgggattacaggcgcctgccaccacgcccagctaattttttgtattcttagtagagatggggtttcaccatgttggccaggctggtctccatctcctgacctcgtgattcacccgcctcggcctcccaaagtgctgggattacaggcgtgagtcacagcccccggccataatttagcactttaaaaaataatagccatgttgggccaggcgtggtggctcatgcctgtaatctgagcactttgggagaccaaggcgggtagatcccttgtgcccaggagttcaagaccagcctgggcaacatggcgaaaccccatttctactaaaaatacaaaaattagctggggcgaggggataggccgagttccgggtgtaagggggccattagggagagcagagcgaggcagctgatcttccggattgggggccttgcccggaagctggacctcacggagatgaaacggaagatgcacgaggatatgatctccatacagaactttctcatctacgtggccctgctgcgagtcactccatttatcttaaagaaattggacagcatatgaagattggacatcacatgtgaatgcatgatatgaagagcctggttacagtttctactgttctctgcaagtaaataggcccagaaaggtataagagactctttgaatggacataaaaattctgcttgttaagaacaagttgagctctggtaactgatcttaatagctaaaatataaaaatatttgggaagtctgaaatgaggtctcctggccctggtgtgcccttaatgcctgtgacagttggcctctgtgaatattggtataattgtaaataatgtcaaactccattttctagcaagtattaataattaagggaagtatgtc

SEQ ID NO: 182214 - DNA, 663 bp, Homo sapiens; identical to SEQ ID NO: 182184
  Payload ID: 15878
  Gene Symbol: SERF1B
  Gene Name: small EDRK-rich factor 1B (centromeric)
  ENST ID: ENST00000628126
  CDS Start-End: 208-354

SEQ ID NO: 182215 - DNA, 569 bp, Homo sapiens; identical to SEQ ID NO: 182183
  Payload ID: 15878
  Gene Symbol: SERF1B
  Gene Name: small EDRK-rich factor 1B (centromeric)
  ENST ID: ENST00000626049
  CDS Start-End: 97-324

SEQ ID NO: 182216 - DNA, 532 bp, Homo sapiens; identical to SEQ ID NO: 182186
  Payload ID: 15878
  Gene Symbol: SERF1B
  Gene Name: small EDRK-rich factor 1B (centromeric)
  ENST ID: ENST00000627838
  CDS Start-End: 265-532

SEQ ID NO: 182217 - DNA, 846 bp, Homo sapiens
  Payload ID: 15878
  Gene Symbol: SERF1B
  Gene Name: small EDRK-rich factor 1B (centromeric)
  ENST ID: ENST00000630348
  CDS Start-End: 192-482
atccccgcttcagtcggcagagagagagctcgcgggtggttccggtccggcttttcaggccggacgggtgcctgcccctcaggtgcgagtttgtgcggtaaagaacacaccccggagatgtggacacggccgccccaggagggtccttgtttggaggtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatgaggacttttgctgttggatttaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggcgccatctcagctccatgcaacctctgcctcctgggttcaagcagttctcttgcctcagcctcctgggtagctgggattacaggcacgcgctgccacacccaggtaatttatttattttttt

SEQ ID NO: 182218 - DNA, 1537 bp, Homo sapiens
  Payload ID: 15879
  Gene Symbol: SERF2
  Gene Name: small EDRK-rich factor 2
  Uniprot ID: P84101
  ENST ID: ENST00000249786
  CDS Start-End: 536-715
agcgagctgtgaacaactcgtgtccaaataagtggctgagaggtggtcctaagtaagcacaagtttagtagtagagtactcgtaacacagaactggctgaaaccccgccctcttgtctacgggcgttctttcagggcgactttgtcagtaccccaaactgtccccgcatgaggtcactctgcacggtcacgtgctcgagcccgcgggagcgccacatcgccagccgcacccctccacccccaacctgcccacgtgacccggcctagtttctccaggcccgtccctacgtctcactcgggaagccccgccccacgctgagcgctccgcctgcgaccctccgccacttacccaccccggctcaagcacgacccgtggatccacgtgctttttcttgtccaatgggagccggctcccgggcgcgaaggggcggggaggaaaggaacgactgtgctacgttgccagaaggggcgggacctgcaacgtccgacagaacgaggggacgtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattccttgagcgcctggtttgactggggacttggggggatggggttggaagaatgactgccctttcccaccaaaaaagggagaactctttagattcagattgtgggtatgtagacttaataagtgaaacatcacagaagaagcctttattatacaatgacaaccaaacaagtactccggatatgcagtagaggaatcctctaagaaccatagagacttcttttctgtgatttttgttccccacccttgaacaccatctctaggatggagttggcctaagagtgaatgctgcaagatctgtgtttatgcctcttttcctcattcttcctcagtttgttcgtctgcttgaaagttggccaaaaaatcctgctgctcaccgacttcccgtggtcagctgctgtcaagcgttcactttctcttctgtcattcctcatggaatgagggtggttttgtcttcccgcttcccttgacctcaaaatcaggattaaaacctggggtagcctctgtgctcctttcttctatgccctggtttgttctgtggttctgggcttctt

SEQ ID NO: 182219 - DNA, 506 bp, Homo sapiens
  Payload ID: 15879
  Gene Symbol: SERF2
  Gene Name: small EDRK-rich factor 2
  Uniprot ID: P84101
  ENST ID: ENST00000339624
  CDS Start-End: 31-432
cggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagtgccccatcatctctacccccagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattc

SEQ ID NO: 182220 - DNA, 1931 bp, Homo sapiens
  Payload ID: 15879
  Gene Symbol: SERF2
  Gene Name: small EDRK-rich factor 2
  Uniprot ID: P84101
  ENST ID: ENST00000381359
  CDS Start-End: 930-1109
ggccaaccgcccggacctcggcgctttcttctaggatccgcatgaatcgctttgggctatcggaagagctatccccagttctcgggagaaagagtccgcgaccagcgtctgacctctcactcagagtccccagtcctgccttagtttccccagcgaccctgaatttggagttgctgtctctaagtgaaagctgaacctgcaaccccttgagggtttcagccgcagaggggcgggagaaagggcctggttggtaggcgggctcagcggttcgcgcccagttagccccgagcttcggagacccgagagaccagaggatggctgacacgaaggggcacccgagacagcgcctgggctttttcccgcccgcggttccaccgctctgaaaccgatttctaacagagagagacatagtcttgctctgttacccatgctggagtacggtggcgagatcacgactcactacaactttgaattcctggattcaagcaatcctcccatctcagcctcctgagtagctaaggactacagggcgactttgtcagtaccccaaactgtccccgcatgaggtcactctgcacggtcacgtgctcgagcccgcgggagcgccacatcgccagccgcacccctccacccccaacctgcccacgtgacccggcctagtttctccaggcccgtccctacgtctcactcgggaagccccgccccacgctgagcgctccgcctgcgaccctccgccacttacccaccccggctcaagcacgacccgtggatccacgtgctttttcttgtccaatgggagccggctcccgggcgcgaaggggcggggaggaaaggaacgactgtgctacgttgccagaaggggcgggacctgcaacgtccgacagaacgaggggacgtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattccttgagcgcctggtttgactggggacttggggggatggggttggaagaatgactgccctttcccaccaaaaaagggagaactctttagattcagattgtgggtatgtagacttaataagtgaaacatcacagaagaagcctttattatacaatgacaaccaaacaagtactccggatatgcagtagaggaatcctctaagaaccatagagacttcttttctgtgatttttgttccccacccttgaacaccatctctaggatggagttggcctaagagtgaatgctgcaagatctgtgtttatgcctcttttcctcattcttcctcagtttgttcgtctgcttgaaagttggccaaaaaatcctgctgctcaccgacttcccgtggtcagctgctgtcaagcgttcactttctcttctgtcattcctcatggaatgagggtggttttgtcttcccgcttcccttgacctcaaaatcaggattaaaacctggggtagcctctgtgctcctttcttctatgccctggtttgttctgtggttctgggcttctt

SEQ ID NO: 182221 - DNA, 690 bp, Homo sapiens
  Payload ID: 15879
  Gene Symbol: SERF2
  Gene Name: small EDRK-rich factor 2
  Uniprot ID: P84101
  ENST ID: ENST00000403425
  CDS Start-End: 280-417
gccgtcgccatgacccgtgagcaccgagcccccttctccttgcccttttctttccgttcaccctaaacaccaccggcgaggcgccggctttgaccttccgtagcttccctagcaaggcgtttctctgggcgcgctctgtggccaccctcacactcggtgcccggaaatcgagccctttgcccacggctacttcacgggaccaccctcccgggttaggcataggccctcccggatcttccgcggtgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattc

SEQ ID NO: 182222 - DNA, 586 bp, Homo sapiens
  Payload ID: 15879
  Gene Symbol: SERF2
  Gene Name: small EDRK-rich factor 2
  Uniprot ID: P84101
  ENST ID: ENST00000402131
  CDS Start-End: 247-384
gccgtcgccatgacccgtgagcaccgagcccccttctccttgcccttttctttccgttcaccctaaacaccaccggcgaggcgccggctttgaccttccgtagcttccctagcaaggcgtttctctgggcgcgctctgtggccaccctcacactcggtgcccggaaatcgagccctttgcccacggctacttcacgggaccaccctcccgggcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgaggg

SEQ ID NO: 182223 - DNA, 700 bp, Homo sapiens
  Payload ID: 15879
  Gene Symbol: SERF2
  Gene Name: small EDRK-rich factor 2
  ENST ID: ENST00000409617
  CDS Start-End: 24-146
aggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagcttctagaactggagcagaaagaaggtgtggcccagggccagccccgcctcctccccgggcggaagctgtgtcagttgccggaagtcggcgtgaggtggggcttatgcggcggcgtggtgaaatagatatggcgaccgagggggatgtggagctggagttggagactgagaccagtggaccagagcggcctccggagaagccacggaaacatgacagcggtgcggcggacttggagcgggtcaccgactatgcagaggagaaggagatccagagttccaatctggagacggccatgtctgtgattggagacagaaggtcccgggagcagaaagccaaacaggagcgggagaaagaactggcaaaagtcactatcaagaaggaagatctggagctaataatgactgagatggagatatctcgagcagcagcagaacgcagtttgcgggaacacatgggcaacgtggtagaggcgcttattgccctaaccaactgatgcgtgctttctcaaatatacctactggattaatttatggcaataaaatttttttttgtctttttca

SEQ ID NO: 182224 - DNA, 559 bp, Homo sapiens
  Payload ID: 15879
  Gene Symbol: SERF2
  Gene Name: small EDRK-rich factor 2
  ENST ID: ENST00000409646
  CDS Start-End: 48-299
agaacgaggggacgtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagaaagtacacacaaacctattatgcagctgtgcccgcgggctggtgggggagtggaggtggaccagcaacacagcctgcagcaggtggaaggtggcggttcctgcacatactcggtacacagccccagagccactgagcactggacagtcagagaggccaaacaggttctgtttcaagctgattccagccatttgggattgccgcccactgacaacttagtagggctttcattataagcaggcttgagatatctgacctttctctcgacctaaacacctggggctggaaacatggcgggagagatttacagattatacctggggcaacgaaccagaacgacattagaggagaaaagaggcctgtcgtttttattggcttctgcacgtcttcctcccc

SEQ ID NO: 182225 - DNA, 582 bp, Homo sapiens
  Payload ID: 15879
  Gene Symbol: SERF2
  Gene Name: small EDRK-rich factor 2
  Uniprot ID: P84101
  ENST ID: ENST00000409614
  CDS Start-End: 172-309
ggcctcgatgggccgttgtcggggcccggagattgaagtggtgttggatcctgctgctggccgcgctggggtagaagggtcgccggtgtgtgggcagagcggcccccgcgtctcacctttaattttctttccttaggcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattc

SEQ ID NO: 182226 - DNA, 807 bp, Homo sapiens
  Payload ID: 15879
  Gene Symbol: SERF2
  Gene Name: small EDRK-rich factor 2
  ENST ID: ENST00000409291
  CDS Start-End: 73-201
cggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagaggttctgtttcaagctgattccagccatttgggattgccgcccactgacaacttagtagggctttcattataagcaggcttgagatatctgacctttctctcgacctaaacacctggggctggaaacatggcgggagagatttacagattatacctggggcaacgaaccagaacgacattagaggagaaaagaggcctgtcgtttttattggcttctgcacgtcttcctccccagcttcggccactctccccttcgcaccctctcacctgacagaagggacttttcactaggacactgctgcctccgctgtgctgctgtgccaggcccagggaggtgccggggctggggccggccttggcacccaccatccttgtcccagggattaggcttaggtccaccagatggaaggcagatgagagcagcagttgcttctgtcctcagcccattggactgccactgtgttggggctgagcacccggtcccgggcagaatggagacgtccggaagagaacactgacctccaggttgcggtaaatgcaaatgccctgtgaaggagctttgtccttagggcctcaacactgcggccactcaggctgttctctccagattagggggcagtttgtctatctggccccctgtggattagcattctttattggtt

SEQ ID NO: 182227 - DNA, 1032 bp, Homo sapiens
  Payload ID: 15879
  Gene Symbol: SERF2
  Gene Name: small EDRK-rich factor 2
  Uniprot ID: P84101
  ENST ID: ENST00000409960
  CDS Start-End: 48-560
agaacgaggggacgtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggtgggagtacagcagccaaacgctgaacttagtcccatccacttccatcttatcctttgtgcccttcatccccctgcatcttgtcctttttgccctctggtacctcccagtgccccatcatctctacccccagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattccttgagcgcctggtttgactggggacttggggggatggggttggaagaatgactgccctttcccaccaaaaaagggagaactctttagattcagattgtgggtatgtagacttaataagtgaaacatcacagaagaagcctttattatacaatgacaaccaaacaagtactccggatatgcagtagaggaatcctctaagaaccatagagacttcttttctgtgatttttgttccccacccttgaacaccatctctaggatggagttggcctaagagtgaatgctgcaagatctgtgtttatgcctcttttcctcattcttcctcagtttgttcgtctgcttgaaagttggccaaaaaatcctgctgctcaccgacttcccgtggtcagctgctgtca

SEQ ID NO: 182228 - DNA, 2792 bp, Homo sapiens
  Payload ID: 15879
  Gene Symbol: SERF2
  Gene Name: small EDRK-rich factor 2
  ENST ID: ENST00000448830
  CDS Start-End: 24-350
aggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagtgctattacttcatcccggaatttcctttacccagcctatgtctactttccctcctctgtcccctccccacccagaaagtacacacaaacctattatgcagctgtgcccgcgggctggtgggggagtggaggtggaccagcaacacagcctgcagcaggtggaaggtggcggttcctgcacatactcggtacacagccccagagccactgagcactggacagtcagagaggccaaacaggaggcagcagattgctgaggcccccacatggaggaggatgtagaacaggcggctgcaagtggatgcggtgagagagggccacctagagtggcagcagctggcacaaggagcaggcccacagcagcacacctgggagtagagcagatgcaaggcagcgaggtggagacttgctgaggaaaggcatacgttaatgtatgtgtgaggttaacccaggaggttgaattccaaaatttccccttcccctttcttccttttactcaggttctgtttcaagctgattccagccatttgggattgccgcccactgacaacttagtagggctttcattataagcaggcttgagatatctgacctttctctcgacctaaacacctggggctggaaacatggcgggagagatttacagattatacctggggcaacgaaccagaacgacattagaggagaaaagaggcctgtcgtttttattggcttctgcacgtcttcctccccagcttcggccactctccccttcgcaccctctcacctgacagaagggacttttcactaggacactgctgcctccgctgtgctgctgtgccaggcccagggaggtgccggggctggggccggccttggcacccaccatccttgtcccagggattaggcttaggtccaccagatggaaggcagatgagagcagcagttgcttctgtcctcagcccattggactgccactgtgttggggctgagcacccggtcccgggcagaatggagacgtccggaagagaacactgacctccaggttgcggtaaatgcaaatgccctgtgaaggagctttgtccttagggcctcaacactgcggccactcaggctgttctctccagattagggggcagtttgtctatctggccccctgtggattagcattctttattggtttaggattagacgtcattcaggttgaacggagttccctgaggtgggtgggtgcgtgtttatgtgttgaggggactattcctagtttatgaggtggttaaggatatcggtggggtgggctggagcggtgtcgggttaggtctgagagaaggcctcgcacaaaacactgtacaaacccgaaaggaagtctgagagacgaaccgccttcctccctgaagcttctagaactggagcagaaagaaggtgtggcccagggccagccccgcctcctccccgggcggaagctgtgtcagttgccggaagtcggcgtgaggtggggcttatgcggcggcgtggtgaaatagatatggcgaccgagggggatgtggagctggagttggagactgagaccagtggaccagagcggcctccggagaagccacggaaacatgacagcggtgcggcggacttggagcgggtcaccgactatgcagaggagaaggagatccagagttccaatctggagacggccatgtctgtgattggagacagaaggtcccgggagcagaaagccaaacaggagcgggagaaagaactggcaaaagtcactatcaagaaggaagatctggagctaataatgactgagatggagatatctcgagcagcagcagaacgcagtttgcgggaacacatgggcaacgtggtagaggcgcttattgccctaaccaactgatgcgtgctttctcaaatatacctactggattaatttatggcaataaaatttttttttgtctttttcagttttatcatcttgggtcaagtagagtgtatactatatcctatgttgtggagaatttatatgttggagactaactgaatttaagtgacccattaaaatctagcacacctgtatgaaaaatcagtgtagaagaatacctcatgtgcagatgctaggtggcaggccagtctcattcatctgactagctctcaacagtattcaaggtacatctggagtctcagcagagttactgtactcaaatggcatgtgtctccaagacagcttatgaatatctaaaaggccagctacctgcctaggagccactatatatatagatagatgtaggttatgaacccagttcataggccaccttgagttagaattttggtacctacaacatgcttgattttgagtgattaaaaaaaaataatttggctgggtgctgtggctcacacctctaatcccagcactttgggaggtcgaggcaggtagatcacgaggtcaggaattcaagaccagcctggccaacatgtgaaaccccgtctccactgaaaatagaaaaattagctgggcatggtggtgggcgcctataatcccagctattctggaggctgaggcaggaatcgcttgaaattggaaagcagaggttgcagtgagctgagatcacactactgtactactgtactccagcctgggggaaagagtgaaactccatctcaaaaaaaaaaaaaaaaaaaa

SEQ ID NO: 182229 - DNA, 483 bp, Homo sapiens
  Payload ID: 15879
  Gene Symbol: SERF2
  Gene Name: small EDRK-rich factor 2
  ENST ID: ENST00000430901
  CDS Start-End: 271-483
atgacccgtgagcaccgagcccccttctccttgcccttttctttccgttcaccctaaacaccaccggcgaggcgccggctttgaccttccgtagcttccctagcaaggcgtttctctgggcgcgctctgtggccaccctcacactcggtgcccggaaatcgagccctttgcccacggctacttcacgggaccaccctcccgggttaggcataggccctcccggatcttccgcggtgcggtaaccagcgtgagctcgcccgccagaagaatatgaaaaagcagagcgactcggttaagggaaagcgccgagatgacgggctttctgctgccgcccgcaagcagagtgctattacttcatcccggaatttcctttacccagcctatgtctactttccctcctctgtcccctccccacccagaaagtacacacaaacctattatgcagctgtgcccgcgggctggtgggggagtggaggtggacca

SEQ ID NO: 182230 - DNA, 2099 bp, Homo sapiens
  Payload ID: 15879
  Gene Symbol: SERF2
  Gene Name: small EDRK-rich factor 2
  Uniprot ID: P84101
  ENST ID: ENST00000445816
  CDS Start-End: 41-220
ggggacgtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcagtttgttcgtctgcttgaaagttggccaaaaaatcctgctgctcaccgacttcccgtggtcagctgctgtcaagcgttcactttctcttctgtcattcctcatggaatgagggtggttttgtcttcccgcttcccttgacctcaaaatcaggattaaaacctggggtagcctctgtgctcctttcttctatgccctggtttgttctgtggttctgggcttcttatatccgtgtgcccagggctgaactccttattttcctttctccaagggcagagccgagtcttcagtccctgttggtctttccccacccccacttccagcccaagagccaggaaagggctggtgccacactgtctgctgggatcagcggtggttctttgagctgctgatttgggtgttaggctcttgagctgggatgcagatgtaacagtagctccagtgagtcagacactctgcccagcacattagactgtgtttgaccacttcttccagttcatagtattgacttcagcccaaacggagataactccctgtgtgtccttgaggtattgagctgggctggacagctccccttgagccaactctaggagtacaatgtcaggggaaccccagtttgtgaaaaggacttagactggaggatatttgttatctggggatatgatgcggtggcggcggcgcctcaagataaggggctggggtttctgggtggggggccaacagagtggtgccagtaacagccccagatagaggagtacgcaggcccagcatgaggcaaccttgacccagaaggtggcccagctacccttgatgaaggtcttttccagttctgctccctcatagctgtgtaaccaaaggctctggttagagaatatgaagggccttagcttttagacctgttctacctcctcaccaaatataatggcagacccatgtgtgtctggaatggccttgaattgctctttccttaaaatagctagctcttcaggagagtatctaaggcccactccatcttacctgaaccagttggtaagggtaaccatgacatagagtgaggcaaggaagaagacgaagtggaaggcagaatagttgtaggaaagatgctggacttggactggaggagctggaggggtttcttggtcagctggcctcgcagccccacccctttgccctggagagaggaaatggctgctgggagcagagctgctgaaacacctcttcccctctcccccaactacctttgttaaggctcttgagggttcttatggcactccacagagatctaccacttcttatggttcctcacttggcactcacctttgtctgcctccactgtttcagggcagcagaaacacagtgagggcttctgcaaaacagaacgcaggttttggaatggtcttaaaagatgtgagggtgttaatctaggaaacttcccccgtgaaaagattggtctagtattaaaaagtggaggcacacctgggttcaaattctagctccagcatataagtggctgtgcagactttggtaagatgtttaatcttttgtgcctcgatttctccatttgtaaaatggagcaaatacctacctcacagggttgttgtgagggttaaattaaatgagattatgtaaaagtatctagcacagttgcctagcacattgtgggtactcaataaaaggtaacagcagctataatctgagcattctgggtagaggttggta

SEQ ID NO: 182231 - DNA, 862 bp, Homo sapiens
  Payload ID: 15879
  Gene Symbol: SERF2
  Gene Name: small EDRK-rich factor 2
  ENST ID: ENST00000630046
  CDS Start-End: 536-862
agcgagctgtgaacaactcgtgtccaaataagtggctgagaggtggtcctaagtaagcacaagtttagtagtagagtactcgtaacacagaactggctgaaaccccgccctcttgtctacgggcgttctttcagggcgactttgtcagtaccccaaactgtccccgcatgaggtcactctgcacggtcacgtgctcgagcccgcgggagcgccacatcgccagccgcacccctccacccccaacctgcccacgtgacccggcctagtttctccaggcccgtccctacgtctcactcgggaagccccgccccacgctgagcgctccgcctgcgaccctccgccacttacccaccccggctcaagcacgacccgtggatccacgtgctttttcttgtccaatgggagccggctcccgggcgcgaaggggcggggaggaaaggaacgactgtgctacgttgccagaaggggcgggacctgcaacgtccgacagaacgaggggacgtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagtgctattacttcatcccggaatttcctttacccagcctatgtctactttccctcctctgtcccctccccacccagaaagtacacacaaacctattatgcagctgtgcccgcgggctggtgggggagtggaggtggaccagcaacacagcctgcagcaggtggaaggtggcggttcctgcacatactcggtacacagccccagagccactga

SEQ ID NO: 182232 - DNA, 6643 bp, Homo sapiens
  Payload ID: 15880
  Gene Symbol: SGSM1
  Gene Name: small G protein signaling modulator 1
  Uniprot ID: Q2NKQ1
  ENST ID: ENST00000400358
  CDS Start-End: 58-3339
ctaccgccgccaccgccgccaccgcctcctgggactcggaacgcagcgctcggagccatggcctcggcccccgcggaggcggagacccgacagaggctgctacgcaccgtcaagaaggaggtgaagcagatcatggaggaggctgtgacacgcaagtttgtccacgaagacagcagccacatcatctccttctgtgcggctgtggaggcctgcgttctgcacgggcttcggcggcgggcggctggcttcctacgcagcaataagattgcagccctctttatgaaagtgggcaagaacttcccgccggctgaggatctgagccgcaaggtgcaagacctggagcagctgatcgagagcgcgagaaaccagattcaaggcctccaggagaatgtgcggaagctgccgaagctgcccaacttgtccccacttgccatcaagcatctgtggattcgcacagccttgtttgagaaggtcctggacaaaattgtgcattaccttgtggaaaacagcagtaaatactatgagaaggaagctctcctgatggaccctgtggacggccccatccttgcatctttgttggtggggccctgtgccctagagtacaccaagatgaagactgcagatcacttctggaccgatccctcggctgacgaacttgtccagaggcaccgcatccacagctcccacgtgcggcaggactcgcccaccaagcgtcctgccctctgtatccagaagaggcattccagtggcagcatggatgaccggccatccctctctgcccgcgactacgtggagtccctgcatcagaactcccgtgccacccttctctatggcaaaaacaacgttcttgttcagccgagggacgacatggaggctgtgccagggtacctgtccctgcaccagacggctgacgtcatgaccttgaagtggacacccaaccagctgatgaacgggtctgtgggggacctggactatgagaagagcgtctactgggactatgccatgaccatccgcttggaggagattgtctacctgcactgccaccagcaagttgacagcggcgggacagtggtattggtcagccaggacgggatccagaggccgcccttccgcttccccaagggcgggcacctcctgcagttcctctcgtgcctggagaatgggctgctcccacatgggcagttggacccgccactgtggtcccagaggggtaagggcaaagtgtttcctaaactgcgcaagcgaagccctcagggttctgccgagtccacatcttcagacaaagatgatgatgaggccacggattatgtgttcaggatcatctaccctggcatgcagtcggaattcgtgccccaggatctgatggacgtctctgtaagcaacctcccatccctgtggcagcccagtccccggaagtcctcctgttcatcctgttcacagagtggctcggctgatggtagctcgaccaatggctgcaaccatgagagggctcccctgaaacttctctgtgacaatatgaagtaccagatcctctccagagccttctatggatggctggcctactgcagacacctgtccaccgtgagaacccacctatcagccctggtcaatcacatgatcgtgtctccagacttgccctgcgatgctggacagggactgacagccaggatctgggagcagtaccttcacgacagcacaagttacgaggagcaggagctgctgcgcctcatctactacgggggcatccagcctgagatccgcaaggccgtgtggcccttcctcctgggccactaccagttcgggatgacggaaacagaaaggaaagaggtggacgagcagattcatgcctgctatgcacagaccatggctgagtggctgggctgcgaggcgatcgtgcggcagagggagcgggagtcccatgcggccgccctggccaaatgctcatccggggccagcttggacagccacctgcaccggatgttgcacagggactcaaccatcagcaatgagtcctcccagagctgcagttcgggccgccagaacatccgcctgcacagcgactccagcagcagcacacaggtgtttgagtctgtggatgaggtggagcaggtggaggctgaaggcagattggaggagaaacagcccaagatccccaatgggaacctagtgaacggcacttgttccccagactcgggtcatccttcctcccataacttctcctcgggcctctcagagcactcagagcccagtctgagcacagaagacagtgtcttggacgcccagcggaacacccccacggtgctgcgacctagggatggcagcgtggatgacaggcagagcagcgaggccaccacatctcaggatgaggctccccgggaggagctggccgtgcaggacagcctggagagtgacctcctggccaacgagagcatggacgagttcatgtccatcacgggcagcctggacatggccctgcctgaaaaggacgatgttgtgatggagggctggaggagcagcgagacagagaaacatggccaggcggacagtgaggacaacctctcggaggagcctgagatggaaagtctcttccctgccctggcttctctggctgtgactacttctgccaacgaggtgtcccctgtgtcttccagcggcgtcacctactctccagagctgctggatctgtacacggtgaacctgcaccgcatcgagaaggatgtgcagaggtgcgaccgcaactactggtacttcacgcccgccaacttggagaagctgcgtaacatcatgtgcagctacatctggcagcacattgagatcggctatgtccagggcatgtgtgatcttctggctccactgctggtcattctggatgatgaggcccttgccttcagctgcttcacggagctcatgaagaggatgaaccagaacttcccccacggaggcgccatggacacgcactttgcaaacatgagatcgttgatccagatcctggactcagagctgtttgagctgatgcatcagaacggggactatactcacttctacttctgctaccgctggttcctgctggatttcaagcgagaactcgtctatgatgacgtcttcttggtctgggagaccatctgggcagccaaacacgtctcctctgcgcactacgtcctgttcattgcgctggctctggtggaagtctaccgtgacatcattttggagaacaacatggatttcacagacatcatcaaattctttaatgaaatggctgagcgacacaacaccaagcaagtcctgaagctggcgcgggacctcgtgtacaaggtgcagactctgattgagaacaagtgaggggcacctcaccccggcagcctcagccaagctgcccctgccccgctcctctgcttacttttcctcctggctggatgggcaccccgggagcggggtcctggtgtctgttcacaagcgtggagttcagtgcgcaaagaaactaccctgacttttacttctgggcagatggggtggagggagtaccccttcaattcagccttacattttcctgtttgaccaaagattgcccaagtctggcgttcctcccttgcaggaggtggaggttgttggtggaggaggagccatctttgtttgctggtgcccggaatggtctcctcttcttctttccctatccctccaaactgtcttgtaagatgagacctggggaggaaacttctttttggaaattggtgtagaagaggtgtgtggggctacctctatgctcctctgcaaggggcctttggcgatgttctggacatggctgaagattgacttagagattgaccctccacctcgacattactgacatttggggccaggtgattctttttgaggggactgtcccctgcattgtaggatgctgagcagcatcccgggcctcaccagatgccagtagtgccatcccccaaccatacccctggttgtgacagcccccaaaaatgtctctagacattgcgaaatgttccctgcagggcaaaattgcccccatttgagaaccactggcttggagaagggactacaaatgtacttcctcccccattcttttgacgctaagccaccctggtcctgacgcctcccctcacttagaaaaggcatacaggaggccgggcatggtggctcacacctgtaatcccagcactttgggaggctaaggtgggcggatcacaaggtcaggagttttgagaccagcctggccaacatggtgaaaccccatctctactaaaaatacaaaaattagctgggtgtggtggcgggtgcctgtaatcccagctacttgggaggctgaggcaggagaatcacttgaacctgggaggtggaggttgcagtgagttgagatcacgccactgcactccagcccgggcgacagttcaagactccatctcaaaaaaaaaaagaaaaggcacacaagagtccctcacacatctctcttggagtctgggattccatctgttgtattttctccttttttctcctctgtctgatgccagaagatacttgttttcttcttttcaagaaaagtatctccccacataggcggtggacccaaaaagtgtaggcatgagacggtcagagctctttggggtcctgctcagagtcccccaggcagggcagagtctgtatcctgctgccatcttgcaagggaaaaccgcctctccttccaagtattgggtcttggaaaggtgtgtgtttggtgaaagccacttaatggtggtggggtgcagcttttctctaagtgcagttactcactcaggacaaaggaggaaaaggaaggcagaggtcagccagggtagagggtgatgtctgttttccttgggaaacatctgctgatgaactgggtccagggccgtgctaggtctgggaacaatcctctccaggtcttcacacagagtatcaccaatccacaaacagacccgaagtgaactagtttactctgcctacctgtcctttcaatagagcagtctttcccgctcttctgttctgagaatgcacccggaatgggggaaacccagcaagcagcagagagaaaggctcttcccgggagacctgccgcctctagggtggtcagagaatagcagctgggattttggagagggagaggataggtaaagcagcgtattgaagcatttgcggaggggtgtattagtcctcccaccctgagcacaccaggacggggatgcatccttgccttgtgtgcttgtaaaggcttctttcccttggtatagcaacttcaactgcacctgaacctccaacctctgcccagcctctggtgcagggtggatagaggtctagccagcccttacttcctgaagagagctctgtgggaaactcgaggctacagtagcttcccggctcccagctcctaccctacccccaccaaagcagaaacgggagacggcaacgttctggctgccattagacttacgtctccctcccctacgtcccctagcttcccaagacaggaagaaatgtgcaaaaggcccctccggagaaaactattttgccgttcagctgttctttacagaggatgttattttagtgagacccaggtcctagaccttctgattcctatttatttttttaacagactagtctcaaagtacagcacaaaatctcttctctgccttctcttgtgatgttccagagagcatctgtggttgtgatttggaataagtcatatttatttggtttactgtgcctattcagatctctgtatgttgtgtgtgtttctgtgtcctggaattggatgcgtgggactcgttctgtccgcggagtgcactctttttttcagtgtggcccacatatcttgtaaatgtttgctgaagagttgtgtctatatatagagaaaatatatataaacagagaaatatgtgaatctgtttttttttgtctttttttttttaatttgaaagaaaaaaatgcttgcttctgaggactgtgtcctcccactcacaccccagtgaccctatatggggtcagatttttgtaatagctgcctggccttttcccagaaaaggtgaatcacttctgacttcttgtattagctggctcttaccacaagtaatgctgcattacaaatgacccaaaaagtagtggtttaaaacagccatgtatttacctcataattctgtgggtcagcatcccaggctaggttcagctaggaggttcttctgttctcagacttcttcatgtgtctgtggtcagctgatgtccagataggcaactctgcttctgatggttgtctggctgttgactagggcagtgggggaaactggattccgtatcttgcatcctccagcaggctagcttaggcttgtttacatggctatgatagcagatcccagaaggtaagcagaaacacacactgtctcttggtctcagcttctctggcataaagtcatttctgccacattctgttggtcagagtaagtcacatgactcagcccagcttcatagggtagggaaatagactgtacttcctgatgagaatctttggaaagtgacactgaaaaggagcatgggccaggcacagtggcttacccctgtaatcccagcactttgggaggccaaagcaggaggatcacttgaggccaagagttcaagatca

SEQ ID NO: 182233 - DNA, 4317 bp, Homo sapiens
  Payload ID: 15880
  Gene Symbol: SGSM1
  Gene Name: small G protein signaling modulator 1
  Uniprot ID: Q2NKQ1
  ENST ID: ENST00000400359
  CDS Start-End: 8-3454
cggagccatggcctcggcccccgcggaggcggagacccgacagaggctgctacgcaccgtcaagaaggaggtgaagcagatcatggaggaggctgtgacacgcaagtttgtccacgaagacagcagccacatcatctccttctgtgcggctgtggaggcctgcgttctgcacgggcttcggcggcgggcggctggcttcctacgcagcaataagattgcagccctctttatgaaagtgggcaagaacttcccgccggctgaggatctgagccgcaaggtgcaagacctggagcagctgatcgagagcgcgagaaaccagattcaaggcctccaggagaatgtgcggaagctgccgaagctgcccaacttgtccccacttgccatcaagcatctgtggattcgcacagccttgtttgagaaggtcctggacaaaattgtgcattaccttgtggaaaacagcagtaaatactatgagaaggaagctctcctgatggaccctgtggacggccccatccttgcatctttgttggtggggccctgtgccctagagtacaccaagatgaagactgcagatcacttctggaccgatccctcggctgacgaacttgtccagaggcaccgcatccacagctcccacgtgcggcaggactcgcccaccaagcgtcctgccctctgtatccagaagaggcattccagtggcagcatggatgaccggccatccctctctgcccgcgactacgtggagtccctgcatcagaactcccgtgccacccttctctatggcaaaaacaacgttcttgttcagccgagggacgacatggaggctgtgccagggtacctgtccctgcaccagacggctgacgtcatgaccttgaagtggacacccaaccagctgatgaacgggtctgtgggggacctggactatgagaagagcgtctactgggactatgccatgaccatccgcttggaggagattgtctacctgcactgccaccagcaagttgacagcggcgggacagtggtattggtcagccaggacgggatccagaggccgcccttccgcttccccaagggcgggcacctcctgcagttcctctcgtgcctggagaatgggctgctcccacatgggcagttggacccgccactgtggtcccagaggggtaagggcaaagtgtttcctaaactgcgcaagcgaagccctcagggttctgccgagtccacatcttcagacaaagatgatgatgaggccacggattatgtgttcaggatcatctaccctggcatgcagtcggaattcgttgcccccgacttcttgggcagcacttcctccgtctctgtgggccctgcctggatgatggttcctgcaggccggtccatgctggtggtggccagagggagtcagtgggagccagccagatgggacactactctccccacgccaagcccgaaggagcagccccccatgccccaggatctgatggacgtctctgtaagcaacctcccatccctgtggcagcccagtccccggaagtcctcctgttcatcctgttcacagagtggctcggctgatggtagctcgaccaatggctgcaaccatgagagggctcccctgaaacttctctgtgacaatatgaagtaccagatcctctccagagccttctatggatggctggcctactgcagacacctgtccaccgtgagaacccacctatcagccctggtcaatcacatgatcgtgtctccagacttgccctgcgatgctggacagggactgacagccaggatctgggagcagtaccttcacgacagcacaagttacgaggagcaggagctgctgcgcctcatctactacgggggcatccagcctgagatccgcaaggccgtgtggcccttcctcctgggccactaccagttcgggatgacggaaacagaaaggaaagaggtggacgagcagattcatgcctgctatgcacagaccatggctgagtggctgggctgcgaggcgatcgtgcggcagagggagcgggagtcccatgcggccgccctggccaaatgctcatccggggccagcttggacagccacctgcaccggatgttgcacagggactcaaccatcagcaatgagtcctcccagagctgcagttcgggccgccagaacatccgcctgcacagcgactccagcagcagcacacaggtgtttgagtctgtggatgaggtggagcaggtggaggctgaaggcagattggaggagaaacagcccaagatccccaatgggaacctagtgaacggcacttgttccccagactcgggtcatccttcctcccataacttctcctcgggcctctcagagcactcagagcccagtctgagcacagaagacagtgtcttggacgcccagcggaacacccccacggtgctgcgacctagggatggcagcgtggatgacaggcagagcagcgaggccaccacatctcaggatgaggctccccgggaggagctggccgtgcaggacagcctggagagtgacctcctggccaacgagagcatggacgagttcatgtccatcacgggcagcctggacatggccctgcctgaaaaggacgatgttgtgatggagggctggaggagcagcgagacagagaaacatggccaggcggacagtgaggacaacctctcggaggagcctgagatggaaagtctcttccctgccctggcttctctggctgtgactacttctgccaacgaggtgtcccctgtgtcttccagcggcgtcacctactctccagagctgctggatctgtacacggtgaacctgcaccgcatcgagaaggatgtgcagaggtgcgaccgcaactactggtacttcacgcccgccaacttggagaagctgcgtaacatcatgtgcagctacatctggcagcacattgagatcggctatgtccagggcatgtgtgatcttctggctccactgctggtcattctggatgatgaggcccttgccttcagctgcttcacggagctcatgaagaggatgaaccagaacttcccccacggaggcgccatggacacgcactttgcaaacatgagatcgttgatccagatcctggactcagagctgtttgagctgatgcatcagaacggggactatactcacttctacttctgctaccgctggttcctgctggatttcaagcgagaactcgtctatgatgacgtcttcttggtctgggagaccatctgggcagccaaacacgtctcctctgcgcactacgtcctgttcattgcgctggctctggtggaagtctaccgtgacatcattttggagaacaacatggatttcacagacatcatcaaattctttaatgaaatggctgagcgacacaacaccaagcaagtcctgaagctggcgcgggacctcgtgtacaaggtgcagactctgattgagaacaagtgaggggcacctcaccccggcagcctcagccaagctgcccctgccccgctcctctgcttacttttcctcctggctggatgggcaccccgggagcggggtcctggtgtctgttcacaagcgtggagttcagtgcgcaaagaaactaccctgacttttacttctgggcagatggggtggagggagtaccccttcaattcagccttacattttcctgtttgaccaaagattgcccaagtctggcgttcctcccttgcaggaggtggaggttgttggtggaggaggagccatctttgtttgctggtgcccggaatggtctcctcttcttctttccctatccctccaaactgtcttgtaagatgagacctggggaggaaacttctttttggaaattggtgtagaagaggtgtgtggggctacctctatgctcctctgcaaggggcctttggcgatgttctggacatggctgaagattgacttagagattgaccctccacctcgacattactgacatttggggccaggtgattctttttgaggggactgtcccctgcattgtaggatgctgagcagcatcccgggcctcaccagatgccagtagtgccatcccccaaccatacccctggttgtgacagcccccaaaaatgtctctagacattgcgaaatgttccctgcagggcaaaattgcccccatttgagaaccactggcttggagaagggactacaaatgtacttcctcccccattcttttgacgctaagccaccctggtcctgacgcctcccctcacttagaaaaggcatacaggaggccgggcatggtggctcacacctgtaatcccagcactttgggaggctaaggtgggcggatc

SEQ ID NO: 182234 - DNA, 5991 bp, Homo sapiens
  Payload ID: 15880
  Gene Symbol: SGSM1
  Gene Name: small G protein signaling modulator 1
  ENST ID: ENST00000610372
  CDS Start-End: 158-3421
gcggccgcctcgggtcctgacgtcgggcgccctccggccgtcactcagcgctcggccccgccccgccgcggctgcagcagcagcgccgcggccggaggagctaccgccgccaccgccgccaccgcctcctgggactcggaacgcagcgctcggagccatggcctcggcccccgcggaggcggagacccgacagaggctgctacgcaccgtcaagaaggaggtgaagcagatcatggaggaggctgtgacacgcaagtttgtccacgaagacagcagccacatcatctccttctgtgcggctgtggaggcctgcgttctgcacgggcttcggcggcgggcggctggcttcctacgcagcaataagattgcagccctctttatgaaagtgggcaagaacttcccgccggctgaggatctgagccgcaaggtgcaagacctggagcagctgatcgagagcgcgagaaaccagattcaaggcctccaggagaatgtgcggaagctgccgaagctgcccaacttgtccccacttgccatcaagcatctgtggattcgcacagccttgtttgagaaggtcctggacaaaattgtgcattaccttgtggaaaacagcagtaaatactatgagaaggaagctctcctgatggaccctgtggacggccccatccttgcatctttgttggtggggccctgtgccctagagtacaccaagatgaagactgcagatcacttctggaccgatccctcggctgacgaacttgtccagaggcaccgcatccacagctcccacgtgcggcaggactcgcccaccaagcgtcctgccctctgtatccagaagaggcattccagtggcagcatggatgaccggccatccctctctgcccgcgactacgtggagtccctgcatcagaactcccgtgccacccttctctatggcaaaaacaacgttcttgttcagccgagggacgacatggaggctgtgccagggtacctgtccctgcaccagacggctgacgtcatgaccttgaagtggacacccaaccagctgatgaacgggtctgtgggggacctggactatgagaagagcgtctactgggactatgccatgaccatccgcttggaggagattgtctacctgcactgccaccagcaagttgacagcggcgggacagtggtattggtcagccaggacgggatccagaggccgcccttccgcttccccaagggcgggcacctcctgcagttcctctcgtgcctggagaatgggctgctcccacatgggcagttggacccgccactgtggtcccagaggggtaagggcaaagtgtttcctaaactgcgcaagcgaagccctcagggttctgccgagtccacatcttcagacaaagatgatgatgaggccacggattatgtgttcaggatcatctaccctggcatgcagtcggaattcgttgcccccgacttcttgggcagcacttcctccgtctctgtgggccctgcctggatgatggttcctgcaggccggtccatgctggtggtggccagagggagtcagtgggagccagccagatgggacactactctccccacgccaagcccgaaggagcagccccccatgccccaggatctgatggacgtctctgtaagcaacctcccatccctgtggcagcccagtccccggaagtcctcctgttcatcctgttcacagagtggctcggctgatggtagctcgaccaatggctgcaaccatgagagggctcccctgaaacttctctgtgacaatatgaagtaccagatcctctccagagccttctatggatggctggcctactgcagacacctgtccaccgtgagaacccacctatcagccctggtcaatcacatgatcgtgtctccagacttgccctgcgatgctggacagggactgacagccaggatctgggagcagtaccttcacgacagcacaagttacgaggagcaggagctgctgcgcctcatctactacgggggcatccagcctgagatccgcaaggccgtgtggcccttcctcctgggccactaccagttcgggatgacggaaacagaaaggaaagagtcctcccagagctgcagttcgggccgccagaacatccgcctgcacagcgactccagcagcagcacacaggtgtttgagtctgtggatgaggtggagcaggtggaggctgaaggcagattggaggagaaacagcccaagatccccaatgggaacctagtgaacggcacttgttccccagactcgggtcatccttcctcccataacttctcctcgggcctctcagagcactcagagcccagtctgagcacagaagacagtgtcttggacgcccagcggaacacccccacggtgctgcgacctagggatggcagcgtggatgacaggcagagcagcgaggccaccacatctcaggatgaggctccccgggaggagctggccgtgcaggacagcctggagagtgacctcctggccaacgagagcatggacgagttcatgtccatcacgggcagcctggacatggccctgcctgaaaaggacgatgttgtgatggagggctggaggagcagcgagacagagaaacatggccaggcggacagtgaggacaacctctcggaggagcctgagatggaaagtctcttccctgccctggcttctctggctgtgactacttctgccaacgaggtgtcccctgtgtcttccagcggcgtcacctactctccagagctgctggatctgtacacggtgaacctgcaccgcatcgagaaggatgtgcagaggtgcgaccgcaactactggtacttcacgcccgccaacttggagaagctgcgtaacatcatgtgcagctacatctggcagcacattgagatcggctatgtccagggcatgtgtgatcttctggctccactgctggtcattctggatgatgaggcccttgccttcagctgcttcacggagctcatgaagaggatgaaccagaacttcccccacggaggcgccatggacacgcactttgcaaacatgagatcgttgatccagatcctggactcagagctgtttgagctgatgcatcagaacggggactatactcacttctacttctgctaccgctggttcctgctggatttcaagcgagaactcgtctatgatgacgtcttcttggtctgggagaccatctgggcagccaaacacgtctcctctgcgcactacgtcctgttcattgcgctggctctggtggaagtctaccgtgacatcattttggagaacaacatggatttcacagacatcatcaaattctttaatgaaatggctgagcgacacaacaccaagcaagtcctgaagctggcgcgggacctcgtgtacaaggtgcagactctgattgagaacaagtgaggggcacctcaccccggcagcctcagccaagctgcccctgccccgctcctctgcttacttttcctcctggctggatgggcaccccgggagcggggtcctggtgtctgttcacaagcgtggagttcagtgcgcaaagaaactaccctgacttttacttctgggcagatggggtggagggagtaccccttcaattcagccttacattttcctgtttgaccaaagattgcccaagtctggcgttcctcccttgcaggaggtggaggttgttggtggaggaggagccatctttgtttgctggtgcccggaatggtctcctcttcttctttccctatccctccaaactgtcttgtaagatgagacctggggaggaaacttctttttggaaattggtgtagaagaggtgtgtggggctacctctatgctcctctgcaaggggcctttggcgatgttctggacatggctgaagattgacttagagattgaccctccacctcgacattactgacatttggggccaggtgattctttttgaggggactgtcccctgcattgtaggatgctgagcagcatcccgggcctcaccagatgccagtagtgccatcccccaaccatacccctggttgtgacagcccccaaaaatgtctctagacattgcgaaatgttccctgcagggcaaaattgcccccatttgagaaccactggcttggagaagggactacaaatgtacttcctcccccattcttttgacgctaagccaccctggtcctgacgcctcccctcacttagaaaaggcatacaggaggccgggcatggtggctcacacctgtaatcccagcactttgggaggctaaggtgggcggatcacaaggtcaggagttttgagaccagcctggccaacatggtgaaaccccatctctactaaaaatacaaaaattagctgggtgtggtggcgggtgcctgtaatcccagctacttgggaggctgaggcaggagaatcacttgaacctgggaggtggaggttgcagtgagttgagatcacgccactgcactccagcccgggcgacagttcaagactccatctcaaaaaaaaaaagaaaaggcacacaagagtccctcacacatctctcttggagtctgggattccatctgttgtattttctccttttttctcctctgtctgatgccagaagatacttgttttcttcttttcaagaaaagtatctccccacataggcggtggacccaaaaagtgtaggcatgagacggtcagagctctttggggtcctgctcagagtcccccaggcagggcagagtctgtatcctgctgccatcttgcaagggaaaaccgcctctccttccaagtattgggtcttggaaaggtgtgtgtttggtgaaagccacttaatggtggtggggtgcagcttttctctaagtgcagttactcactcaggacaaaggaggaaaaggaaggcagaggtcagccagggtagagggtgatgtctgttttccttgggaaacatctgctgatgaactgggtccagggccgtgctaggtctgggaacaatcctctccaggtcttcacacagagtatcaccaatccacaaacagacccgaagtgaactagtttactctgcctacctgtcctttcaatagagcagtctttcccgctcttctgttctgagaatgcacccggaatgggggaaacccagcaagcagcagagagaaaggctcttcccgggagacctgccgcctctagggtggtcagagaatagcagctgggattttggagagggagaggataggtaaagcagcgtattgaagcatttgcggaggggtgtattagtcctcccaccctgagcacaccaggacggggatgcatccttgccttgtgtgcttgtaaaggcttctttcccttggtatagcaacttcaactgcacctgaacctccaacctctgcccagcctctggtgcagggtggatagaggtctagccagcccttacttcctgaagagagctctgtgggaaactcgaggctacagtagcttcccggctcccagctcctaccctacccccaccaaagcagaaacgggagacggcaacgttctggctgccattagacttacgtctccctcccctacgtcccctagcttcccaagacaggaagaaatgtgcaaaaggcccctccggagaaaactattttgccgttcagctgttctttacagaggatgttattttagtgagacccaggtcctagaccttctgattcctatttatttttttaacagactagtctcaaagtacagcacaaaatctcttctctgccttctcttgtgatgttccagagagcatctgtggttgtgatttggaataagtcatatttatttggtttactgtgcctattcagatctctgtatgttgtgtgtgtttctgtgtcctggaattggatgcgtgggactcgttctgtccgcggagtgcactctttttttcagtgtggcccacatatcttgtaaatgtttgctgaagagttgtgtctatatatagagaaaatatatataaacagagaaatatgtg

SEQ ID NO: 182235 - DNA, 4863 bp, Homo sapiens
  Payload ID: 15881
  Gene Symbol: SGSM2
  Gene Name: small G protein signaling modulator 2
  Uniprot ID: O43147
  ENST ID: ENST00000268989
  CDS Start-End: 178-3333
ggaagatggctgcggagccgagcaccgggcagtggctgcggcggcggcggcggcggcgggccgggagcgcggcgggcgggggctccgccttgcgcgtggggcgctgagccgagaggcgcggaggcggcgagggcgcgggggctctgaggaccgctcggcgccgcctcctgccacaccatgggcagcgcagaggacgcagtcaaagagaaactgctgtggaacgtgaagaaggaggtgaagcaaatcatggaggaggctgtcaccaggaagtttgtgcatgaagacagcagccacatcattgctttatgtggtgcagtggaggcttgcctcttgcatcagctgagacgccgtgccgctggcttcctgcgcagtgacaagatggcagccctgttcaccaaggtggggaagacgtgcccagtggcgggggagatttgccacaaggtacaggagctgcagcaacaagcagagggcaggaaaccctcaggggtcagccaggaggccctgcggagacagggctcagccagcgggaaggccccggccctcagccctcaggccttgaaacacgtatgggtacgcacggcgctcatcgagaaagttctggacaaggtcgtgcaatacctggcggaaaactgcagcaagtactacgagaaggaggcactgctggcagaccctgtgttcggcccgatcctggcctctcttctagtgggaccctgtgccttggaatacactaagctcaagacagccgatcactactggactgacccctctgctgatgagctggtccagcggcaccgcatccggggtccacctactcgccaggactcccctgcaaagcgcccagccctggggatccggaaacggcactcaagcggcagcgcgtcggaggacaggctggctgcctgtgcccgcgagtgtgtggagtccctgcaccagaactcacggacgcggctgctctatggcaagaaccacgtgctggtgcagccgaaggaggatatggaggcggtccctggctacctctccctgcaccagtctgcagagagcctgactctgaagtggacccccaaccagctcatgaatgggactctgggggactccgagctggaaaagagcgtttactgggactatgccctcgtggtgcccttcagccaggtcgtgtgcatccactgccaccagcaaaagagcggtggcacgcttgtgctggtgagccaggatggcatccagaggccgccgctgcatttcccacagggaggacacctgctgtcctttctgtcctgtctggagaatgggctgctgcctcggggacagctagagcccccgctgtggacccagcaagggaaggggaaagtgttccccaagctacggaaacgaagcagcattcgctccgtggatatggaggagatgggcacggggcgggccaccgactatgtgttccggatcatctaccccggccacaggcacgagcacatcactattaactaccaccacctagcggccagccgcgcggcctcggtggacgatgatgaggaagaggaggataaactgcacgcgatgctctcaatgatctgctcgcggaacctcacagctcccaatccgatgaaagacgctggtgacatgatcgagatgcagggctttgggcccagcctgccagcctggcacctggagcccctgtgcagtcagggctcctcctgcctctcctgctcctccagcagctccccacatgcaacccccagccactgtagctgcatccccgaccggttgccgctcaggctactgtgtgagagtatgaagaggcagatcgtgtcccgggccttctacggctggctggcacactgccgccacctgtccacggtgcggacccacctgtcggcgctggtgcaccatagcgttatcccacctgaccggcccccgggggcctccgcgggcctcaccaaggacgtgtggagcaagtatcagaaggacaaaaagaactacaaagagctggagctgctgcggcaagtttactacggaggcatagagcacgagatccgcaaggacgtctggccctttctgcttggccactacaagttcggcatgagcaagaaggagatggagcaggtggacgcagtggtggcagcaaggtaccagcaggtgttggcagagtggaaggcctgcgaggtggtggtgaggcagcgggagcgggaggcccacccagccacacgcaccaagttctcctcaggcagcagcatcgacagccacgtgcagcgcctcatccaccgagactccaccatcagcaacgatgtgtttatctcagtggatgatctggaacccccggagccccaggaccctgaagattccagaccaaaacctgagcaggaagcaggacccgggactccgggcaccgccgtggtggagcagcagcattccgtggagttcgactctccagactcaggactgccctcctctcgcaattactccgtggcctcgggcatccagtcaagcctagatgaggggcagagcgtgggcttcgaagaggaggacggcggtggggaggaaggctccagtgggcccggccctgcagctcacactttgagggagccccaggatcccagccaggagaagcctcaggccggagaactggaggccggagaggagcttgcggctgtgtgtgcggctgcctacactatagaattactggacactgtggccttaaacctgcaccgcatagacaaggatgtgcagaggtgtgaccgcaactactggtacttcacgccccccaacctcgagaggctcagagacgtcatgtgcagctacgtgtgggagcacctggacgtgggctatgtgcagggcatgtgcgatctgctggcgcctctcctggtcaccctcgacaatgatcagctggcctacagctgcttcagccacctcatgaagaggatgagccagaacttccccaacgggggtgccatggacacccactttgccaacatgcgctccctcatccagatcctggactcagagctgtttgagctgatgcatcagaatggagactacacccacttctacttctgttatcgctggttcctgctggattttaagagagaactgctgtatgaggatgtgtttgctgtgtgggaggtgatctgggcagccaggcacatctcatcggagcactttgtcctgttcatcgccctcgccctggtggaggcctaccgagagatcatccgtgacaacaacatggacttcactgacatcatcaagtttttcaatgaacgtgctgagcatcacgatgcccaggagatcctgcggattgcccgggacctcgtccacaaggtgcagatgctcatagagaacaagtgagctggggccaggaggcagcagccgtgcagagcctgggctccggcagggagaggtgcaggggagtcaccgcccagacctccccagccaccaaccgaccccacctctgttcctaacaaagcggttgtgagcctggatccgactcccggcagtgctgaccctgcagggcaagtcaggggccaggatgccctcggatcagggccgggatgggaggggtcagcctcagggagcagctgccttgggggacacacctactctgctcccctctcacacatctgggagtagccccactgccacctgcagccgcagcctggactgctgcccacgagtgaacctggggccccacaggattaacaggggctatagcggcctgggccctactcagctggggtggcagagggcgagaggctctgtgctgtgtcccttctgagggtccctttgcagtcccagtatattgtgcgtgcaccagccccagctggagcaaccaaaactgcttctggtttaggcacacgtcacgggtgcgggagacccgggcacgggagacccgggccgccttcaggccgctcccccgagattctggggcagtcggaagatgtgggccctgggtgggagcagcccacttcagcagcactgccactgcctttggccacctgaggtgacccccaggcctccccggccttgtacagtgtacctctgtgtatctgtacagcctcgctcctgccaccccacccttgcgttctgcattaggtacttccctgaaaaccacgtgtaagaagtgatgcttttgccagtggatgatctggaatgcgaccggagcacttgctctgaggaatcccagggtgactctgtcggggaagaatccggtcacagcctcccctcagagacaggcctcagttcgagggcagcccattatctgtcgcagacatctgccatgtccctgagactgcgggaggcaggggatgcatgggtgtccccatctgtccctggtgagaagcaaggctagctctgccttccacatgcttctcaggatgccaagaggcctaggaacccagaaacccccttggaggagctgtgtatgcgggggtgccaggaagggcatagctcctgcccccaggcctaggcatgctgcttgctcggccatccccacttcctcctctaccccaacacatgcaggctaggccttgccctggaacatggaggccctgcccggggctggggcctagtccagcagccaccaaagtctggcagactttctgcatttgagaaacatgacaaagggccccgcagcccttctgcacccagcacagcctgcccagcccagccctgcccccgggcactgcacagcctgtctgggggccagaccaccccattgtccatccttgttgtccgtgagtccttggcctccaccaagcacgtgtggccattgtgtgcctgccttagtgactccgtggttttgtgaggagcagagtgtgtatgatttttgcctcagaaactatactcttctgtgtaacagaccaataaacaacatttgtc

SEQ ID NO: 182236 - DNA, 4734 bp, Homo sapiens
  Payload ID: 15881
  Gene Symbol: SGSM2
  Gene Name: small G protein signaling modulator 2
  Uniprot ID: O43147
  ENST ID: ENST00000426855
  CDS Start-End: 176-3196
aagatggctgcggagccgagcaccgggcagtggctgcggcggcggcggcggcggcgggccgggagcgcggcgggcgggggctccgccttgcgcgtggggcgctgagccgagaggcgcggaggcggcgagggcgcgggggctctgaggaccgctcggcgccgcctcctgccacaccatgggcagcgcagaggacgcagtcaaagagaaactgctgtggaacgtgaagaaggaggtgaagcaaatcatggaggaggctgtcaccaggaagtttgtgcatgaagacagcagccacatcattgctttatgtggtgcagtggaggcttgcctcttgcatcagctgagacgccgtgccgctggcttcctgcgcagtgacaagatggcagccctgttcaccaaggtggggaagacgtgcccagtggcgggggagatttgccacaaggtacaggagctgcagcaacaagcagagggcaggaaaccctcaggggtcagccaggaggccctgcggagacagggctcagccagcgggaaggccccggccctcagccctcaggccttgaaacacgtatgggtacgcacggcgctcatcgagaaagttctggacaaggtcgtgcaatacctggcggaaaactgcagcaagtactacgagaaggaggcactgctggcagaccctgtgttcggcccgatcctggcctctcttctagtgggaccctgtgccttggaatacactaagctcaagacagccgatcactactggactgacccctctgctgatgagctggtccagcggcaccgcatccggggtccacctactcgccaggactcccctgcaaagcgcccagccctggggatccggaaacggcactcaagcggcagcgcgtcggaggacaggctggctgcctgtgcccgcgagtgtgtggagtccctgcaccagaactcacggacgcggctgctctatggcaagaaccacgtgctggtgcagccgaaggaggatatggaggcggtccctggctacctctccctgcaccagtctgcagagagcctgactctgaagtggacccccaaccagctcatgaatgggactctgggggactccgagctggaaaagagcgtttactgggactatgccctcgtggtgcccttcagccaggtcgtgtgcatccactgccaccagcaaaagagcggtggcacgcttgtgctggtgagccaggatggcatccagaggccgccgctgcatttcccacagggaggacacctgctgtcctttctgtcctgtctggagaatgggctgctgcctcggggacagctagagcccccgctgtggacccagcaagggaaggggaaagtgttccccaagctacggaaacgaagcagcattcgctccgtggatatggaggagatgggcacggggcgggccaccgactatgtgttccggatcatctaccccggccacaggcacgagcacaacgctggtgacatgatcgagatgcagggctttgggcccagcctgccagcctggcacctggagcccctgtgcagtcagggctcctcctgcctctcctgctcctccagcagctccccacatgcaacccccagccactgtagctgcatccccgaccggttgccgctcaggctactgtgtgagagtatgaagaggcagatcgtgtcccgggccttctacggctggctggcacactgccgccacctgtccacggtgcggacccacctgtcggcgctggtgcaccatagcgttatcccacctgaccggcccccgggggcctccgcgggcctcaccaaggacgtgtggagcaagtatcagaaggacaaaaagaactacaaagagctggagctgctgcggcaagtttactacggaggcatagagcacgagatccgcaaggacgtctggccctttctgcttggccactacaagttcggcatgagcaagaaggagatggagcaggtggacgcagtggtggcagcaaggtaccagcaggtgttggcagagtggaaggcctgcgaggtggtggtgaggcagcgggagcgggaggcccacccagccacacgcaccaagttctcctcaggcagcagcatcgacagccacgtgcagcgcctcatccaccgagactccaccatcagcaacgatgtgtttatctcagtggatgatctggaacccccggagccccaggaccctgaagattccagaccaaaacctgagcaggaagcaggacccgggactccgggcaccgccgtggtggagcagcagcattccgtggagttcgactctccagactcaggactgccctcctctcgcaattactccgtggcctcgggcatccagtcaagcctagatgaggggcagagcgtgggcttcgaagaggaggacggcggtggggaggaaggctccagtgggcccggccctgcagctcacactttgagggagccccaggatcccagccaggagaagcctcaggccggagaactggaggccggagaggagcttgcggctgtgtgtgcggctgcctacactatagaattactggacactgtggccttaaacctgcaccgcatagacaaggatgtgcagaggtgtgaccgcaactactggtacttcacgccccccaacctcgagaggctcagagacgtcatgtgcagctacgtgtgggagcacctggacgtgggctatgtgcagggcatgtgcgatctgctggcgcctctcctggtcaccctcgacaatgatcagctggcctacagctgcttcagccacctcatgaagaggatgagccagaacttccccaacgggggtgccatggacacccactttgccaacatgcgctccctcatccagatcctggactcagagctgtttgagctgatgcatcagaatggagactacacccacttctacttctgttatcgctggttcctgctggattttaagagagaactgctgtatgaggatgtgtttgctgtgtgggaggtgatctgggcagccaggcacatctcatcggagcactttgtcctgttcatcgccctcgccctggtggaggcctaccgagagatcatccgtgacaacaacatggacttcactgacatcatcaagtttttcaatgaacgtgctgagcatcacgatgcccaggagatcctgcggattgcccgggacctcgtccacaaggtgcagatgctcatagagaacaagtgagctggggccaggaggcagcagccgtgcagagcctgggctccggcagggagaggtgcaggggagtcaccgcccagacctccccagccaccaaccgaccccacctctgttcctaacaaagcggttgtgagcctggatccgactcccggcagtgctgaccctgcagggcaagtcaggggccaggatgccctcggatcagggccgggatgggaggggtcagcctcagggagcagctgccttgggggacacacctactctgctcccctctcacacatctgggagtagccccactgccacctgcagccgcagcctggactgctgcccacgagtgaacctggggccccacaggattaacaggggctatagcggcctgggccctactcagctggggtggcagagggcgagaggctctgtgctgtgtcccttctgagggtccctttgcagtcccagtatattgtgcgtgcaccagccccagctggagcaaccaaaactgcttctggtttaggcacacgtcacgggtgcgggagacccgggcacgggagacccgggccgccttcaggccgctcccccgagattctggggcagtcggaagatgtgggccctgggtgggagcagcccacttcagcagcactgccactgcctttggccacctgaggtgacccccaggcctccccggccttgtacagtgtacctctgtgtatctgtacagcctcgctcctgccaccccacccttgcgttctgcattaggtacttccctgaaaaccacgtgtaagaagtgatgcttttgccagtggatgatctggaatgcgaccggagcacttgctctgaggaatcccagggtgactctgtcggggaagaatccggtcacagcctcccctcagagacaggcctcagttcgagggcagcccattatctgtcgcagacatctgccatgtccctgagactgcgggaggcaggggatgcatgggtgtccccatctgtccctggtgagaagcaaggctagctctgccttccacatgcttctcaggatgccaagaggcctaggaacccagaaacccccttggaggagctgtgtatgcgggggtgccaggaagggcatagctcctgcccccaggcctaggcatgctgcttgctcggccatccccacttcctcctctaccccaacacatgcaggctaggccttgccctggaacatggaggccctgcccggggctggggcctagtccagcagccaccaaagtctggcagactttctgcatttgagaaacatgacaaagggccccgcagcccttctgcacccagcacagcctgcccagcccagccctgcccccgggcactgcacagcctgtctgggggccagaccaccccattgtccatccttgttgtccgtgagtccttggcctccaccaagcacgtgtggccattgtgtgcctgccttagtgactccgtggttttgtgaggagcagagtgtgtatgatttttgcctcagaaactatactcttctgtgtaacagaccaataaacaacatttgtcaacactgg

SEQ ID NO: 182237 - DNA, 3410 bp, Homo sapiens
  Payload ID: 15881
  Gene Symbol: SGSM2
  Gene Name: small G protein signaling modulator 2
  Uniprot ID: O43147
  ENST ID: ENST00000574563
  CDS Start-End: 68-3031
gagaggcgcggaggcggcgagggcgcgggggctctgaggaccgctcggcgccgcctcctgccacaccatgggcagcgcagaggacgcagtcaaagagaaactgctgtggaacgtgaagaaggaggtgaagcaaatcatggaggaggctgtcaccaggaagtttgtgcatgaagacagcagccacatcattgctttatgtggtgcagtggaggcttgcctcttgcatcagctgagacgccgtgccgctggcttcctgcgcagtgacaagatggcagccctgttcaccaaggtggggaagacgtgcccagtggcgggggagatttgccacaaggtacaggagctgcagcaacaagcagagggcaggaaaccctcaggggtcagccaggaggccctgcggagacagggctcagccagcgggaaggccccggccctcagccctcaggccttgaaacacgtatgggtacgcacggcgctcatcgagaaagttctggacaaggtcgtgcaatacctggcggaaaactgcagcaagtactacgagaaggaggcactgctggcagaccctgtgttcggcccgatcctggcctctcttctagtgggaccctgtgccttggaatacactaagctcaagacagccgatcactactggactgacccctctgctgatgagctggtccagcggcaccgcatccggggtccacctactcgccaggactcccctgcaaagcgcccagccctggggatccggaaacggcactcaagcggcagcgcgtcggaggacaggctggctgcctgtgcccgcgagtgtgtggagtccctgcaccagaactcacggacgcggctgctctatggcaagaaccacgtgctggtgcagccgaaggaggatatggaggcggtccctggctacctctccctgcaccagtctgcagagagcctgactctgaagtggacccccaaccagctcatgaatgggactctgggggactccgagctggaaaagagcgtttactgggactatgccctcgtggtgcccttcagccaggtcgtgtgcatccactgccaccagcaaaagagcggtggcacgcttgtgctggtgagccaggatggcatccagaggccgccgctgcatttcccacagggaggacacctgctgtcctttctgtcctgtctggagaatgggctgctgcctcggggacagctagagcccccgctgtggacccagcaagggaaggggaaagtgttccccaagctacggaaacgaagcagcattcgctccgtggatatggaggagatgggcacggggcgggccaccgactatgtgttccggatcatctaccccggccacaggcacgagcacaacgctggtgacatgatcgagatgcagggctttgggcccagcctgccagcctggcacctggagcccctgtgcagtcagggctcctcctgcctctcctgctcctccagcagctccccacatgcaacccccagccactgtagctgcatccccgaccggttgccgctcaggctactgtgtgagagtatgaagaggcagatcgtgtcccgggccttctacggctggctggcacactgccgccacctgtccacggtgcggacccacctgtcggcgctggtgcaccatagcgttatcccacctgaccggcccccgggggcctccgcgggcctcaccaaggacgtgtggagcaagtatcagaaggacaaaaagaactacaaagagctggagctgctgcggcaagtttactacggaggcatagagcacgagatccgcaaggacgtctggccctttctgcttggccactacaagttcggcatgagcaagaaggagatggagcaggtggacgcagtggtggcagcaaggtaccagcaggtgttggcagagtggaaggcctgcgaggtggtggtgaggcagcgggagcgggaggcccacccagccacacgcaccaagttctcctcaggcagcagcatcgacagccacgtgcagcgcctcatccaccgagactccaccatcagcaacgatgtgtttatctcagtggatgatctggaacccccggagccccaggaccctgaagattccagaccaaaacctgagcaggaagcaggacccgggactccgggcaccgccgtggtggagcagcagcattccgtggagttcgactctccagactcaggactgccctcctctcgcaattactccgtggcctcgggcatccagtcaagcctagatgaggggcagagcgtgggcttcgaagaggaggacggcggtggggaggaaggctccagtgggcccggccctgcagctcacactttgagggagccccaggatcccagccaggagaagcctcaggccggagaactggaggccggagaggagcttgcggctgtgtgtgcggctgcctacactatagaattactggacactgtggccttaaacctgcaccgcatagacaaggatgtgcagaggtgtgaccgcaactactggtacttcacgccccccaacctcgagaggctcagagacgtcatgtgcagctacgtgtgggagcacctggacgtgggctatgtgcagggcatgtgcgatctgctggcgcctctcctggtcaccctcgacaatgatcagctggcctacagctgcttcagccacctcatgaagaggatgagccagaacttccccaacgggggtgccatggacacccactttgccaacatgcgctccctcatccagatcctggactcagagctgtttgagctgatgcatcagaatggagactacacccacttctacttctgttatcgctggttcctgctggattttaagagagaactgctgtatgaggatgtgtttgctgtgtgggaggtgatctgggcagccaggcacatctcatcggagcactttgtcctgttcatcgccctcgccctggtggaggcctaccgagagatcatccgtgacaacaacatggacttcactgacatcatcaagtttttcaatggtacttccctgaaaaccacgtgtaagaagtgatgcttttgccagtggatgatctggaatgcgaccggagcacttgctctgaggaatcccagggtgactctgtcggggaagaatccggtcacagcctcccctcagagacaggcctcagttcgagggcagcccattatctgtcgcagacatctgccatgtccctgagactgcgggaggcaggggatgcatgggtgtccccatctgtccctggtgagaagcaaggctagctctgccttccacatgcttctcaggatgccaagaggcctaggaacccagaaacccccttggaggagctgtgtatgcgggggtgccaggaagggcatagctcctgcccccaggcctaggcatgctgcttgctcggccatccccacttcctcctcta

SEQ ID NO: 182238 - DNA, 460 bp, Homo sapiens
  Payload ID: 15881
  Gene Symbol: SGSM2
  Gene Name: small G protein signaling modulator 2
  ENST ID: ENST00000572875
  CDS Start-End: 192-281
tctgtgcggggctcggaagatggctgcggagccgagcaccgggcagtggctgcggcggcggcggcggcggcgggccgggagcgcggcgggcgggggctccgccttgcgcgtggggcgctgagccgagaggcgcggaggcggcgagggcgcgggggctctgaggaccgctcggcgccgcctcctgccacaccatgggcagcgcagaggacgcagtcaaagagaaactgctgtggaacgtgaagaaggaggtgcagtggaggcttgcctcttgcatcagctgagacgccgtgccgctggcttcctgcgcagtgacaagatggcagccctgttcaccaaggtggggaagacgtgcccagtggcgggggagatttgccacaaggtacaggagctgcagcaacaagcagagggcaggaaaccctcaggggtcagccaggaggccctgcggagacagggctcagcc

SEQ ID NO: 182239 - DNA, 392 bp, Homo sapiens
  Payload ID: 15881
  Gene Symbol: SGSM2
  Gene Name: small G protein signaling modulator 2
  ENST ID: ENST00000570431
  CDS Start-End: 107-392
ggctgctctatggcaagaaccacgtgctggtgcagccggccatccctgagagcctctcagcccttcatcgtcggtcttccggtgtctcccgctgtagaaggaggatatggaggcggtccctggctacctctccctgcaccagtctgcagagagcctgactctgaagtggacccccaaccagctcatgaatgggactctgggggactccgagctggaaaagagcgtttactgggactatgccctcgtggtgcccttcagccaggtcgtgtgcatccactgccaccagcaaaagagcggtggcacgcttgtgctggtgagccaggatggcatccagaggccgccgctgcatttcccacagggaggacacctgctgtcctttctgtcctgtctgg

SEQ ID NO: 182240 - DNA, 644 bp, Homo sapiens
  Payload ID: 15881
  Gene Symbol: SGSM2
  Gene Name: small G protein signaling modulator 2
  ENST ID: ENST00000572925
  CDS Start-End: 1-110
acatggacttcactgacatcatcaagtttttcaatgaacgtgctgagcatcacgatgcccaggagatcctgcggattgcccgggacctcgtccacaaggtacttccctgaaaaccacgtgtaagaagtgatgcttttgccagtggatgatctggaatgcgaccggagcacttgctctgaggaatcccagggtgactctgtcggggaagaatccggtcacagcctcccctcagagacaggcctcagttcgagggcagcccattatctgtcgcagacatctgccatgtccctgagactgcgggaggcaggggatgcatgggtgtccccatctgtccctggtgagaagcaaggctagctctgccttccacatgcttctcaggatgccaagaggcctaggaacccagaaacccccttggaggagctgtgtatgcgggggtgccaggaagggcatagctcctgcccccaggcctaggcatgctgcttgctcggccatccccacttcctcctctaccccaacacatgcaggctaggccttgccctggaacatggaggccctgcccggggctggggcctagtccagcagccaccaaagtctggcagactttctgcatttgagaaacatgacaaagggccccgcagcccttc

SEQ ID NO: 182241 - DNA, 571 bp, Homo sapiens
  Payload ID: 15881
  Gene Symbol: SGSM2
  Gene Name: small G protein signaling modulator 2
  ENST ID: ENST00000573851
  CDS Start-End: 1-343
ctacttctgttatcgctggttcctgctggattttaagagagaactgctgtatgaggatgtgtttgctgtgtgggaggtgatctgggcagccaggcacatctcatcggagcactttgtcctgttcatcgccctcgccctggtggaggcctaccgagagatcatccgtgacaacaacatggacttcactgacatcatcaagtttttcaatggtacgagctggtccagccatccaggctgccctgagcagaggtgtggaggcccccacctctgccccgcacacagctggagggttctcaggaatcctgggggcccttccccaaaggccgggatgtcaagaatctagcagagcagatggaaacagagcagggtagtcagccacctcctagcctgctgccctttctctgggcctctctacagctcttcacgtttccccccagaacgtgctgagcatcacgatgcccaggagatcctgcggattgcccgggacctcgtccacaaggtgcagatgctcatagagaacaagtgagctggggccaggaggcagcagccgtgcagagcctgggctccggca

SEQ ID NO: 182242 - DNA, 242 bp, Homo sapiens
  Payload ID: 15881
  Gene Symbol: SGSM2
  Gene Name: small G protein signaling modulator 2
  ENST ID: ENST00000574650
  CDS Start-End: 1-213
ctgcagcaacaagcagagggcaggaaaccctcaggggtcagccaggaggccctgcggagacagggctcagccagcgggaaggccccggccctcagccctcaggccttgaaacacgtatgggtacgcacggcgctcatcgagaaagttctggacaaggtcgtgcaatacctggcggaaaactgcagtgggaccctgtgccttggaatacactaagctcaagacagccgatcactactggactg

SEQ ID NO: 182243 - DNA, 1335 bp, Homo sapiens
  Payload ID: 15881
  Gene Symbol: SGSM2
  Gene Name: small G protein signaling modulator 2
  ENST ID: ENST00000573062
  CDS Start-End: 184-1134
gggctcggaagatggctgcggagccgagcaccgggcagtggctgcggcggcggcggcggcggcgggccgggagcgcggcgggcgggggctccgccttgcgcgtggggcgctgagccgagaggcgcggaggcggcgagggcgcgggggctctgaggaccgctcggcgccgcctcctgccacaccatgggcagcgcagaggacgcagtcaaagagaaactgctgtggaacgtgaagaaggaggtgaagcaaatcatggaggaggctgtcaccaggaagtttgtgcatgaagacagcagccacatcattgctttatgtggtgcagtggaggcttgcctcttgcatcagctgagacgccgtgccgctggcttcctgcgcagtgacaagatggcagccctgttcaccaaggtggggaagacgtgcccagtggcgggggagatttgccacaaggtacaggagctgcagcaacaagcagagggcaggaaaccctcaggggtcagccaggaggccctgcggagacagggctcagccagcgggaaggccccggccctcagccctcaggccttgaaacacgtatgggtacgcacggcgctcatcgagaaagttctggacaaggtcgtgcaatacctggcggaaaactgcagcaagtactacgagaaggaggcactgctggcagaccctgtgttcggcccgatcctggcctctcttctaggtgagcctgagagcacaggcacagtgggtacggggcaggtgctgagggagcatcgtctgggctggctgtctctgtctccacagtgggaccctgtgccttggaatacactaagctcaagacagccgatcactactggactgacccctctgctgatgagctggtccagcggcaccgcatccggggtccacctactcgccaggactcccctgcaaagcgcccagccctggggatccggaaacggcactcaagcggcagcgcgtcggaggacaggctggctgcctgtgcccgcgagtgtgtggagtccctgcaccagaactcacggacgcggctgctctatggcaagaaccacgtgctggtgcagccgaaggaggatatggaggcggtccctggctacctctccctgcaccagtctgcagagagcctgactctgaagtggacccccaaccagctcatgaatgggactctgggggactccgagctggaaaagagcgtttactgggactatgccctcgtggtgcccttcagccaggtcgtgtgcatccactgccaccagcaaaagagcggtggcacgcttgtgctggtgagccaggatggcatccagaggccgccgctgcatttcccacagg

SEQ ID NO: 182244 - DNA, 2969 bp, Homo sapiens
  Payload ID: 15882
  Gene Symbol: SGSM3
  Gene Name: small G protein signaling modulator 3
  Uniprot ID: Q96HU1
  ENST ID: ENST00000248929
  CDS Start-End: 190-2439
ccgctgagcgctgactgggtgcgagtggggaagctgctaacccgacccggattggcgctgaggtggcccgtggggcagggcagatgattctggaccagatgaagcctgaggagccttccagctctaagatagcaggataggagacttctaagattggagctgcagaagacttgccagcccaccagcacaatgtcaggaagccatacacctgcctgtggccctttctcagccctgactccgagcatatggccccaggagatcttggccaagtacacgcagaaggaagagtcagcagagcaaccagagttctactacgatgagtttggtttccgtgtgtacaaggaagaaggtgatgagcctggctccagtctgctggcgaactcccctctgatggaggatgctccacagaggctgcggtggcaggcccacctggagttcacccataaccacgatgtgggggatctcacctgggacaagattgccgtctccctaccccgctctgagaagctccgctccctggtgctggccggcatcccacatggcatgaggccacagctgtggatgcggctctctggggccctgcagaagaagaggaactctgagctgtcctaccgcgagattgtgaagaacagctccaacgatgagaccatcgctgccaagcagatcgagaaggacctgctccgcaccatgcccagcaacgcctgcttcgccagcatgggtagcatcggggtgccccgcctgcgcagggtgctccgggccctggcctggctctacccagagatcggctactgccagggcaccggcatggtggccgcctgcctcctgctgttcctggaggaggaggacgccttctggatgatgtctgccatcatcgaggacctgctccccgcctcctacttcagcaccaccctgctgggtgtccagactgaccagcgggtcctgcgccacctcattgtccagtacctgcctcgcctggacaagctgctccaggagcatgacattgagctgtccctgatcacactgcactggttcctcacggccttcgccagcgtggtggacatcaagctgctcctgcgcatctgggacctgtttttctacgagggctcccgggtgctgttccagctcacgctgggcatgctgcacctcaaggaggaagagctgatccagtcagagaactcggcctccatcttcaacacgctatcggatatcccgtcgcagatggaggacgcggagctgcttctgggggtggccatgcggctggccggctccctcaccgatgtggccgtggagactcagcgccgcaagcacctggcctatctcattgcagaccagggccagctcctgggggccggcaccctcaccaacctctctcaggttgttcgccgcaggacccagcggaggaagtccaccatcactgctctgctcttcggggaggatgacctggaggcactcaaggccaagaacatcaagcagacggaactggtggctgacctccgggaagccatcctgcgcgtggcacgccacttccagtgcacagaccccaaaaactgcagcgtggagctgactccagactatagcatggagagccaccagcgggaccacgagaactacgtggcgtgctcacgcagccaccggcgccgagccaaggccctgctggactttgagcggcacgacgacgacgagctgggcttccgcaagaacgacatcatcacaatcgtgtctcagaaggacgagcactgctgggtgggggagctcaacggcctgcgaggctggtttccagccaagttcgtggaagtcctggatgagcgcagcaaagagtactccatcgcgggggatgactcggtgacggagggggtcacagacctcgtgcgagggaccctctgcccggcccttaaggccctgttcgaacatggactgaagaagccatccctgcttgggggcgcctgccacccctggctgtttatcgaggaggctgcaggccgggaggtcgagagagactttgcctccgtgtattcccgtctggtgctctgtaagaccttcaggttggatgaagatggcaaagtcctgaccccggaggagctgctctaccgggctgtgcagtctgtgaacgtgacccacgatgcagtgcatgcacaaatggatgtgaagctccgctcactgatctgcgtggggctcaatgagcaggtgctgcacctgtggctggaggtgctctgctccagcctgcccaccgtggagaagtggtaccagccctggtccttcctgcgcagcccgggctgggtccagatcaagtgtgagctccgagtcctctgctgctttgccttcagcctctcccaggactgggagctccctgcgaagagagaggcgcagcagcccctgaaggagggcgtccgggacatgctggtgaagcaccacctcttcagctgggatgtggacgggtgaccccctcctccccagcccaacctcgggcctgcgtctgaggtggcccaggaccccaagctgcagagcccagggaagagcagctccagagccctggccggggccgcgggatatcaatatcaggctgccccactccacgttccccagcacatcccaggtggtgggagcagagggtaccctgccccaccagggtccttagggatgctctaggccaaaccacagtttgtaccaaaaaccttgtgaggaggtgggggagccatgtctgtgctcaggaagagggaaggggatgggggtggctagtaggctcctggcctctttggtttataaataaactgtgtctgtctttgagaaagcacctacctgtcttctgtgcagctagggctgcagagctgtattcaggtccaaggttctgcccttccttgagtggtctagaaggcactgcgtggcccctcagatgctgggacacaacagacccgggacccagctgtgctacccaccccttccatggactgaataagatggactaacaggcc

SEQ ID NO: 182245 - DNA, 1086 bp, Homo sapiens
  Payload ID: 15882
  Gene Symbol: SGSM3
  Gene Name: small G protein signaling modulator 3
  ENST ID: ENST00000457767
  CDS Start-End: 328-1086
gccacgcgtgcgcttaggcgccgctgagcgctgactgggtgcgagtggggaagctgctaacccgacccggattggcgctgaggtggcccgtggggcagggcagatgattctggaccagatgaagcctgaggagccttccagctctaagatagcaggataggagacttctaagattggagctgcagaagacttgccagcccaccagcacaatgtcagaaggaagagtcagcagagcaaccagagttctactacgatgagtttggtttccgtgtgtacaaggaagaaggtgatgagcctggctccagtctgctggcgaactcccctctgatggaggatgctccacagaggctgcggtggcaggcccacctggagttcacccataaccacgatgtgggggatctcacctgggacaagattgccgtctccctaccccgctctgagaagctccgctccctggtgctggccggcatcccacatggcatgaggccacagctgtggatgcggctctctggggccctgcagaagaagaggaactctgagctgtcctaccgcgagattgtgaagaacagctccaacgatgagaccatcgctgccaagcagatcgagaaggacctgctccgcaccatgcccagcaacgcctgcttcgccagcatgggtagcatcggggtgccccgcctgcgcagggtgctccgggccctggcctggctctacccagagatcggctactgccagggcaccggcatggtggccgcctgcctcctgctgttcctggaggaggaggacgccttctggatgatgtctgccatcatcgaggacctgctccccgcctcctacttcagcaccaccctgctgggtgtccagactgaccagcgggtcctgcgccacctcattgtccagtacctgcctcgcctggacaagctgctccaggagcatgacattgagctgtccctgatcacactgcactggttcctcacggccttcgccagcgtggtggacatcaagctgctcctgcgcatctgggacctgtttttctacgagggctcccgggtgctgttccagctcacgctgggcatgctgcacctcaag

SEQ ID NO: 182246 - DNA, 793 bp, Homo sapiens
  Payload ID: 15882
  Gene Symbol: SGSM3
  Gene Name: small G protein signaling modulator 3
  ENST ID: ENST00000427834
  CDS Start-End: 1-639
gtcacagacctcgtgcgagggaccctctgcccggcccttaaggccctgttcgaacatggactgaagaagccatccctgcttgggggcgcctgccacccctggctgtttatcgaggaggctgcaggccgggaggtcgagagagactttgcctccgtgtattcccgtctggtgctctgtaagaccttcaggttggatgaagatggcaaagtcctgaccccggaggagctgctctaccgggctgtgcagtctgtgaacgtgacccacgatgcagtgcatgcacaaatggatgtgaagctccgctcactgatctgcgtggggctcaatgagcaggtgctgcacctgtggctggaggtgctctgctccagcctgcccaccgtggagaagtggtaccagccctggtccttcctgcgcagcccgggctgggtccagatcaagtgtgagctccgagtcctctgctgctttgccttcagcctctcccaggactgggagctccctgcgaagagagaggtgggtggtgtgggcctcgtagggcctgcactgatggagctgcccaaaccgttcgcggggtggctaaggtgggaacccgaagtgctggtgtcagcggttaggaactaccccagccatgcccaaggcctgtgaggtgaggggctgccctgtttgcaggcgcagcagcccctgaaggagggcgtccgggacatgctggtgaagcaccacctcttcagctgggatgtggacgggtgaccccctcctccccagcccaacctcgggcctgcgtctgaggtggcccaggacc

SEQ ID NO: 182247 - DNA, 666 bp, Homo sapiens
  Payload ID: 15882
  Gene Symbol: SGSM3
  Gene Name: small G protein signaling modulator 3
  ENST ID: ENST00000417424
  CDS Start-End: 1-307
gttggatgaagatggcaaagtcctgaccccggaggagctgctctaccgggctgtgcagtctgtgaacgtgacccacgatgcagtgcatgcacaaatggatgtgaagctccgctcactgatctgcgtggggctcaacccgggctgggtccagatcaagtgtgagctccgagtcctctgctgctttgccttcagcctctcccaggactgggagctccctgcgaagagagaggcgcagcagcccctgaaggagggcgtccgggacatgctggtgaagcaccacctcttcagctgggatgtggacgggtgaccccctcctccccagcccaacctcgggcctgcgtctgaggtggcccaggaccccaagctgcagagcccagggaagagcagctccagagccctggccggggccgcgggatatcaatatcaggctgccccactccacgttccccagcacatcccaggtggtgggagcagagggtaccctgccccaccagggtccttagggatgctctaggccaaaccacagtttgtaccaaaaaccttgtgaggaggtgggggagccatgtctgtgctcaggaagagggaaggggatgggggtggctagtaggctcctggcctctttggtttataaataaactgtgtctgtctttgagaaagcacctacct

SEQ ID NO: 182248 - DNA, 2330 bp, Homo sapiens
  Payload ID: 15883
  Gene Symbol: SGTA
  Gene Name: small glutamine-rich tetratricopeptide repeat (TPR)-containing, alpha
  Uniprot ID: O43765
  ENST ID: ENST00000221566
  CDS Start-End: 163-1104
cattaacgcgcctgtgcagaagggaagcaactccgggcgcctttcttttgcgcaggcgtcgcgccctggggccggggccgggcggcaccgcggtgcgcaagcgcaaccgtcggtgggtcggggatcggtcgcctgagaggtatcacctcttctgggctcaagatggacaacaagaagcgcctggcctacgccatcatccagttcctgcatgaccagctccggcacgggggcctctcgtccgatgctcaggagagcttggaagtcgccatccagtgcctggagactgcgtttggggtgacggtagaagacagtgaccttgcgctccctcagactctgccggagatatttgaagcggctgccacgggcaaggagatgccgcaggacctgaggagccccgcgcgaaccccgccttccgaggaggactcagcagaggcagagcgcctcaaaaccgaaggaaacgagcagatgaaagtggaaaactttgaagctgccgtgcatttctacggaaaagccatcgagctcaacccagccaacgccgtctatttctgcaacagagccgcagcctacagcaaactcggcaactacgcaggcgcggtgcaggactgtgagcgggccatctgcattgacccggcctacagcaaggcctacggcaggatgggcctggcgctctccagcctcaacaagcacgtggaggccgtggcttactacaagaaggctctggagctggaccccgacaacgagacatacaagtccaacctcaagatagcggagctgaagctgcgggaggcccccagccccacgggaggcgtgggcagcttcgacatcgccggcctgctgaacaaccctggcttcatgagcatggcttcgaacctaatgaacaatccccagattcagcagctcatgtccggcatgatttcgggtggcaacaaccccttgggaactcccggcaccagcccctcgcagaacgacctggccagcctcatccaggcgggccagcagtttgcccagcagatgcagcagcagaacccagagttgatagagcagctcaggagccagatccggagtcggacgcccagcgccagcaacgacgaccagcaggagtgacgctgcctgctcccggtgtgaccgcgtccttccctggccgacccgaaggaagccttctggttgtctgccacttcctcctgttggactgcctgagagaggggaagagagagacctcggacctgcatgtcaagatggattttccccttttatctctgccctcctccactccctttttgtaactcccttacagcccccagacccttcttgaaacgagagccagcaagctgagcacagaccagcagcgacctcccttccagcccccagaaagctcggtcacttgagtgttttctagaatcctggggtgctcccgggccgctctcagagaagtggcaggtttcacgttcagccgtgtggcggatcgtgtggcttccaaagccttttacagcccccgccccccatcccgtggtctgtctgcaggaactctcccgtctgtgagaagcctctttccgagtcgacctcccggccaccccggccctgtgcctgctcggaagagctcactgccagctgcggcctgggcaccgcgggccatgtgtgtttgcatgaggaactctttagtggcagacacctaagagacggctgcggtcaccccacgcctccgcggctcaggagccgtcctgggtgcataggaccagtttctgtgacttttctccagttgggcatgttgacagacatgtttcccctcctcccaccctcattttctggtcctcgcgactgagagccaggggcgacatcatgaccttctgtcccggccgccttagccccgggcacagggaaggcagctgggccgtttctgtctgtgtcccatcctgctgtccttctgtcctggatgtttcatgggcccggggccccccagggaagcttacccctcctgtgctgggtggaggccacgggacacctcaggtgccacccaccttggccctaaaacagccaccaggaaagcagccggagagccggacagcaggcagcctgtctgggttcctgaggcctgggggtggcagacgagcccacggcgccgtggtcccagcagcagggttgtcagtcggagcatcctggggctccctggctcctggccgtctgtgaggtaggcgcagtaccgtgtatcgtaggtagcagtaggaacgggggccgccgcggccctgcagccgctcatggcggtgaggtgtgtgccaagcccacccggggtgcagggcgtgacgtgtggggaataaataggcgttgtgacctct

SEQ ID NO: 182249 - DNA, 637 bp, Homo sapiens
  Payload ID: 15883
  Gene Symbol: SGTA
  Gene Name: small glutamine-rich tetratricopeptide repeat (TPR)-containing, alpha
  ENST ID: ENST00000589251
  CDS Start-End: 151-637
cgcaaccgtcggtgggtcggggatcggtcgcctgagagagtcttcttctgcatatcgtgctagaggtgggggaaatctgggattcaggaccgtccaccaccacctcccacccgctgtgtaaacctgggtatcacctcttctgggctcaagatggacaacaagaagcgcctggcctacgccatcatccagttcctgcatgaccagctccggcacgggggcctctcgtccgatgctcaggagagcttggaagtcgccatccagtgcctggagactgcgtttggggtgacggtagaagacagtgaccttgcgctccctcagactctgccggagatatttgaagcggctgccacgggcaaggagatgccgcaggacctgaggagccccgcgcgaaccccgccttccgaggaggactcagcagaggcagagcgcctcaaaaccgaaggaaacgagcagatgaaagtggaaaactttgaagctgccgtgcatttctacggaaaagccatcgagctcaacccagccaacgccgtctatttctgcaacagagccgcagcctacagcaaactcggcaactacgcaggcgcggtgcaggactgtgagcgggccatctgcattgacccggcctacagcaaggcctacg

SEQ ID NO: 182250 - DNA, 841 bp, Homo sapiens
  Payload ID: 15883
  Gene Symbol: SGTA
  Gene Name: small glutamine-rich tetratricopeptide repeat (TPR)-containing, alpha
  ENST ID: ENST00000587866
  CDS Start-End: 637-841
ctctcttcgtgtggccacatggcctcagcctctgcctccgtcttcacgcggccgtctccgtgcggccatgttcaatccctgcattagggccaccacagcgacctcatctccacttgtttccatctgcaaagacacagacaaggtcccgtgctcaggtcccaggtggacgtgactagcccagaacttggctgctccagcggcgggggcgggggcggctgcttctccacgcagcttgttacatctgaatgtttagagtcaccatcgccagccttcgggggaaatggaggcacagtgaggccaagccttcctgagctggcgcctcaaggcagccggccagcctgccccgggggaagctcacgtcggggcttcctgctcagagccgtgaaggtcactgtggccgaggcccctccaagttggcccaggcacccaggaaacctgtgtgaaaggtcttgtactaaaaaaagacctgtccatagactacagctccagattccagaacagcctctcctgatgtcaccatctggcaccctttagagctttggcaggaaactgcagggaccacagacatgagcagaagcagctgtcaagtcctgggaatgaggaacaagacagggtatcacctcttctgggctcaagatggacaacaagaagcgcctggcctacgccatcatccagttcctgcatgaccagctccggcacgggggcctctcgtccgatgctcaggagagcttggaagtcgccatccagtgcctggagactgcgtttggggtgacggtagaagacagtgaccttgcgctccctcagactctgccggagatatttgaagcggctgccacgggca

SEQ ID NO: 182251 - DNA, 5469 bp, Homo sapiens
  Payload ID: 15884
  Gene Symbol: SGTB
  Gene Name: small glutamine-rich tetratricopeptide repeat (TPR)-containing, beta
  Uniprot ID: Q96EQ0
  ENST ID: ENST00000381007
  CDS Start-End: 237-1151
gccccaggggcggtgctggccagaccctgccgcctgagagagagcacagcctggtgggttctggggtctacggcctaggggccggggaagtttgcgccgccgcgaccagtgctgcgatcccgagccgggctccagccccgaggaccaggggtcgggcgggcctgcctacggaaccccgcgggccagcagcagtcgtctcgcgtcctcctgcttggaaaagtgtttaagcttctaaaatgtcatctatcaagcacctggtttatgcagttattcgtttcttacgggaacaaagtcagatggacacttacacctcggatgaacaagaaagtttggaagttgcaattcagtgcttggagacagtttttaagatcagcccagaagatacacacctagcagtttcacagcctttgacagaaatgtttaccagttccttctgtaagaatgacgttctgcccctttcaaactcagtgcctgaagatgtgggaaaagctgaccaattaaaagatgaaggcaataaccacatgaaagaagaaaattatgctgctgcagtggattgttacacacaggcaatagaattggatcccaataatgcagtttactattgcaacagggctgctgctcagagcaaattaggtcactacacagatgcgataaaggattgtgaaaaagcaatagcaattgattcaaagtacagcaaggcctatgggagaatggggctggccctcactgccttgaataaatttgaagaagcagttacaagttatcaaaaggcattagatcttgaccctgaaaatgattcctataagtcaaatctgaaaatagcagaacagaagttaagagaggtatccagtcctacaggaactggactgagctttgacatggctagcttgataaataatccagccttcattagtatggcggcaagtttaatgcagaaccctcaagttcaacagctaatgtcaggaatgatgacaaatgccattgggggacctgctgctggagttgggggcctaactgacctgtcaagcctcatccaagcgggacagcagtttgctcagcagatacagcaacaaaatcctgaacttatagagcaactgagaaatcacatccggagcagatcattcagcagcagcgctgaagagcattcctgatttaaccaggggctcaagcccaagatacaaatggtttatggctatgaatgaagtatttgttgtagatagtaccccctccctccttcaaaaaaccaaacaccatatctgatgtgtgaaaataatggaggaaaacctcttgtgtatattcttaaagaataaatctgtttagacaataggtttatcacaaacaaactcaaaacataacatgactccttttgaaatgatcactagccatgttacgtgccaatatagcactgggataaggttccattttcaaacttctatcatatttgtatattagacttaatagcaaagcatatttattgaactctagtagggctatttgttggtaagctctttagctccaatttcccttaagcaaagttttttgagaagggaaatgacccaaaggaaaggtttcctatgctggttgagaagaagtgtacttgccactgagcagtatgtcaggaaagaaggaatattatctaggtttagctttgataagtgctattagtaatgaatatataacatgggaaccaatgttatctttaatgttgcttgttctggtgaacagagaatcttaagagctgttagaaagtagcacttgatgcaagggatgttttgaaaagaaaaaattggtaatgcgaatgtatagaaagtaaaggtaggatgctcaggttttctgcatagttcttaactaatcttgtctgcagtttggtattgataatattagcatggccacttatgctaaatacacaataagatacatttagaaatccttaatgtactggttaggtcagtggtacaactgtttgacttaattatcacaatttccccaatggtaaccttaccttggaaactatcaaatataaatatactttaactaagccagtgacctggtcctaagttaaggattttctaaatggtatttaattgtgtgcccataaacactgattttttttaaaaagaaaacttagtaattatttgatggataacaaaaagcatctatcactaacattgcttgttcatgtaatcttctgtgataatttggcttggcatgccagtcttataattaacataatttaaatttgatgcaatttaaatataacaggagacttaaaatattttattataaattagatgccatattagttagtggagaaaaggggcattaggtattaattgcatgggtctaactacattgatgatgagagtttaattccaactagagtatattttttgtttattaataatgaaattggtgctgacatgtaatgacttcacaagttttacgagggaaaactgaaaaaggaagtaatataaattttgtggggtttttttgagatggagtcttactcttttgccaggctagagtggtgttgcaatgtcagctcactgcaacctccacctcctggattcaagtgattctcgagccttaagctcccaagtagctgggattacgggcgcccaccaccacgcccagctaattttttttttttttttcttgagatggagtctctctctgtcgccaggctggagtgcagtggcgcaatcgcggctcactgcaacctctgcctcccgggttcaagtgattctcctgcctcagcctcctgagtagctgggattacaggcacgtgtcaccatgcccagctaatttttgtatttttagtagagacggggtttcaccatgtttgccaggattgtctcaatctcttgacctcgtgatccgcctgccttggcctcccaaatgctgggattacaggcgtgagccaccgtgcctggccgctaatttttgtttttaatggagagagttccaccgtatcggccaggctggtctcgaactcctgacctcaagtgatctgcccatcttggcccctcaaagtgctgggattagaggtgtgagccactgtgcctggccaggaagtaatatacaattaaatgagtaataatgcagatgattaggccttatagaacccttatcaaaagactaattggccgggcgctgtggctcatgcctgtaatcccagcactttgggaggccaaggcaggggggatcacctgaggtcaggagtttgagaccagcctggccaacatggtgaaacccacctctactgaaaatacaaaaattagcctggcttggtggcgggcacccgtagtcccagctacttgggaggctgaagcatgagaattgctcgaacctgagaggcagaggttgcagtgagccaagattgcgccactgcactccagcctgggtgacagagcaagactccatttcaaaaaaaaaaaaaaaaagaaaaagagactaagagactaattattttgtatcttgaagtttaaaatccaacttttctctttctcctttgtgacattagaacagtagttctataacttcattgtaagaatcacctggataattcattaaagatgcagattcagggccacgtgttcaattctgatacagtaggtcctgtaataaggcctaggaatggccatttttaaacagtacactaggtggttttgatacagatccaaggactctaatttagaggaacactaggttagaggtttctcagacctgcaaacacctaagcacctgggccaaacaaagctacaacgaagatctgtatgaagatatatagttctgcagaatttaaaaagagcacaatttaagtcttcggccctcagaagttaaattcatattccatctaagccaactttgattttcattaagttagaatgaactcctagtattccagtattacacagaacgaagtactactactaacacatagaagtcattactgtgatataaaaagcaaaatagatccttaattaaaaattagtcactcatattcagtgttgaataagaagttaaagtttctagcataactatcttgagtgcattaaaaatgcttttagagcaataagataagcttctagctgactgcctagaaaaacagaagatacaaattcagtgtcagaaatgaaagggaatacactacagacactatagttattaaaaggctaactagaaaacaccatgaccaactcaaggattgtatatttaacaacttagatgaaacagattccctataggatacaaactagaaagctcactgtagaaacagataacctaaacagaaccatatttattaaggaaattgagtttgtggttaagttaaaaaccttccagtaaagaaaactacaggcccagataacttccgtgatgaattttaccaaacacttaagggagaaataatatcaattctaaacaatctcttccaggaaacagaagaggaggaaatacttcccaactcattttatttgaccagtattacccagacaaagatactataagaaaaaaaactttaaaacaatgtcttcatgtgctaacatctgtagttaaattagccattctttttacatgaaataatgggaattggtatatttcttccatttcatttttctatttctttgctaatataccacctgtaacaaattcaatctagatgctatctgtccacttgcctacatttccattctattcaagccatttttgctcttcaagtaccttgatcactttggaatcatagcattgcaagctatttcaaaaaaagttgcgtggttggattgtgctagctacttttaaatttataaaaaatgccccatatattttcttgcttgtctgggaaatatagttgctatctaactagaaaaataagagggcattattaaagtaactctttaagcatcgtactaaatgtttgacttccattaaccatatttcttgtagtagctgtagctattatgatactgtgtaaaacagaacaggttctatatatgcaaatgacattttcatttaatgtaccaaattgtgtatctaacttttataatataggttaaacagatcctttctaagatggcattatttaatctttacttaaaactatgaaaaatatgtgtaagttattgtttataaacagaagagactataattaaaatatagagcagattccaagtgaccatcattttactttttagatttaaaacagaatgaaacagaagatttagtcataagaagatgcttgaaaaacaatccaagtatccaatgcagtggctataaaatattatttcatcatttaatcttaatcattttgaaacaaagacagacttcaattttacactgcttgcactttattttgtacagacatttcattaattattactcaattttgaggtgcaaaccttctgaatatagctttcattttggaccaaacaatttgttatggcaataaataatgatgcattgaaaaaccaa

SEQ ID NO: 182252 - DNA, 887 bp, Homo sapiens
  Payload ID: 15884
  Gene Symbol: SGTB
  Gene Name: small glutamine-rich tetratricopeptide repeat (TPR)-containing, beta
  ENST ID: ENST00000506816
  CDS Start-End: 302-887
aagcaatccaaaacagcagctcaggctgcccaaagccgtgtccaagcgatcattttctccattttgggccaagtcaatttgcaccggcaagaggcagaatgtttgttttatggggaggaggaaaataaaaaaggaagtcagagagcatggacggaaacaagcaacaccaccaaagaggtttcatctcgggtggatgttaaacgattggaatgctaataatgggcgcgaggagcaaacacaattgttctgagtccacagctgcggcacttttaatgacaggaaaagtgtttaagcttctaaaatgtcatctatcaagcacctggtttatgcagttattcgtttcttacgggaacaaagtcagatggacacttacacctcggatgaacaagaaagtttggaagttgcaattcagtgcttggagacagtttttaagatcagcccagaagatacacacctagcagtttcacagcctttgacagaaatgtttaccagttccttctgtaagaatgacgttctgcccctttcaaactcagtgcctgaagatgtgggaaaagctgaccaattaaaagatgaaggcaataaccacatgaaagaagaaaattatgctgctgcagtggattgttacacacaggcaatagaattggatcccaataatgcagtttactattgcaacagggctgctgctcagagcaaattaggtcactacacagatgcgataaaggattgtgaaaaagcaatagcaattgattcaaagtacagcaaggcctatgggagaatggggctggccctcactgccttgaataaatttgaagaagcagttacaagttatcaaaaggcattagatcttgaccctgaaaatgattcctataagtcaaatctgaaaatag

SEQ ID NO: 182253 - DNA, 491 bp, Homo sapiens
  Payload ID: 15885
  Gene Symbol: SMIM1
  Gene Name: small integral membrane protein 1 (Vel blood group)
  ENST ID: ENST00000561886
  CDS Start-End: 195-308
gctcgaggcgtctgccgcacctcagcccacgacctgccccgctgggaggtgcgggccgctggccaggccctgaccgcaacctggcccagaggccccagccctcaggcaaggttctccggtgaagccacagcctggccacctgtcttgatctccccaccgagaaggccccgcccctcccgctgcagccccacagcatgcagccccaggagagccacgtccactatagtaggtgggaggacggcagcagggacggagtcagcctaggggctgtgtccagcacagaagaggcctcacgctgccgcaggtgaggggcctgagggcagcctgccagccatagcaggctggtgtctccctccagagacgcctgccctaacccctgctaccggccccatcaccctccaccccatcctggctgggagcccacggtccagcagctcagcaaaccgcagcctttggccttccctctggttggctgtgggcggggagagctt

SEQ ID NO: 182254 - DNA, 546 bp, Homo sapiens
  Payload ID: 15885
  Gene Symbol: SMIM1
  Gene Name: small integral membrane protein 1 (Vel blood group)
  Uniprot ID: B2RUZ4
  ENST ID: ENST00000444870
  CDS Start-End: 249-485
ggtgaggcgcgcggggtccgggctgcggcttcccggtgcggccgcagtgggcaggctcgaggcgtctgccgcacctcagcccacgacctgccccgctgggaggtgcgggccgctggccaggccctgaccgcaacctggcccagaggccccagccctcaggcaaggttctccggtgaagccacagcctggccacctgtcttgatctccccaccgagaaggccccgcccctcccgctgcagccccacagcatgcagccccaggagagccacgtccactatagtaggtgggaggacggcagcagggacggagtcagcctaggggctgtgtccagcacagaagaggcctcacgctgccgcaggatctcccagaggctgtgcacgggcaagctgggcatcgccatgaaggtgctgggcggcgtggccctcttctggatcatcttcatcctgggctacctcacaggctactatgtgcacaagtgcaaataaatgctgccccgcatgcacgcggggggctggccgcacacgtgagagcacaggcctggagaca

SEQ ID NO: 182255 - DNA, 447 bp, Homo sapiens
  Payload ID: 15885
  Gene Symbol: SMIM1
  Gene Name: small integral membrane protein 1 (Vel blood group)
  ENST ID: ENST00000452264
  CDS Start-End: 433-447
gcggccgcagtgggcaggtgcgactgtgcgcggcctcgctggctgagaactggcgggggtgggggcgtgccctggactgacccccaccggcctaacccgcggtgcggggccagggccggaactgcccgcccggctccttgcccggctccttgtggctgctggggacccccgacaccagccactttcccttcccggcccttagcaagatcggcttctccggtcacctttatttttttaggctcgaggcgtctgccgcacctcagcccacgacctgccccgctgggaggtgcgggccgctggccaggccctgaccgcaacctggcccagaggccccagccctcaggcaaggttctccggtgaagccacagcctggccacctgtcttgatctccccaccgagaaggccccgcccctcccgctgcagccccacagcatgcagccccaggag

SEQ ID NO: 182256 - DNA, 1536 bp, Homo sapiens
  Payload ID: 15886
  Gene Symbol: SMIM10
  Gene Name: small integral membrane protein 10
  Uniprot ID: Q96HG1
  ENST ID: ENST00000330288
  CDS Start-End: 159-410
ggcagggcgccagtgaccgctggggccagagccctgccgggaaaggagggcttccgccttgcagcgcagctcggatcagcagcagcccaggaggcctcccgcccgtactttcccgcgtccatccctctgtcccacggtcggtgagtcagcggagcctgatggaggccttgggctctgggcactatgtgggaggcagcatcaggtccatggcggcggcggccctgtctggcctggcggtgcggctgtcgcgcccgcaggggacccgcggctcttacggcgccttctgcaagacgctcacgcgcacgctgctcaccttcttcgacctggcctggcggctgcgcaagaacttcttttacttctatattctggcctcggtgattctcaacgtccacctgcaggtatatatttagagccactaactttgtggcatttgggggctcctcgtcaggatggctgacttccacccacctgctcacccaccctagagcaaagcgaccaactccgctcctgcatgcagacttgccactcattctttccattgcctcatcttttagtataaatgggtggcaaaaaaagaaaaaaacagcatttgtggaaagcctgaaatataacccaaatcgtctaagatagaatgaaaaattgactctcaaggaaatatttgaaggaacagaatacagcttaaaaatttgaaaatccttaaaaatatctgagaagtttttgcatccgtaaaacagaaaacagcacgaactttaggaaatgacaatgggcacagaatgcaataaaaaaaaaaaacggggaaaggtaactaaaaacttaaggaaagataaactgaacaagaatggctcagacagcaggcaaatctccccaattagaaacgaagtgaatagacccaattgaatgagatgaattctaagcaatagatggattgaataataagctggaggacattaataacatgttctggaaggcatacatttcttcaacccaaaggaaaaaaaatgacagaaagaaactacagggaagaacattaaaaactgtgcaagaaacttatgtttcacatatgaagcaacctcagatgtggcatggttttgaacagttgccgaaagtgtgagaaagggaatctgtttgaatattggcacatggatcaagactctggagtcggtgatgagaaaatccaatcagagcattccactttgctattcattgaaccaggtagccaacagaagagttaaaaattagtgatatgactatattcagggggaaggagagctgaggggggcggcaggaagtcagcagaaaatgcctcatgtcattaagtcaagaaatagtaataaaggcatgttattgaaaaagggggtgtaatctctaaacaagcacgtgtagaagtttgtgtttctgatttggggaagcaagagttgagaaggagggacagttctattacttttcattatatgtcctttttctactgtttgatttttaaaaactatacacatgtattgcttttgcttcgattaaaaatcaagacattaaaatgaa

SEQ ID NO: 182257 - DNA, 4795 bp, Homo sapiens
  Payload ID: 15887
  Gene Symbol: SMIM10L1
  Gene Name: small integral membrane protein 10 like 1
  ENST ID: ENST00000622602
  CDS Start-End: 136-342
ggcagcggcaagcttgggtgtgagcccgggagccgctttgcttaccgtcctgccggtcccagccgtcgctaggaggtccgcgggccctgcggcaaccctcgctacagacgctgggcgggcggcgacacctggctcatggcccccgcggcggctccgtcctccttggccgtcagggcctcaagccccgccgcgacacccacctcgtacggcgtcttctgcaaggggctctcccgcaccctgctcgccttcttcgagctggcctggcagctgcgcatgaacttcccgtacttctacgtcgcgggctcggtgatcctcaacatccgattgcaggtacatatttagagccatgactaagctaacggcctccggggccagcatgatggccgactcccagggtccgttgcggcgcggcggagcagccaatggcgagccccacagtctcgcgagagtgctcaggcgctcttcgtggctgccctcttagctgctagcggagctcctcagggggcggccgggagcctacaatccctagaaagagaatacgctgttccggaaacagaactgcagttaagaccctcgaaaacatctaagaaagtgtgcatcctaaaacacctgacgaatttcagaatgtgacaaagcgcagaggatgcattatttcaaaacaaaacagaaggctaaaatttgcaggaaaaagaaaatcagtaaaccgggaatcctcggactggattgtaagcaagatttcaatgaataagaagctgaaggtattaaggctgtgatatagaaggtacatatttcatcccacaagagaaaacaataataatcagaaattttcggtgaaaaaaacgcaaaactgtacaggaaaatcatcctccaagtaccagacataaaatgctgcaagcttttgaactaatggcgagagtgtaagaaaatgggctctacttcagtgatcctgtggcaggacgtggatcaagacttggaaccgcagaaaacgaaatcccatagtagcacaaagcttggctgttcagtgaataacatttaaataatcgtaaaatacaaatgttgtttatggtttttattgtttaagggcatacttaattatggttacaaagtggagtgcaaatgttatttaccatgttttaaaaatacagccggaaaatacaagtgggaatgttgaaggagggcgggggaagtaaatggaatgggggttatgtccttataaagtggaaacttgaaaggtactgtctgttgttgagtggggaaagacatttttattacttacagggtagccataaagtttctaaaacggtaatatattaaagagggagagtggtaggggagaacagtatgaagtcaacaggaaatggctaaagatggagagctcaggtagaatagtttaaaaaatgaaaattgatagagtacctggtgtatttgaatacagcctagagagctttcattttccaaagagtgtggggataaattagtgaatgcatatttttcaaaattaagaaaacagaacatataattttgaacgctgagaaaaataaaaatttaaaaactacactgtatacacggtatacctcaactgtgaataatagtagtcatgtaaagtcagtcataattatgtaaatactgaatactgattttacaacaaatgattctataacgctgggaggatgggagaaaagagatgtgtgtgtgtgtaatggtggtgagccaatcaagatctgatatagaaaaatgcagaaaaaggagtatacacatgttttcttcggattaaaaaaactaataataaatcaccaagagtggtaaagttttaaatcaagatctgatatagaaaagtgcagaaaaagtagtatacgcattttttttttcaggaaaaaattaactaataaaccactaagaggggtaaagtgttaaaatagttgcattgttctatattccactcattgtgtccagcaaacagtgttctatggctttaagtagtaagcatcttgccccgtccaacaccatgtctggcctagggtaattgttctttctagtctttattctttgtctccagccaaactccatttgggcacattctcctatagccttttctacctgaagatactctgtgttttaaagctaagcttaggtggcgctttttccattaaatttttcctggattccactgaccatataggagctcacttcttttaatccataaggccattttcataggttgccttatttttccctaatcgtgcatcaactgtctgttttatatacccaagacaggtttcctagactgcgataagccaaaacattttagtctaaaatatcagaagtgtagtttaatcaatgaaatagtaataccaagggatttagaatcgtggacatcactgtttcccagagcactgatgtcccaatttgtaacacaaaagactgtctagtcttaatcctgaaatggtgacagagtaggatgctccatttgggtgactatgtgaacatattcctataacttttttcctcacatcagtcatttgttaaaccgaagatgaagaaacagactttgtatttattacatcctccaacataattggcagctctgtgagggaagacactatatcctattcaattttacacccggtagtaacagtatgtgtgtgtactgtatatatacatatatatatacatacacatatataaatttaagtagtaactatatatgtatatatgtatagttactacttactatatatgtatacagtatataagtatatatgtatagttactacttacaatatatgcataaagttacagcttacatttacctcgtaatatatgtatatatatatattaggagttaaatgtattaggaggtaaatgtaaactctgtggtttatcatttattcacaattgctcttaattcttggggtatagtttgcctcctacatgatgcaattcagtgaaattcccaggagacaaaacaagattttgacctgaataaaccacttattgttgtaattcacaagtgagtttattcttcctggcacacttccaggtaatatccattaggctaaggattttgtttgttcactgttctatccccaagcctagagcactgcccagtgcggaatagctaataaatattgttgaatggatagatgaatggcaattttgttggtatgctctacatagtcagcagtcaataaaggaaacatatattcgttcctgataataagatgattcactttattgcccataaattgggctttttcaggccatcatgcacgttgattgatccagagatccctcaagcatgaaaaagcagagacataggtggtatagttattatcaatagagataagaaatgtagctggcaaaaaaaaaaatgggaaacgatgcgttacagcttattttaactataaaaggaaaacagtgaacatagcaacatatgtaacctaagggataggggaaaagttgtttttttttttttaattctgggtaaaaatacatgtgattacttgacaaatagcatatcattaccatcagcatcatttttaaaatatattgagtttttaataccaggaactatgaaaaactatttatatacatgagctccgtaattctcacatataccctgtgaggaaaacatttttatcatttttcagagaagcaaaccgggatttagagaggttaagtaaattcctaaggtcatgataaccaaccagacctcaaatgaatctccagtaattcctaaagttatatttcataaggagttcaattttcttaaatgtgtagataattacaaataattctgtttctcaaatttctggacagaaatattacctgggtaatagttattttttttaacataactattgagggtctttcatactaaaatataaatatttaacatgatttgatatgtaagttcaagtattttatactctctgcagccttaaacctattggcttattttattagagggttggtgggattgagggatatgggagcaaagggagagagaggaaagaacgttgtcctcagaatggaagggaaacactttcctgtgctacccagagtagagatcagacaatgttaaattttgaagccatgtctgttcctgtcctgaggatccctaactaaattttgttagaaaatcttgcagtttgcttttaatgggagatctttctggcaggacatcaatagcttttgatagcgtcaagaagaaaataaagttacatgcagaagcataaaggggtaggatgaaagttgaggaatatagggacaaaagatgagggaaaggaatatcctaatacttggaagtttgagcatggaaagtagtctaaagacgacttgggaagttccaagaaaatgaaccaagaaaagaacctctgcaagaactatgagaattcccaacaattgggttggattgattcatattagtctattacttgggttaccttgagtgtggggattcttcttgcagttttaacacttgtactatggtctgaatgtgccccccaaaaattcacatgttggcatttaacccccaaagtgatgatctcaggagatgggacctttgggaggtgatcaggtcataaagatgaaaccctcgtgaatgggattagtgcctttataaaggagaccccaaaataattcccttaccccttttgccatgtaaggttatagggaaaagtcatctatgaacaaggaaatgaaccctcaccagataccaaatttgtgaatgcctggatcttggacttcccagcttctagaactataagaaataaatttctgttgttcataagca

SEQ ID NO: 182258 - DNA, 5230 bp, Homo sapiens
  Payload ID: 15888
  Gene Symbol: SMIM10L2A
  Gene Name: small integral membrane protein 10 like 2A
  Uniprot ID: P0DMW4
  ENST ID: ENST00000417443
  CDS Start-End: 190-426
tgtgcgggatcgtggaggtggggccgaggcagcggccgcctgagccccgctcggccttgggaacacgggggcggggcggccgcggctctgggcgacccgctgggtgcactagtgctcgggtcccaccgccctgaggctcgcgctcgagcgggtcagtcggtcggcggggcctgcgcggggcccgggcccatggcggcgtcggcggctctgtctgcagcggcggctgcggcggccctgtctggcctggcggtgcggctgtcgcgctcagctgcggcccgaggctcgtacggcgccttctgcaaggggctcacgcgcacgctgctcaccttcttcgacctggcctggcggctgcgcatgaacttcccctacttctacatcgtggcctcggtgatgcttaacgtccgcctgcaggtgcggatcgagtgagcgccggcggcggcggcggcgaaggcccggctgaaggggcgcccgtgtccccgcccgcccccggccgggtcgccggcatgaaggaaagctgggccgcggcggggggcggaggcggggcggctcggacccctggactctagacctacgccgccagggcacgacggcccagccctggccccggctgcggtctcagcccgggggccctggatcgcgcagaaacgcactgaatgggcccctgccatcgggctccagaaactacctgggctcggccgacctgttgcctcatattggccaaagagggggaaaccagaaggagggaattctgctgcggcgacttgactttccaggcccggagcagaaaggcattggcatttgtaggcggtgacccgccccttctctggccttgccaagagtcacatccctgcccaggggcacctctggccctggaacttgcctgggcagaggcagcgtgaagggcctgaacaagaggagaagaagggccttcctagtagaggcacagcatggacaaaggctcacaggggtgggggtgcccagtgatcgagtcctggcttgggaaggaaggtctgagttccctgggaactgaaatctgctagcagcactgtgagagaggtgtatttccccctcctaatgacagaggaaactgaggcttcagggaggggtggatttgcccttgacatgcagataggaggaggaggaactgcgtgtgcccctgggcctgcaggcccccacacccctccccagtcttcttcaagacctggcatggtgggaggagggagggggaagtggagaggggagcatagggctcctggggcaccaagggagagaggggcccaggggtagggaatctaggaatgtcgctttccttggagcagtacggaaagtcacagggaagatcaggaggacggacagctgagatgggagacaggagagatgagccccaggacccctggggagccaagctgtcccccacatcctagcctctcaccccacctggagcttcaccaagggctcctcagcagtgaagtggcacaagcctcccagtttggtgggcaagtgggggtgatcttggtgttgtggctcctggagacacgacataaccaggagggtgaagggataaacctggggtgggctggggctgagacccatggcatgaccccaattctctctcctcaagctcgaccccccatccccaggatcacacaggagaatctcatcctcacggcttggattgctcctgggggccccctggtgtgctgctaactggtgtacaatgctcaggagcagcccagaggggagccgggaagggaccctcgcccttaccatctatccccatttccgcatctcttgcactggtaccccgggcgccacgttctcagttcctgggactgaaaactgcagcagtctggccagctccagggacagagtggcccagccacctactatgtaccctcctcagctgcccactggactcaggtcctgaatgaagctgtccgcctgcctcatgccagaagcggctggacagtggctgcctcatgacccttgcagtctcccacatccagggcctgatgacatgcccccttgtcccaagtttcttgggaacccctgaccctgctggcccctctcatccaccccaaccctatccaccctggaccacctctgggggtctgtcagcctgctggtccccccaacagatctttgggggcagcctctatgggacaagagtgacacagggctggagaagaggagtgaggagcctccttgtgtctgatgcacagatgtggccctttcaaaccctggtgtcaccctctgggtgactggatccccagctccagcctcttcctgggccagccaggaaggctggaggaaagctctttgctgagtgcatgcatgggagtgtggggggtgactgagccctccccatgcaaggggcttggcctgggaccctggaagctgtttccctactgggataaagttgcgtcagccgcaggggtctctgccctcaaagaccccccactgcagggagccccaccccataagagggtcacggaagtccatgtccgcccacccccagtggcttctggtgtggccgtattggcctagaggggctgactggggagggtcagggccaagccctcagcatctgctcctgtccctgctttttcacccctgctgcctgaagtggtagccccgcctgctgcttctccacctcccctccccacctcttctctcccagatggggcccttgctgcgtgacggggtctccatgcgctttatttatttgcagtctgttttctaggcggtggagctagacactgaccggaatgacatacttttctgtgtgtgattcactgtgtactggtcagcacaggctggccagagagctgttcttgtttctggtgttgtcacgtcttcttgttttctctaagtttaaaaaaaagtccttggtttaatacactaaaatcccaactggaggcctcccgtgtctggtgggggtgatgcagtggccccgggtggagaggccccatggtgaggtcaccagctcccatggccaggagttggcagggagaagcctctgagggctagggctgggggaggctgtggcagggaccgtgtttcctgttcagaggctgtgctgagaaccgacttgacctggaccactgccccatgagaagcaggcagcatcctagcctggccccgagaggtagctgcttgttctgttgacaacctttgttcaacgacccaaaacataagtccctttcctttttagagtctggcgatcaaaagtgtcttaagtcagtagaatcctgagggtggactagggtgaagtgaactgaaacagactcgacacaggtcattttgtgtagcactgagactcctctccctgcctgaggccacctcccactgcctccctaccagcaaggttactgcagaatcttggagaagataaaggacctggccctggaagcctgcttccctttcccaaccttggaagcaaattctgtcccatcagagcccccctccctagtggctcccaccagagacctccctagtggctgctgtaagggttggcaagcaggcaaaaggcgggggagggagggcagagggtagtgttagaggaagccccatagggcccctgggtgggggtggggaggcatcctgaggacacagggctatgctcagacttaggagtgaagactgggtttaggggccctgggggcactcctgttgccaagggctacccaggggtcagagcatcctgacaaggaggacccgtccaaacgcactggtgctaatgccctatggcatctgccaccacaggagaaatggaccccagtccttgatcttccctcccctttgtctagatggtcctctttatccccactccagggatcacatgacttggcaaagcaagatgggaaatgatcctcccagagcctggctccaaggcttcttgaagagggaggatcacccctcccatccctgctacagaggaaaaggcaggaaggccggttctgctccgatgggactccaggagaccaaagccctgagccctgagcccagctcttccacttactactgtgtggtgccaggcaagctgtgcacaacctggagtttttagtaaggttccgttgggatgcttgtaagcagtgaatacgatgatgtctgttcattgtttgtcatcaggtctcacctggagcagccttgttactgtggggaaaaggaaccaagtgaagggaatcggcctctgatgagagcctgccatgtgccaggcaccatactaggtgctttgcattcctaatctcatcattatcacacaaccacctaaccattatccctgttttacagagaaaccaaagacaggaaccaagtctgaaacagagccccaagaagaagctcttttcctgagctaccagtgccccttggagaggcagggaattgggctggaagaatggtggaatggaatagcaaagatggaagatgaccctgtcctttctgggtgaggtccagaagaaatccagggcttggatgaggggtagacctgagagccttctccaaatggaactccccagtgggagcagctgtggccaccctgagatgggtctacctgtcttccttccattccacctccagagattgattgggacctaagagactgagtcaggagagggcaagaaagcagctaagtgggaagtttcaggggcactagagcaaatacattgagaaatgggaaatacaaacagcatgcaaaatcacatcctactcctacccaccccactcccaagggaaattgctgggttttggacgaattttcactttgtgtgcaccttttatgtatgtaaaactacaaacatactactttgaaatctgattccgctatttcatgtttgtcttaccatgttattatgtattttcctacatccaaagctacctagtatctcttttgtatgaaggtttcatcatgtatcccccagtgccctttggttgtttttctttgttgtcatttattttggtgggggttggtttgctttttgttgttgtttttccttgtttttataaatgatacagtgacagatgccgttgtggataaatgctgtggcatagtcatcaattccttgatatatattcctagaaagtgcaccaaagggtatgcatggcttagggcttttgatactctccagagttgggataccaagtcacactactcactggagtcaggatgagagttttttgagacaatggtggcaattctgattcaatagattaaaaaatttattactacctt

SEQ ID NO: 182259 - DNA, 2696 bp, Homo sapiens
  Payload ID: 15889
  Gene Symbol: SMIM10L2B
  Gene Name: small integral membrane protein 10 like 2B
  Uniprot ID: P0DMW5
  ENST ID: ENST00000433425
  CDS Start-End: 2-238
catggcggcgtcggcggctctgtctgcggcggcggcggcggcagccctgtctggcttggcggttcggctgtcgcgctcggcggcggcccgaggctcatacggcgccttctgcaaggggctcacgcgcacgctgctcaccttcttcgacctggcctggcggctgcgcatgaacttcccctacttctacatcgtggcctcggtgatgctcaacgtccgcctgcaagtgcggatcgagtgagcgccggcggcggcggcggccgcggaggcccggctggaggggcgacagtgtccccgcccgcccccggccgggtcgcgggcatgaaggacagctggatcgcggcggggggcggaggtggggcggcccgggcccctggactctagacctacgccgcccgggcacgaaggcccagccctggccctggccgcggtctcagcccgggaccccggatcgcgcagaaatgcactgaacaggcccctacaattgggctccagaaactacctgagctcggactacctgttgcctcacattggcaaaagagggggaaaccagaaggagggaattctgctgcggcgacttgactttccccgccccgagcagaaaggcattgacgtttgtaggcggtgacccgccccttctctggccttgccaagagtctcatccctaccctggggcacctctgaccctggacctgcttgggcagaggcagcgtgaagggcctgaacaagaggagaagaagggccttcctagtagaggcacagcatggacaaaggctcacaggggtgggggtgcccagtgatcgagtcctggcttgggagggaaggtctgagttccctgggaactgaaatcggctagcagcactgtgagagaggtgtatttccccctcctaatgacagaggaaaccgaggcttcggggagggggggatttgcccttgacatgcagataggatgaggaggaactgcgtgtgcccctgggcctgcaggctcccacacccctccccagtcttctccaagacctggcatgatgggaggagggaggggaaagtgaagagggaagcatagggctcctagggcaccaagggagaggggcccaagggtagggaatctggggatctcgctttctttggagcagtacagaagatcacaggaaagattaggacagacagctgagatggcagacaggagagatgggccccaggatccctggggagccaagctttcccccacagcctagcctccccaccccacctggagcttcaccaagggcttttcagcagtgaagtggcacaaacctcccagtttggtgggcaagtggggctgatggtggtgtcatggctcctggagacacgacataaccaggagggtgaagggataaacctggggtgggctggggctgagacccatggcatgaccccaattctctctcctcaagctcgacccccccgccatccccaggatcacacaggagaatctcatcctcacggcttggattggtcctgggggcccccggttgtgctgctaactggtgtacaatgctcaagagcagcccagaggggagccaggaagggaccctcgccctcacctgctatccccatttccgcatctcttgcactggtaccctgagggccacattctcagttcctgggattgaaaactgcagcagtctggccagctccagggacagagtgatccaaccacctaccacgtaccctcctcagcaggccactggacccaggtcctgaatgaagctgtccgcctgcctcaccccagaagaggctggacagtggctgcctcgtgccccctgcagtctcccacagccagggcccgatggggtgcctccttgtcccaagtctcctgagaacccctgaccttgctggcctctctcatccgccccaaccctgtccacccttgaccacctctgggggcctgtcagcctgctggtccccccaacagatctctgggggcagcctctgtgggacaagagtgatacagagctggaggagaagaggagtgaggggcctccttgtgtctgatgcacagatgtggccctttcaaaccctggtgtcaccctctgggtgactggatccctagctccagcctcttcctgggccagccaggaagggtggaggaaagttctttgctgattgcatgtgtgatacagtggggggtgcctgagccctccccatgcaaggggctcatcctgggactctggaagctgcttccctactgggagaaatgtgtgtcggagctgcaggggtccctaccctcagagacccccgactgcagggaacccaccccataagagggtcacggatgtccatgtccgcccaccccccgtggcttctgctgtggctatattggcctagaggggctgactggggaggagcagggctaagccctcagcatttgctcctgtccctgccttttcacccctgctgcctgaagtggtagccccgcctgctgcttctctacctcccctccccacctcttctctcccctacagggcccttgctgcgtgatggggtctccatgcactttatttatttgcagtctgttttctaggcggtggagcttctagacaccgaccggaatgacatacgtttctgtgtgtgattcactgtgtactggtcagcacaggctggccagagagatgttcttgtttctggtgttgtcacgtcttcttgttttctctaagttt

SEQ ID NO: 182260 - DNA, 850 bp, Homo sapiens
  Payload ID: 15890
  Gene Symbol: SMIM11A
  Gene Name: small integral membrane protein 11A
  Uniprot ID: P58511
  ENST ID: ENST00000399292
  CDS Start-End: 146-322
ccccggcaggacggtagaagtcgtggtttgtgcgcggccaggcgctggagcctccgctgccgggagcaatcagaccttccagctgcctctcatgtacttgtctgttgggggcttgtgttgatcaggagtgaattcacagtctaccatgaattggaaggttcttgagcacgtgcccctgctgctgtatatcttggcagcaaaaacattaattctctgcctgacatttgctggggtgaaaatgtatcaaagaaaaaggttggaggcaaaacaacaaaaactggaggctgaaaggaagaagcaatcagagaaaaaagataactgaagattctgccatgtaaatgtcagcttgagtggactccagctgagaagaaagagaagaaagacttaattattgaataatttgtcagaggataaactcccaacctagacctttcacttaaaatagtgtgaatttgtatatgtttttaaaagaaccagtactggccgggtatgctggcttttacctgaaatcccagcactttgggaggccgaggcgagtggatcgcctgagatcgggagtttgagaccagcctggccaacatggtaaaatcctgtctctactaaaaatataaaaattagccaggtgtagtggcgcgcgtctgtaatcccagctactcgggaggctgaggcaggagaattgcttgaatccgggaggtggaggttgcagtgagcctaggtcgtgccactgccctccagcctgggtgacagagcgactgcgtctccaaaaaaaaaaaggtaaaattaaaattaaaaaaaataataataaccagtattttgtttactaaaataaaatgcctttgtaaaaaaagga

SEQ ID NO: 182261 - DNA, 1074 bp, Homo sapiens
  Payload ID: 15890
  Gene Symbol: SMIM11A
  Gene Name: small integral membrane protein 11A
  Uniprot ID: P58511
  ENST ID: ENST00000399295
  CDS Start-End: 371-547
aaattccaaaagctctttgggatgctgcgatgtcgcggccggccccgcgctcgggttttccctcctagacaaaagtctgccggctcccggtcgcgccgggtcggggatccggaaggtgaaggccgccaggccccacctgcggggcgcccctgctggacctggccgtcgggcgccgtcaacccgttgagcagcgtgttccggctggcacgtggcccgggcggggcccaggattggttcaagcctacggtgttggtccccggagagtctagggagacaagcaatcccctggaatgatcagaccttccagctgcctctcatgtacttgtctgttgggggcttgtgttgatcaggagtgaattcacagtctaccatgaattggaaggttcttgagcacgtgcccctgctgctgtatatcttggcagcaaaaacattaattctctgcctgacatttgctggggtgaaaatgtatcaaagaaaaaggttggaggcaaaacaacaaaaactggaggctgaaaggaagaagcaatcagagaaaaaagataactgaagattctgccatgtaaatgtcagcttgagtggactccagctgagaagaaagagaagaaagacttaattattgaataatttgtcagaggataaactcccaacctagacctttcacttaaaatagtgtgaatttgtatatgtttttaaaagaaccagtactggccgggtatgctggcttttacctgaaatcccagcactttgggaggccgaggcgagtggatcgcctgagatcgggagtttgagaccagcctggccaacatggtaaaatcctgtctctactaaaaatataaaaattagccaggtgtagtggcgcgcgtctgtaatcccagctactcgggaggctgaggcaggagaattgcttgaatccgggaggtggaggttgcagtgagcctaggtcgtgccactgccctccagcctgggtgacagagcgactgcgtctccaaaaaaaaaaaggtaaaattaaaattaaaaaaaataataataaccagtattttgtttactaaaataaaatgcctttgtaaaaaaagg

SEQ ID NO: 182262 - DNA, 1033 bp, Homo sapiens
  Payload ID: 15890
  Gene Symbol: SMIM11A
  Gene Name: small integral membrane protein 11A
  ENST ID: ENST00000399299
  CDS Start-End: 146-352
ccccggcaggacggtagaagtcgtggtttgtgcgcggccaggcgctggagcctccgctgccgggagcaatcagaccttccagctgcctctcatgtacttgtctgttgggggcttgtgttgatcaggagtgaattcacagtctaccatgaattggaaggtcctaactgggaccacctactccccttggagggtccggatggagtttcccctctgcggctgcctctcactcatcctccaccactttgccgacaaggaaggaaggacaatcgggaggagggagtcttgcttggcgaccatctggacaatatctcgcccatggcaagctggatccctgtggattactttgagctaaagacatttcataaaatgggcatgaaggattccttcaaatgaagacgtggacaaaatgattggtcaggtcctttgctctactgttgaatggaggaggattttttttttttttccctcacacaggggttttcttggagctcaagtttggatgaccccagacagtaagataatctcatcatggtaaagttaatatgaaatatgtggtctccaaacagcctctcccagaggccaggatcagcaggtttgagtggataattggcttgtggtcattttctcataggatttttcttttagtagtggaaactgtttttcaaatcaaatttggatgccaactatgtggaacagaagtgtggctgctctggtggaagtggcaatggtagtcctagagtctccctgtcagccacaccctttgtctccccctacccaagggaccctgtggcctggaaccgcagtgtgaaatgctatatagtgcaatgaagtcaattcgaagacaagagttctttgcctttctcatctaatttttagttatggatatgagacgcttgttcagaagtatggaaaagtatatataatatgttatcttttagatgtgggtgtaaatatgcttatgtatgcaatatgcttatattttaacgcataaacaacatgaataaagcaaacactctagacttctccaaatgta

SEQ ID NO: 182263 - DNA, 843 bp, Homo sapiens
  Payload ID: 15891
  Gene Symbol: SMIM11B
  Gene Name: small integral membrane protein 11B
  Uniprot ID: P58511
  ENST ID: ENST00000619874
  CDS Start-End: 142-318
ggcaggacggtagaagtcgtggtttgtgcgcggccaggcgctggagcctccgctgccgggagcaatcagaccttccagctgcctctcatgtacttgtctgttgggggcttgtgttgatcaggagtgaattcacagtctaccatgaattggaaggttcttgagcacgtgcccctgctgctgtatatcttggcagcaaaaacattaattctctgcctgacatttgctggggtgaaaatgtatcaaagaaaaaggttggaggcaaaacaacaaaaactggaggctgaaaggaagaagcaatcagagaaaaaagataactgaagattctgccatgtaaatgtcagcttgagtggactccagctgagaagaaagagaagaaagacttaattattgaataatttgtcagaggataaactcccaacctagacctttcacttaaaatagtgtgaatttgtatatgtttttaaaagaaccagtactggccgggtatgctggcttttacctgaaatcccagcactttgggaggccgaggcgagtggatcgcctgagatcgggagtttgagaccagcctggccaacatggtaaaatcctgtctctactaaaaatataaaaattagccaggtgtagtggcgcgcgtctgtaatcccagctactcgggaggctgaggcaggagaattgcttgaatccgggaggtggaggttgcagtgagcctaggtcgtgccactgccctccagcctgggtgacagagcgactgcgtctccaaaaaaaaaaaggtaaaattaaaattaaaaaaaataataataaccagtattttgtttactaaaataaaatgcctttgtaaaaaaa

SEQ ID NO: 182264 - DNA, 1021 bp, Homo sapiens
  Payload ID: 15891
  Gene Symbol: SMIM11B
  Gene Name: small integral membrane protein 11B
  ENST ID: ENST00000612624
  CDS Start-End: 134-340
ggtagaagtcgtggtttgtgcgcggccaggcgctggagcctccgctgccgggagcaatcagaccttccagctgcctctcatgtacttgtctgttgggggcttgtgttgatcaggagtgaattcacagtctaccatgaattggaaggtcctaactgggaccacctactccccttggagggtccggatggagtttcccctctgcggctgcctctcactcatcctccaccactttgccgacaaggaaggaaggacaatcgggaggagggagtcttgcttggcgaccatctggacaatatctcgcccatggcaagctggatccctgtggattactttgagctaaagacatttcataaaatgggcatgaaggattccttcaaatgaagacgtggacaaaatgattggtcaggtcctttgctctactgttgaatggaggaggattttttttttttttccctcacacaggggttttcttggagctcaagtttggatgaccccagacagtaagataatctcatcatggtaaagttaatatgaaatatgtggtctccaaacagcctctcccagaggccaggatcagcaggtttgagtggataattggcttgtggtcattttctcataggatttttcttttagtagtggaaactgtttttcaaatcaaatttggatgccaactatgtggaacagaagtgtggctgctctggtggaagtggcaatggtagtcctagagtctccctgtcagccacaccctttgtctccccctacccaagggaccctgtggcctggaaccgcagtgtgaaatgctatatagtgcaatgaagtcaattcgaagacaagagttctttgcctttctcatctaatttttagttatggatatgagacgcttgttcagaagtatggaaaagtatatataatatgttatcttttagatgtgggtgtaaatatgcttatgtatgcaatatgcttatattttaacgcataaacaacatgaataaagcaaacactctagacttctccaaatgta

SEQ ID NO: 182265 - DNA, 1193 bp, Homo sapiens
  Payload ID: 15891
  Gene Symbol: SMIM11B
  Gene Name: small integral membrane protein 11B
  Uniprot ID: P58511
  ENST ID: ENST00000622934
  CDS Start-End: 146-322
ccccggcaggacggtagaagtcgtggtttgtgcgcggccaggcgctggagcctccgctgccgggagcaatcagaccttccagctgcctctcatgtacttgtctgttgggggcttgtgttgatcaggagtgaattcacagtctaccatgaattggaaggttcttgagcacgtgcccctgctgctgtatatcttggcagcaaaaacattaattctctgcctgacatttgctggggtgaaaatgtatcaaagaaaaaggttggaggcaaaacaacaaaaactggaggctgaaaggaagaagcaatcagagaaaaaagataactgaaggtcctaactgggaccacctactccccttggagggtccggatggagtttcccctctgcggctgcctctcactcatcctccaccactttgccgacaaggaaggaaggacaatcgggaggagggagtcttgcttggcgaccatctggacaatatctcgcccatggcaagctggatccctgtggattactttgagctaaagacatttcataaaatgggcatgaaggattccttcaaatgaagacgtggacaaaatgattggtcaggtcctttgctctactgttgaatggaggaggattttttttttttttccctcacacaggggttttcttggagctcaagtttggatgaccccagacagtaagataatctcatcatggtaaagttaatatgaaatatgtggtctccaaacagcctctcccagaggccaggatcagcaggtttgagtggataattggcttgtggtcattttctcataggatttttcttttagtagtggaaactgtttttcaaatcaaatttggatgccaactatgtggaacagaagtgtggctgctctggtggaagtggcaatggtagtcctagagtctccctgtcagccacaccctttgtctccccctacccaagggaccctgtggcctggaaccgcagtgtgaaatgctatatagtgcaatgaagtcaattcgaagacaagagttctttgcctttctcatctaatttttagttatggatatgagacgcttgttcagaagtatggaaaagtatatataatatgttatcttttagatgtgggtgtaaatatgcttatgtatgcaatatgcttatattttaacgcataaacaacatgaataaagcaaacactctagacttctcc

SEQ ID NO: 182266 - DNA, 1863 bp, Homo sapiens
  Payload ID: 15891
  Gene Symbol: SMIM11B
  Gene Name: small integral membrane protein 11B
  Uniprot ID: P58511
  ENST ID: ENST00000624304
  CDS Start-End: 690-866
gtaagtgtgtgacgtcggggtagaagggagtgacccaaattccaaaagctctttgggatgctgcgatgtcgcggccggccccgcgctcgggttttccctcctagacaaaagtctgccggctcccggtcgcgccgggtcggggatccggaaggtgaaggccgccaggccccacctgcggggcgcccctgctggacctggccgtcgggcgccgtcaacccgttgagcagcgtgttccggctggcacgtggcccgggcggggcccaggattggttcaagcctacggtgttggtccccggagagtctagggagacaagcaatcccctggaatggtgggggaagcgatgacagcccctggtcctcatccgcagctctgggggaagtcggggggtggggagggcgggtgttgctccctgagtgttgggggaagggtatggggagaggaccctgaactagcccccaggttacccaggaggagctgaggcccagagaggttcagcgactcgcccagggttgcacagcgagcacaggcaccgacgtcgccctccgaggcctgggcttccagcagggagagacccggacacctgtcatcgcttctcggtggatccctgaaatatcagaccttccagctgcctctcatgtacttgtctgttgggggcttgtgttgatcaggagtgaattcacagtctaccatgaattggaaggttcttgagcacgtgcccctgctgctgtatatcttggcagcaaaaacattaattctctgcctgacatttgctggggtgaaaatgtatcaaagaaaaaggttggaggcaaaacaacaaaaactggaggctgaaaggaagaagcaatcagagaaaaaagataactgaaggtgagtccacagtacccaaccttgcaaatgggagctggccagtgggttggggtgaccaatcaatgaacaagagaggtctgagacctccctgtccgtcgggtctgaagggctgcgtgggggcatgtggcctcacctgttctctaaggtagaactgctccataaagggccaggtgtgcagatcctggtcctgggatgtgagtgctgctgagccaaggtgcacggagcattagttcatccttcttgaaacctgcggtggcaatggttcttgacaggtattgggttaagaattgaggactcagtgacagctgtggaccttcttcccagagaagcacacatactgaaaccatctgcatttgtgtgtggggagaagtttgcagatgtggggagtcacaggtcatttgaaattccaagattaagaaaccctgttacctttaagataaagtctgactccatggtatgacaaataaatcccttcccagtctggtcttaacccagacctcatttgccacatgtgcccactccccatccccctgcaggccattcctcagccaccatggcctttggccttgcttattaggttcttcccaaggacctcctcaccaggcctgagggtacactcatcgttgtcacccagtgcctatcacagtgcacactggtgggcttagaacacacttggggagttacaatacatcaaggcaccagaaagttcctgttaagcccctgttacagatttaacacatgacaattcacagttaccttgattccagtgtgttgatgcagtttcttcactttgcaggttgagttctgtactttaaaaatcaggggattcagccaggtgtggtgactcatgcctgtaatcccagtgctttgggaggcaaaggtgggaggatcacttgagccaatgagttcaagaccagcctgggcaacatagtgaaaccctgtctctacaaaaattaaaaaaaaaaaacaaaaaaaaccaaaaaaaaaaaccaaaa

SEQ ID NO: 182267 - DNA, 1074 bp, Homo sapiens; identical to SEQ ID NO: 182261
  Payload ID: 15891
  Gene Symbol: SMIM11B
  Gene Name: small integral membrane protein 11B
  Uniprot ID: P58511
  ENST ID: ENST00000624758
  CDS Start-End: 371-547

SEQ ID NO: 182268 - DNA, 1021 bp, Homo sapiens
  Payload ID: 15891
  Gene Symbol: SMIM11B
  Gene Name: small integral membrane protein 11B
  Uniprot ID: P58511
  ENST ID: ENST00000623661
  CDS Start-End: 78-254
atcagaccttccagctgcctctcatgtacttgtctgttgggggcttgtgttgatcaggagtgaattcacagtctaccatgaattggaaggttcttgagcacgtgcccctgctgctgtatatcttggcagcaaaaacattaattctctgcctgacatttgctggggtgaaaatgtatcaaagaaaaaggttggaggcaaaacaacaaaaactggaggctgaaaggaagaagcaatcagagaaaaaagataactgaaggtcctaactgggaccacctactccccttggagggtccggatggagtttcccctctgcggctgcctctcactcatcctccaccactttgccgacaaggaaggaaggacaatcgggaggagggagtcttgcttggcgaccatctggacaatatctcgcccatggcaagctggatccctgtggattactttgcctctgccaagccaagcagccagctcctaggactcccctccctccacctgaggctccttgtcctcccttcctcaggagtctccagcctcccgggacttcccctccccgctgcccactccagcagaggctgccaactgcctgggagagagaagtgggcttcctggggccacctccccaactttggagtgtttggaaggtgatggagcgaccactaggaggcagtgtggacaggtctctgtaggactgctcaggcagacacctttgcagggacctcccaggtcgggagccctccacacttttcccatgggagcttctccctccaccccgagtcactactatctgctttcctagaaggcacttctttacttctaattcttctccactgcccagctcctggtttgttaaggcaaacccccatctctggcttctcctggaacctcacctgggaaagaaagaggcagccccggagctggaagctgcttcagggctcacccggaacagcagactcaacctggacccatccaggcatctcctgggagtttcacccaattgcttctgcctggcaccagctcagag

SEQ ID NO: 182269 - DNA, 684 bp, Homo sapiens
  Payload ID: 15892
  Gene Symbol: SMIM12
  Gene Name: small integral membrane protein 12
  Uniprot ID: Q96EX1
  ENST ID: ENST00000417239
  CDS Start-End: 396-674
gccaccttttgggggagagtgggtggaggatgttgtgattttacactagggagtttgggctgtcattcattcgttcagcagaccttttttgggcactctgccaggcagggtaggagaggtgcctggatggatagggcataattgggccagacagacacggttcttagccttttggagcttaaagtgtcttgagaaacgcagacagggaaaaggaacgacttttcatattgtgaaaccaggagattcatcgtagattgtgtttcatggggaaaaggtggccggctgtgctcatggagaaatttcatagagcagagaaaggcatctttttcccttcttgaaatgttggcagactaggtcctggggtcaacaataggcttgaagctctattagatgtcatgtggcctgtgttttggaccgtggttcgtacctatgctccttatgtcacattccctgttgccttcgtggtcggggctgtgggttaccacctggaatggttcatcaggggaaaggacccccagcccgtggaggaggaaaagagcatctcagagcgccgggaggatcgcaagctggatgagcttctaggcaaggaccacacgcaggtggtgagccttaaggacaagctagaatttgccccgaaagctgtgctgaacagaaaccgcccagagaagaattaatggaggacac

SEQ ID NO: 182270 - DNA, 3454 bp, Homo sapiens
  Payload ID: 15892
  Gene Symbol: SMIM12
  Gene Name: small integral membrane protein 12
  Uniprot ID: Q96EX1
  ENST ID: ENST00000521580
  CDS Start-End: 146-424
ctgcgctccgagagagccggcggccagtgggcagggtcacagggcaaggtcccgcgggccgctgggtgcggcgacttccgtgctcccggcgagcgggcggagagcgggggccgcactggggagtgtgggctgggccgcagatgtcatgtggcctgtgttttggaccgtggttcgtacctatgctccttatgtcacattccctgttgccttcgtggtcggggctgtgggttaccacctggaatggttcatcaggggaaaggacccccagcccgtggaggaggaaaagagcatctcagagcgccgggaggatcgcaagctggatgagcttctaggcaaggaccacacgcaggtggtgagccttaaggacaagctagaatttgccccgaaagctgtgctgaacagaaaccgcccagagaagaattaatggaggacacagggccctatggtcctactgtgggtggtgacttgtcctgctaccatgttgacagagccccagaacccacatctaattggctttgttgcttattctggcccttcccacaccacacagccacacaaatactggctgctccttgatggccaggcagacccagcagcagccgaggggccagtgaagaggaaggccgcatctgttgtgtggtggccacaagcactcaggcatctgagtttactggtgcactgctgggaggagagttatgagatgaacattggctgtcaatctctgtgggcaggcggtttggcctctagtgggaatggctgggatttgggcgttgcctttaggagggatacctgcatgtctagttccagtctgcactggaaagaattcaaatatgcacctggctcccttcactattttgccctatcctttgtgctcattcttactgaaatctgtcttgtcagctcaggaatgggattcccccaggaaggaaagcacttttctgttctgggaagcccagactgttcactttggggcagggacgaacatgtgcctcgtgaatttgcttgaaaacagtcaccatcttctacccccatcactgtatagtgaaaaacctgattaaagtggtatctgagaaccataatgatcgaatcttatcatccaggtggtatttgggggtcttcttaggagttaggcaagtacaggcattttagagcaggataacattggtattaaagggtgccaaggagccctggaaactgctttactagtgcggttgcactgaaccctggaggcacagattcccaggaacctttttaccattattacaattggctgcagcaccttcaagtctaaatggaggtagacctcacatacacacacatagacgcctttccctataaaagtatatacgcacattcaagaaaatttggtagggattttaaaaaggtcacccatgttcccagctcgttaataacaaccgttaacattttgttgtcttttactaattctctgcataggttttagagatagttatcattactgtacatttaattttatatacttttctcactattatcattttcccattttacatggtcatcataattggttttttggagacagggtctcactctgtcacacaggctggagtgcagtacaattacggctcagtgcaaccttgacctcctgggctcaagtgatcctctcacttcagctcctcaagtagatgggactacaggagtatgccaccatgcccagctaatttttttatttttttgtagaaccaggtctcactatgttgcccaggctagtctcaaactcctgggctcaagtgatcctccggccttggcctgtagtttcttttttctttttttttggagatggactctcattctgtcacccgggctggagtgcagtggcgtgatcttggctgactgcaacttctgcctcctgggttcaagcgattctcctacctcagcttcctaagtagctgggattacaggcgtgcgccatcgtgcctggctagtttttgtgtttttagtaaagacaggggtttcaccatcttggccaggctggtctcgaactcctgacctcaagcgatcccatctgcctcggcctcccaaagtgctgggattacaggtgtgaggcaccgtgcctggcagtctgtagtttttttttgttgttgttgttgttgttgttttaaatatggagtctcgctgtattgcccaggctggagtgcagtggcgcgatcttggttcactgcaacctccacctcttgggttcaagcgattctcctgcctcagcctcctgagtagctgggattacaggtgtgcgccgctacgcctggctaatttttgtatttttagtagagacagggtttcaccatgttggtcaggctggtctcaaacttctgaccttgtgatctgcctgccttggcctcctaaagtgctgggattacaggcgtgagccaccgtgcctggctgtagttgtttataatagcaacataattgtctatcaagtgggagtatgacataagtttatcctggacaatttccatattgctggacatttgaattgtttctggttggtcactcgtttagatactgcaacgaatatcttatatgaagcttttcctgcgttttggaataaacagtaaaaatagtaaatgtcattttggatgaaatgggataaatgagcagttttgaggatctcatgcataacaccaaatgtctttccaaaagggctctaggagtttctactaaatcttaccactgaagacgttgctggtaaggctgtgaggggagtaaaagcagagagcaggaagaagcataagaagctgttgcctcttgaagcctactgatgtttaactaaagtcagcacagggcagtagtgagcatttgatgaattgatctgcctctaaaagggagtgggtattggccctgcttcttaggttctctctcgtgaggcctgatggtgtccacaggtgggtgagggtggagttcctgaacagttagaggggccagctgtgaagaggtgccagctggaggtgccttccaggacctggtggtggcctgagaggagggagcaggttgagtcgttggcttcttctaaggctccctgaggcctagtgggaatgcggaaatgagctgctgttgcttcccagggaacaaatcggatggaacttgggaagagactgtcagctaccaagtaaggagatttctggttctggctgcaggttctggctgatgagcaggccttatcggcacaccagtgctgccaccctatggcagtcctgggcattaccaagcctgcagtcacttccctgggctaaaccaaacactagtgctgacagaggtcaggtgacaaatgagccaccacgctggcagaaagtatagacctgccgaaagggggcagtggtgactcaccttccaatctgctgctcatccagtggtaccagatttttgaatttttctaaaagatgttctaagagctccagagggggtaaaaaaaaaaaaa

SEQ ID NO: 182271 - DNA, 897 bp, Homo sapiens
  Payload ID: 15892
  Gene Symbol: SMIM12
  Gene Name: small integral membrane protein 12
  Uniprot ID: Q96EX1
  ENST ID: ENST00000423898
  CDS Start-End: 269-547
gagagcgggggccgcactggggagtgtgggctgggccgcaggtgagcgcgcggtcccggcgagcaggtcgggtcagcccaggccagtaacctctgagttacgggaggagtgatcgctagggtccaccccggtcccggccagatctgccagctcccctctctggcgggtgttctggtgccaagtctgggagcccaggtagccctccgcagacagggcttctcggcacctcaatgaggacggacgttgatgaggccatgaatgagatgtcatgtggcctgtgttttggaccgtggttcgtacctatgctccttatgtcacattccctgttgccttcgtggtcggggctgtgggttaccacctggaatggttcatcaggggaaaggacccccagcccgtggaggaggaaaagagcatctcagagcgccgggaggatcgcaagctggatgagcttctaggcaaggaccacacgcaggtggtgagccttaaggacaagctagaatttgccccgaaagctgtgctgaacagaaaccgcccagagaagaattaatggaggacacagggccctatggtcctactgtgggtggtgacttgtcctgctaccatgttgacagagccccagaacccacatctaattggctttgttgcttattctggcccttcccacaccacacagccacacaaatactggctgctccttgatggccaggcagacccagcagcagccgaggggccagtgaagaggaaggccgcatctgttgtgtggtggccacaagcactcaggcatctgagtttactggtgcactgctgggaggagagttatgagatgaacattggctgtcaatctctgtgggcaggcggtttggcctctagtgggaatggctgggatttgggcgttgc

SEQ ID NO: 182272 - DNA, 2618 bp, Homo sapiens
  Payload ID: 15892
  Gene Symbol: SMIM12
  Gene Name: small integral membrane protein 12
  ENST ID: ENST00000426886
  CDS Start-End: 65-289
gctcccggcgagcgggcggagagcgggggccgcactggggagtgtgggctgggccgcagatgtcatgtggcctgtgttttggaccgtggttcgtacctatgctccttatgtcacattccctgttgccttcgtggtcggggctgtgggttaccacctggaatggttcatcaggggaaaggacccccagcccgtggaggaggaaaagagcatctcagagcgccgggaggatcgcaagctggatgagcttctaggcaaggaccacacgcaggtggctggaatgaggctgtgaggctccagcagccgttttgtgccacgaggcagtagaaacctgggttcctgatgactgtggagctgccgaactaatctggacctccagattccatacctgcaagacacatgaacatctgtcttatccatccctggagaggatccctggagaggagcaaacccaggccatccggattttctgcatgggagacctggctgaccgctgcctgggctgctttcaagtctcaccgaattatgaagtcaactactgggtgtttagaatgtctcaagttcaaagactagcaggctagaagcagacatctgagagaacttcgggcaccttagcaggaggaatattaagatgtggcatgctgggcttatcgggagactggatagggatcagaaggaatacatttctattctgcgagctgcagagctcaggagtcgttctgatatcaggcccattgctgactctgctaggaaatgtggaaagctgcagctgcagacagctggctgtgcctgcttcactggagttctcagctctcttacacctgtctgtttagaaaggagcagacaggctgtgaagctctgcaggattcttttcagtgctggggcagaaggagaaatggtggggacagccactctgggcatcagaaccgaatacctgctccccactcctctcagttgcacagcccagctcctggcttcactgcagtgggaagggagatgaaggactcttgaactcagaatatgactgaccaagacccttacagctggggtggaggtagggggctgaaggcaggttctggaggtggagattgagtcttccagttgttttcctggcaacagcgggaacaatagattctaggttctggctggctcaggagttggggtgtctgacctgtctttcctcagtcccttctgctatagatactgatagtcctctgccaccaggctctgcctaccaagtccctgagctcttcctgacctagcctggctctgagaggggagccagcatggcagagggtgggcctggtaccagttgtgtctccctgaatacaggatctgagagctggggagctatggacacccagagcccatcagcctggtctctcccctcactgtaggttcccaggccagtggctggttcctgattttacctagtcttctgcactgggataagaacctgacatccagcttcccctttgggagtaaggcctcttccacgggctgctcctggtctgtgttttccactgcagtctgggagcctacttcccccatgaaggccctaaccccacccatgaagacactacatgaattactgtccagactggactccagatgcagcctcggattagacccaatttggcctcatctccttggagctgtctagtaatttggaatacacgctgctccctacttagccacctgcaaagcagggtccatctcccagcctggttctgccttttcctcagtcttatatgtgtgtgtctgagtacatgtgtcagtcagtgatcatgccaggacggccagctggacttgtgtcagcatgcacatatgttccttgaggctgtcccgtgcaggcgtgcactgagttctcagcccagttctgaagcgtgtttgtgaatatgcccagatacatcatgaacattgctgggatgctaggagggggatcagtatgaatgacattgcatgtcctcaagtacacaggtatgtgtctacgcacacgcacaaacctctctaatatgtatgtatgcacgtgtacatgtgtataatatggctaagtgtgtgtctgggagtatttgaccatgtctgatgtgaatcttctgcccattctgaaaggaaaggggacatgggcccactctccctttttgtagttacactgtggtcagggctggcttgtgacagagggagtcaaggtgagtgcccctctgaacttctgggatctttctgcctaacattctgagacttccccagctgttccctagtcctgcagccttggctgtcagtacttcaagattatctggccaggcgtggtggctcatgcctgtaatcccagcattttgggaggccgaggcgggcagatcatttgaagtcaggagtttgagaccaggccaacatggtgagaccccatctctactaaaaataaaaaaattagccaggtgtactggcacgtgcctgtaatcccagctacttgggaggctgaggcaggagaatcacttgaatccaggagacagaggctgaagtgagtcgagattgcaccactgcactccagcctgggtgacagagtgacacttggtctcaaaaacaaacgaacaaacaacaaacaaacaaaaaaaaaaaaaaaaaaa

SEQ ID NO: 182273 - DNA, 918 bp, Homo sapiens
  Payload ID: 15892
  Gene Symbol: SMIM12
  Gene Name: small integral membrane protein 12
  Uniprot ID: Q96EX1
  ENST ID: ENST00000456842
  CDS Start-End: 110-388
ctgggtgcggcgacttccgtgctcccggcgagcgggcggagagcgggggccgcactggggagtgtgggctgggccgcaggtgagcgcgcggtcccggcgagcagatgtcatgtggcctgtgttttggaccgtggttcgtacctatgctccttatgtcacattccctgttgccttcgtggtcggggctgtgggttaccacctggaatggttcatcaggggaaaggacccccagcccgtggaggaggaaaagagcatctcagagcgccgggaggatcgcaagctggatgagcttctaggcaaggaccacacgcaggtggtgagccttaaggacaagctagaatttgccccgaaagctgtgctgaacagaaaccgcccagagaagaattaatggaggacacagggccctatggtcctactgtgggtggtgacttgtcctgctaccatgttgacagagccccagaacccacatctaattggctttgttgcttattctggcccttcccacaccacacagccacacaaatactggctgctccttgatggccaggcagacccagcagcagccgaggggccagtgaagaggaaggccgcatctgttgtgtggtggccacaagcactcaggcatctgagtttactggtgcactgctgggaggagagttatgagatgaacattggctgtcaatctctgtgggcaggcggtttggcctctagtgggaatggctgggatttgggcgttgcctttaggagggatacctgcatgtctagttccagtctgcactggaaagaattcaaatatgcacctggctcccttcactattttgccctatcctttgtgctcattcttactgaaatctgtcttgtcagctcaggaatgggattcccccaggaaggaaagcacttttctgttctgggaagccc

SEQ ID NO: 182274 - DNA, 2817 bp, Homo sapiens
  Payload ID: 15892
  Gene Symbol: SMIM12
  Gene Name: small integral membrane protein 12
  Uniprot ID: Q96EX1
  ENST ID: ENST00000446026
  CDS Start-End: 1890-2168
agcaaaggcatctgttatgctcctgccaccttttgggggagagtgggtggaggatgttgtgattttacactagggagtttgggctgtcattcattcgttcagcagaccttttttgggcactctgccaggcagggtaggagaggtgcctggatggatagggcataattgggccagacagacacggttcttagccttttggagcttaaagtgtcttgagaaacgcagacagggtaagccagcatcgtgcctgacacagagtaagtggttataagtgtcgaataaaggaatgaattgacttatttgggaatgattagaatgtgagcaggacggtagcgagagactttatgctgcatgtgagagatagttgtgaactcatgcgcgatatgttttaagacaggtttggaaatctgaacggacagttgctatttagggaagcatttacttatacagaggacttgctttaaaggtggaagtaaaatggagaagtattaggtttgggattcttcagaggtgcctcttttaactattactatgtctctgaatttcataaatccctgagtacaatctcagagtttgggaaaaggaaagctcttctaggtaatgaaatgccaggctgatgggaaaaaactgtaggaagctctccctaagtccagggtttggacagaaaccgtatacctctgcagtgtgttcttcccactagaaagagtgtaggctttgaaattggagaggcctgggttcaaaatcagtggctctatcacttctagtgatcttggataagttaacataatgtctgtgagcctttgtggccttcacaagagtctgggctaataattcctacatcatagaggtgttatgaggatcaaatgatgattagtgtgtaaattgtcatcatagtgcctggtgctgagacaataagcgggggagtcttggagatgctgcaattttttttttttttttaaatttcatgatgctgccttattgcaggggtccttaaccccctgggccacagaccagtggtggtcttcagcccattagaaactgggctgcacagcaggaggtgagcggtgggcaagctggcaagcattaccgcctgagctccaccttctgatagatcagcagcggcattagattctcacaggagtgcaaactctattgtgaactgcgcatgtgagggatctacgttgtgtgccccttatgagaatctaatgcctgatgatctgagctggaacagtttcatcccgaaaccatccctctccaacccccatctgtggaaaaattgtcttccacgaaactggtccctggtgccaaatatagattggggaccgctgccttatagtgttacgtctagagaacattgggattccttcaaagagaattggaaccaaagagagagggggagaatcatcttatccttggtgaggtttcgattgttcactttagatcagagatagtagtgttggagaaatacctacaggggcataaacagaaagatcttttagtggatacttttgggcaagtctcttaaccctctgatagtgggttatgtatctacctcacgtggtggacatgaggattaagagagtgagtgtatatgaagcacctagcccaaggcctggcatgtaagtgctcaataaatggtagctgtgttattataactgtgaatgatctttgataattgataatggtaataatcatttgagatggaattggccattagagtgatccaatttgtgtgtttttacattactttggtattgccctacttcaattcaggaggccctgaggccattccactccgctccccgccccaccccaccccaccccaccccccgggcttgtacagtgatttttcacagaaaatcttcaggttctgcggtatccagaatgtcatgtggcctgtgttttggaccgtggttcgtacctatgctccttatgtcacattccctgttgccttcgtggtcggggctgtgggttaccacctggaatggttcatcaggggaaaggacccccagcccgtggaggaggaaaagagcatctcagagcgccgggaggatcgcaagctggatgagcttctaggcaaggaccacacgcaggtggtgagccttaaggacaagctagaatttgccccgaaagctgtgctgaacagaaaccgcccagagaagaattaatggaggacacagggccctatggtcctactgtgggtggtgacttgtcctgctaccatgttgacagagccccagaacccacatctaattggctttgttgcttattctggcccttcccacaccacacagccacacaaatactggctgctccttgatggccaggcagacccagcagcagccgaggggccagtgaagaggaaggccgcatctgttgtgtggtggccacaagcactcaggcatctgagtttactggtgcactgctgggaggagagttatgagatgaacattggctgtcaatctctgtgggcaggcggtttggcctctagtgggaatggctgggatttgggcgttgcctttaggagggatacctgcatgtctagttccagtctgcactggaaagaattcaaatatgcacctggctcccttcactattttgccctatcctttgtgctcattcttactgaaatctgtcttgtcagctcaggaatgggattcccccaggaaggaaagcacttttctgttctgggaagcccagactgttcactttggggcagggacgaacatgtgcctcgtgaatttgcttgaaaacagtcaccatcttctacccccatcactgtatagtgaaaaacctgattaaagtggtatctgagaa
